US007867704B2

(12) United States Patent
Kapur et al.

(10) Patent No.: US 7,867,704 B2
(45) Date of Patent: Jan. 11, 2011

(54) MYCOBACTERIAL DIAGNOSTICS

(75) Inventors: Vivek Kapur, Shoreview, MN (US);
John P. Bannantine, Ames, IA (US);
Ling-Ling Li, Moundsview, MN (US);
Qing Zhang, Seattle, WA (US);
Alongkorn Amonsin, Lopburi (TH)

(73) Assignees: Regents of the University of Minnesota, Saint Paul, MN (US); The United States of America as represented by the Secretary of Agriculture, Washinton, DC (US)

( * ) Notice: Subject to any disclaimer, the term of this patent is extended or adjusted under 35 U.S.C. 154(b) by 1020 days.

(21) Appl. No.: 10/934,893

(22) Filed: Sep. 3, 2004

(65) Prior Publication Data
US 2007/0042383 A1 Feb. 22, 2007

Related U.S. Application Data

(63) Continuation of application No. PCT/IB2003/006509, filed on Mar. 6, 2003.

(60) Provisional application No. 60/362,396, filed on Mar. 6, 2002.

(51) Int. Cl.
*C12Q 1/68* (2006.01)
*C12N 1/12* (2006.01)
*C07H 21/04* (2006.01)

(52) U.S. Cl. .............................. 435/6; 435/4; 435/40.5; 435/41; 435/243; 435/253.1; 435/320.1; 536/23.1; 536/23.7; 536/24.3; 536/24.32

(58) Field of Classification Search ..................... 435/4, 435/6, 40.5, 41, 243, 253.1, 320.1; 536/23.1, 536/23.7, 24.3, 24.32
See application file for complete search history.

(56) References Cited

U.S. PATENT DOCUMENTS

| | | | |
|---|---|---|---|
| 4,918,178 | A | 4/1990 | Hurley et al. |
| 5,314,801 | A | 5/1994 | Nycz et al. |
| 5,504,005 | A | 4/1996 | Bloom et al. |
| 5,589,585 | A | 12/1996 | Mabilat et al. |
| 5,703,217 | A | 12/1997 | Mabilat et al. |
| 5,849,901 | A | 12/1998 | Mabilat et al. |
| 5,968,815 | A | 10/1999 | Murray et al. |
| 5,985,576 | A | 11/1999 | Ellingson et al. |
| 6,387,372 | B1 | 5/2002 | Cocito et al. |

FOREIGN PATENT DOCUMENTS

| | | |
|---|---|---|
| EP | 0 795 611 | 9/1997 |
| EP | 1 223 225 | 7/2002 |
| JP | 06-133775 | 5/1994 |
| WO | WO 00/34517 | 6/2000 |

OTHER PUBLICATIONS

GenBank Accession No. AF445420 dated Apr. 16, 2002.
GenBank Accession No. AF445421 dated Apr. 16, 2002.
GenBank Accession No. AF445422 dated Apr. 16, 2002.
GenBank Accession No. AF445423 dated Apr. 16, 2002..
GenBank Accession No. AF445424 dated Apr. 16, 2002.
GenBank Accession No. AF445425 dated Apr. 16, 2002.
GenBank Accession No. AF445426 dated Apr. 16, 2002.
GenBank Accession No. AF445427 dated Apr. 16, 2002.
GenBank Accession No. AF445428 dated Apr. 16, 2002.
GenBank Accession No. AF445429 dated Apr. 16, 2002.
GenBank Accession No. AF445430 dated Apr. 16, 2002.
GenBank Accession No. AF445431 dated Apr. 16, 2002.
GenBank Accession No. AF445432 dated Apr. 16, 2002.
GenBank Accession No. AF445433 dated Apr. 16, 2002.
GenBank Accession No. AF445434 dated Apr. 16, 2002.
GenBank Accession No. AF445435 dated Apr. 16, 2002.
GenBank Accession No. AF445436 dated Apr. 16, 2002.
GenBank Accession No. AF445437 dated Apr. 16, 2002.
GenBank Accession No. AF445438 dated Apr. 16, 2002.
GenBank Accession No. AF445439 dated Apr. 16, 2002.
GenBank Accession No. AF445440 dated Apr. 16, 2002.
GenBank Accession No. AF445441 dated Apr. 16, 2002.
GenBank Accession No. AF445442 dated Apr. 16, 2002.
GenBank Accession No. AF445443 dated Apr. 16, 2002.
GenBank Accession No. AF445444 dated Apr. 16, 2002.
GenBank Accession No. AF445445 dated Apr. 16, 2002.
GenBank Accession No. AF445446 dated Apr. 16, 2002.
Bannantine and Stabel, "HspX is present within *Mycobacterium paratuberculosis*-infected macrophages and is recognized by sera from some infected cattle," *Vet. Microbiol.*, 2000, 76:343-358.
Bannantine and Stabel, "Identification of two *Mycobacterium avium* subspecies *paratuberculosis* gene products differentially recognised by sera from rabbits immunised with live mycobacteria but not heat-killed mycobacteria," *J. Med. Microbiol.*, 2001, 50:795-804.

(Continued)

*Primary Examiner*—Rodney P. Swartz
(74) *Attorney, Agent, or Firm*—Fish & Richardson P.C.

(57) ABSTRACT

The present invention provides nucleic acid molecules unique to *M. paratuberculosis*. The invention also provides the polypeptides encoded by the *M. paratuberculosis*-specific nucleic acid molecules of the invention, and antibodies having specific binding affinity for the polypeptides encoded by the *M. paratuberculosis*-specific nucleic acid molecules. The invention further provides for methods of detecting *M. paratuberculosis* in a sample using nucleic acid molecules, polypeptides, and antibodies of the invention. The invention additionally provides methods of preventing a *M. paratuberculosis* infection in an animal.

41 Claims, 116 Drawing Sheets

OTHER PUBLICATIONS

Bannantine et al., "Genome Scale Comparison of *Mycobacterium avium* subsp. *paratuberculosis* with *Mycobacterium avium* subsp. *avium* Reveals Potential Diagnostic Sequences,"*J, Clin. Microbiol.*, 2002, 40(4):1303-1310.

Bannantine et al., "Identification of *Mycobacterium paratuberculosis* gene expression signals," *Microbiology*, 1997, 143:921-928.

Brosch et al., "Comparative genomics of the mycobacteria," *Int. J. Med. Microbiol.*, 2000, 290:143-152.

Cole et al., "Deciphering the biology of *Mycobacterium tuberculosis* from the complete genome sequence," *Nature*, 1998, 393:537-544.

Collins and Sockett, "Accuracy and economics of the USDA-licensed enzyme-linked immunosorbent assay for bovine *paratuberculosis*," *J. Am. Vet. Med. Assoc.*, 1993, 203(10):1456-1463.

Cousins et al., "Mycobacteria distinct from *Mycobacterium avium* subsp. *paratuberculosis* isolated from the faeces of ruminants possess IS900-like sequences detectable by IS900 polymerase chain reaction: implications for diagnosis," *Mol. Cell. Probes*, 1999, 14:431-442.

Dubash et al., "Evaluation of an enzyme-linked immunosorbent assay licensed by the USDA for use in cattle for diagnosis of ovine *paratuberculosis*," *J. Vet. Diagn. Invest.*, 1995, 7:347-351.

Ellingson et al., "Evaluation of the accuracy and reproducibility of a practical PCR panel assay for rapid detection and differentation of *Mycobacterium avium* subspecies," *Mol. Cell. Probes*, 2000, 14:153-161.

Ellingson et al., "Identification of a gene unique to *Mycobacterium avium* subspecies *paratuberculosis* and application to diagnosis of *paratuberculosis*," *Mol. Cell. Probes*, 1998, 12:133-142.

Eriks et al., "Rapid Differentiation of *Mycobacterium avium* and *M. paratuberculosis* by PCR and Restriction Enzyme Analysis," *J. Clin. Microbiol.*, 1996, 34(3):734-737.

Harris and Barletta, "*Mycobacterium avium* subsp. *paratuberculosis* in Veterinary Medicine," *Clin. Microbiol. Rev.*, 2001, 14(3):489-512.

Mahairas et al., "Molecular Analysis of Genetic Differences between Mycobacterium bovis BCG and Virulent M. bovis," *J. Bacteriol.*, 1996, 178(5):1274-1282.

Marsh et al., "Quality control and optimized procedure of hybridization capture-PCR for the identification of *Mycobacterium avium* subsp. *paratuberculosis* in faeces," *Mol. Cell. Probes*, 2000, 14:219-232.

Stabel and Whitlock, "An evaluation of a modified interferon-γ assay for the detection of *paratuberculosis* in dairy herds," *Vet. Immunol. Immunopathol.*, 2001, 79:69-81.

Stabel et al., "Comparison of polyclonal antibodies to three different preparations of *Mycobacterium paratuberculosis* in immunohistochemical diagnosis of Johne's disease in cattle," *J. Vet. Diagn. Invest.*, 1996, 8:469-473.

Whipple et al., "Isolation and Analysis of Restriction Endonuclease Digestive Patterns of Chromosomal DNA from *Mycobacterium paratuberculosis* and Other Mycobacterium Species," *J. Clin. Microbiol.*, 1987, 25(8):1511-1515.

Van der Giessen et al., "Comparison of the 23S ribosomal RNA genes and the spacer region between the 16S and 23S rRNA genes of the closely related *Mycobacterium avium* and *Mycobacterium paratuberculosis* and the fast-growing *Mycobacterium phlei*," *Microbiology*, 1994, 140:1103-1108.

Vary et al., "Use of Highly Specific DNA Probes and the Polymerase Chain Reaction to Detect *Mycobacterium paratuberculosis* in Johne's Disease," *J. Clin. Microbiol.*, 1990, 28(3):933-937.

Notice of reasons for Rejection, JP Application No. 2004-568446 mailed May 12, 2009, 7 pages.

```
Gene 10 (SEQ ID NO:1)
GTGCGCCCGCACACCGGCGGACGGCGGATCAGCATCTACTGGACGTGGAGCTATCCGTGGGAATCGCAGCGCGACAT
TCAGACCCTGGACAACCGCTTCTCCACCATGACCGAAGTGCGCAGGGCGGCCTGGCCCCGATACGAGGGGCCCGACT
GGGACGACGCCCACTTTCTGCAGGGCATCGCCGGCACCTTGGAGCTTTTCCACCGCTCGACGCTTGCGTTCCAGGAG
CTGGCCGGCGAAGCAACCGGTCAGCAGGTGGCGGTGTTCCAGCGCGTCGACCAGGCCGGCTACCGGCTGGTGATCGA
CGAGCGGATATTGGCCGACACCGACACCCTGATGGTGTTCGGGCTGGACCATCTCGCCGGGGAAGACGAGGCCGAGC
CCGGGGAGATCTCGGCCATCCGTGCCTGGCTGGAACGCGAGGGCACCTGCCTGCTGCTGGCCCCGCACCACGACGTC
GGCGGCACCGACGACATGGCCCAGCGGCAGGTCGAATACCTGCACCACGGGGATCCGCTCGTGCCGCGGCAACAACG
GTTTTCCGCCTACACCCGCTCGCTGATGAAGGGGCTCGACGTTCCCGTCCGCAACAGGTGGGGCCTGCATCCGGCCC
GGGTGGCCGCGACCGGTCAGATGGCACCGCTGACCTGCTTTCGCGACCTGGACGCGCCCGGGCTGCTGGACGATGTC
ACGACGCTGAACTTTCACCCGCATCTGCCGCACTACGAGCTCACCGCCCCGGAAAGCGACGGGCTACGGGTGCTGGC
CACCCAACGCGTCGACCCGGCCCGGCCCCATCCCTTTACCGAGGCGGGCAACAGCGAATTCAACGCGTTGATCTGGA
TGCCGCCGCACGCCGAACGAGCCGGTGACATCGTGCTCGTCGACTCGACCAACTTCACGACGCTGTTCGGCGGGTCC
GACAGCCTCAGAAACTTCTGGCACAACCTGGCCACGATGAGGTGA Gene 11 (SEQ ID NO:2)
ATGGTGGCAACCGAACACGAGTGGAGCAAACCCGCGGCCCTGGCCATTCCCAGGGAGGGCTACTTCGAGCTCGAACG
CGGTCGTTACGGGCCGCTGTATCCCCGCACCCCGGCCTGCTACGGCTTTTCCATCATCGCCAAGGTCAAGGAGGGCC
GCGAGGAAGCCGTCCGCGCCTACGGCAAACAGATCGAAGAGGCCATCAAGGCCGATCCGCACGTGCTTGCCGCGCTG
CGGCTGCACTACCTGCGCTGGTTGCTCTTCGACGTCGGATCGGGACTGCACTTCCAGTACCAGGGCATCTTCGACAC
GGACTTCGACAAGTACACCGAGGACGCGGTGCAGCTGTTCAGTCAGACCGGGATCACCACCGTCTTCACGAACCTCG
AGGGGTTTCCCGAAGACTGGCGGGAGAACCCGGACGCCTTCGTCAAGTTCGTGCGTGAGCACCAGTGCCCGAGCTTT
CTGGAGTACGGGGAGTATCCCTACGTCACCGCCGACGAGATCAAAAAGGCGTACGGCTCAAGCCGCCTCCCAGACCA
TGCTGGATCAGATGCAATGACGTCGGTCAGAGTCTGA Gene 38 (SEQ ID NO:3)
ATGGTGGTAAGCATTTCGGCTCCCACGGTGCCGATACCCCAGGCGATGACGTTCAGCGGTCTGCGGTCAGACATCGG
ACAGAAGCCGACGCGTGGGCAGCACCGTCAACGGGACGCCGCGATCTTCGAACTGCCAGTTCGGCCCATGAGAGATG
TAGGTCATTTCGACTTCCTCCCGGCGCTTCGCTTCGGTGTCCGACCACCGGATGTCGACGACCAGGTCGCTGGCCTC
GTAGGTCGCGTGCAGATCCGACCAGTGCGGATCGACACCGGTGGCCATGACCTCGAGGGGACTGACATCGTGCGTCG
ACAGCGTCGCCATCCAACTGCGGTCGCGGACGGCGGGGAGTTGCTTGGGATGCGCACCCGCACCGCGTCGCGCGCT
CCTGTCCCGAGGCGCTCCACGGATGCTCCGGTGTAGGCGAACGGGCGCAGGCGGATGCAAATCGAGGACCGAAGC
AAGGTCATCTGCGCCGACGCCAAACCCGAGGCTGCTTGATGCGCGCCGAACCGACGTAG Gene 56 (SEQ ID NO:4)
ATGAACACTTCTTCCTCTCTACCTGTCGACACCCTGGACGTCACCGCACCACCGGATGCCACTGAGGTTTACGGCTG
GGCAGCGCACCCAGACGGTCTGGCCGCCCGTGCATTCGAAGCAGCGGTGCGTGACTGCGCCGGCTACCGGGTCCGGG
TGCGCGGTGCGCAACGCTCCAACGTCACCTGCCGCCGCTGGGTGGCCATCGAAGCCGCACCCGGCGCCGACGAGCAA
GCGTTGGAGCCCGAAGCGGTGCGGCAGCTGGCGCCGCAGATGAGCGTCACGCCTACCACGCGCCGGACAGCTGAGAT
GCTCGACGACGCCGCCTTCGATGCGATCGTCGCGGTGTTCAGTCAACGGGCCCGATGCGAGATGCAAACGCTGTCGG
GAGGCAAGTGCCCACGGGCTGCGCGCTGGCGCATTGATTTGCACGGGTGCGAACAGGCCATTGTGTGCGGGCAGCAC
AAGAAAGCGTGGCTGCAGGAGGCCCTAGCCAACCTCTGGCGCGGCATTCAACCTCGCTGCGCCCACTGCGGAAGAGT
GTTCAACAGCTTCCAAGACGCGGTCAGGATCACCGCGATATGA Gene 57 (SEQ ID NO:5)
ATGGCCACCAACGACGACCAAGACGACGGGAAGCCACCCATTACCGCGGCCGCTGGCGGTGATGAGACCGCGATCGG
GGCGGCCGCTGATGAAACCGAGCTCGTCGCGCCGCTCACCGTGCCCGCGTCCGAGTTGGCCTGGTCCCACGAGGACA
GCGACGCTGGTGATTACTCGTGGGGCCGGGCTGCGGAACGCGCCAGCATCATCGTGCTCGCCTGTGCGGCGGTCGCT
GTCGTGATCGGTTTGCTGACCTGGCTCGCCTTGCACCTACACGACCAGGCCAAGCCGACAGCCGGCCCGACGGCCGC
GCG Gene 128 (SEQ ID NO:6)
ATGAGCGCCAGGGATCTCATCAACATCGGGGTCTTCGGCGCTCTCTACATCGCCACTGTGTTCGCGATCAACGTGTT
CGCTTTCATCAATCCGCTCGTCATGTTGGTCGCCCTGGCGGTCAGCATGATCGCCGGCGGCGTGCCGTTCATGTTGT
```

Figure 2-1

```
TCCTCACCCGGGTGCGACATGCGGGCATGGTGACGGTGTTTGCGATTATCACGGCCGGACTGCTCGCACTGACCGGG
CACCCCCCGATCTGCTTCGTGATCACAGTTGCGTGCGCGTTGGTGGCCGAAGTCGTCCTGTGGCTGGGACGCTATCG
CTCCCGCACCATGGGTGTACTGGCGTACGCAATCTACGCGGCGTGGTACATCGGGCCGCTGCTGCCCATCTTCTACG
CTCGCGATGAATATTTCTCCAGTCCCGGCATGGCACAGATGGGTCCGCGCTACCTCGAAGAGATGGAACGGTTGTTG
TCGCCAGCCGTGCTAATCGCATTCGACCTGTCCACGGTGGTATTCGGGCTGATCGGCGGACTGCTCGGAGTAAGGTT
GCTGCGCAAGCATTTTCAGAGGGCCGGCCTAGCTTGA

Gene 135 (SEQ ID NO:7)
ATGGCGGGGATGCCGGAGGAGGTCGCTGCGCTTCTGCGCGGTTTCCCACGCATCGGCGCGCGCGAGCAGGCGTTTGC
GTTCTTGACCGTTGACACTGGCGGGTTTCCACATGCGGCGTTGCTGTCGCGCTGCGAGCTCGAGCCTGGGCGGGACC
CCCAAACACTGATGGCCGCCATAGCTAGCCGACAGACCCGCGCCAACTTGCGGCGTAGCGGCACCGCGGGGCTGCTC
GCAATCAATGGCACTAGTTGCCACCACCTCAAGCTGCGAGTGGTCGCCTCGCTCGTCGGTCGCGGAATACTCGGATG
TGTGTTTGCCGTGACCGAACATAAGCGCGATGACATGGGAATACCCTTGCAGCCTACGCTATTTCGGACCTCGGCCG
AGATCTCGGTGCTTGAGGACTGGCCGCGTAGTCGGGCCATGTTCGACCGTCTCGCAGCGCTGCGCAGCGCAGCGCGG
GAGGTCCTATGA Gene 159 (SEQ ID NO:8)
ATGCGTTTCGCCCTCCCGACGCGCATCCTGCACTGGCTGATGGCGCCGATGGTCATCGGGCAGCTGCTCATCGGGGT
GGTCATGATCACGTCGTTGACCTACTATCCGCTGCTGCTGGCCATCCACCGGCCGTTGGGCGCCTTGATCCTGGCGT
TTGCGGTGGTGCGCCTGGCGAACCGGTTCACCCACCGGCTGCCGCCCTTCCTTGCCACGATGGGCCCCGTCGAACGC
CGCGTCGCGACATGGTCGGAGTACCTGCTCTATGCCCTGCTGCTAGCCCAGCCCTTGATCGGGTGGGCGATGCTGTC
GGCGGCGCGGTTCCCGGTCGTCTTGGTGGGACCCGTGCATCTGCCCGGCATCGCACCGCACAACGTCGACGTCTATG
CGGCGCTGCGCCAAGCCCACAACGTCGGCGCCTTCCTGCTTTTCCTGACCTTCACGGCCCACGTCTGCGCGGTCCTC
TTTCATACGCTCGGCCTGCGCGACCGGCTCCTCGATCGCATGGCGCTGTGGCCCACCAAGCCCGTCGCCTCGCGGCA
GGACGAAATCAAGGCGTGA Gene 217 (SEQ ID NO:9)
CTGCGCAGGCTGATGGCCGAACGCGGACTGTTCAACACGACAGCGTTGCGGCCACTGCTGGCCGAACGCGGGGTGCA
GCTGTCGGCCAGCCAGGTCTACCGGCTCGTGACCGAGAAACCGGAACGGTTGAGCCTGCCCACCCTGGTGGCACTGG
TGGACATTTTGAGGTGTGCGATGGACGAGTTGATCGAGATCGTGCCCGCCACAGCTGCCTCGGCGAAGAAGGCCGCG
GGCGCACCGGAGCGCAGCAAACCGGTCAGGACGCGGGAACTTGGTGGCCACCGCCCCGTCCGGGCCAAGATCGTCGA
CGCGGATTCCTAG Gene 218 (SEQ ID NO:10)
ATGCGCGGAAACCGCAGCGAGTTCGTGACGGTGATCGTCACTGCAGTGGGCGCGATCGAGCCGCACCTGAGCCACGA
CGATGTCCGCACCGCGATCGAGGGGATGGGCCTGTCGGCCGCGCAGTTGCAGAGGCTGTCTAGAACGCTGCGGCGCG
ACGGTAGCGTGCTCACCGGGCCCGGCGGCAGCGACTGCGCCGCCGACATCGAGCAGCTGATCCTGTGTCTGCGCCAA
CTCGGCGCCATGCGTGTTCGAGCGCCGCGGTGTGCCCAGTGCGGCCGCAACGATTCCGAAACCTACTCGCGCAAGCT
CAAGAAGCGCATCTGCCGAGCCTGTTCGATGCAGGGTTGGCAGCCGGCTGTCGGTGAATGCCCGGGCTGCGGCGCGG
TGGACAAGTTGATCTACCGGCCGCGGCACGGCGATGGCCTGTTGTGTCGGAGGTGCAAGCCCGAACCCGACGTCGAT
CACGCCGCCAAGGTTCGTGACGGTATCGCGCAACTGCGGACCGGGCTTTCGGCCACCGAGATTGACCGGGTGGCGTC
GGTGTTCGGCACGGCCGGTCGCGCAGCGCGAGCTTAACTGGATCTTGCAGGACACCCCCGGAGTGTTTCGCGGTGAGA
TCGCCCACCGCTCGGCGGTCTCGGTGCGGCTCGCCGAACTACTTGTCGCTGCCGGTGCCGACAATGTGCGCCTTCCG
CAGTGCCCGTTGTGTTTGCGCACCGTGAAGCTCGGCAGCCAGATTGACGGGTTGCGCTGCTGCCATACCTGCTGGGG
TCACCACTTCAGCCGCGGCACCTGCGCTCGTTGCGGTTGCCAGCGTCACCTTATCAATTATCACGGTGCCGGCGAGC
GCCTCTGTCACCGTTGTTTCGAGCATGATCCGGTCAATCATGAGCCGTGTACACGGTGCGGTCGTGTGGACTTCATC
AACCACCATGACGGCCAAGCGAAGCTCTGCCGGCGCTGCTACCCGGCACCCACCGCGGTCTGCAGCTCGTGCGGACG
TACTCGCCCATGCACCCGCACCCGGACGGGAAAGCCGATCTGCGGCACCTGCTCGGCCAAACAGCGCCCACCCCAAC
CCTGTTCGGTATGCGGCAACATCCGCTCCGTGCACACCCGGACTGACGCCGGTGAGCCGGTGTGTAACCCGTGCGCA
CGAAGTCGGGAACCGTGCGCGCGGTGCGGCAAAACGCTGGGGGTCTCGGCGGCTTGCCGGGGTCGGGCCGTCGTG
CTCGGCCTGCCTGCAACGTGAACCCGCCTATTTCACCGACTGTGTGCAATGCGGCGCCCATGGACGGACGTACCACC
GTGGGCTGTGCCCGGCCTGCGCCTGTCCCGGTGAGCTCCGCGAATTGTTCGCCAAGAACGGCGAATTGAGCGGCGCC
GCCAGCCGCATCGTCGAGGCGTTGCTGCAATGTGACGCCATGCCGGTGCTGCGATGGGTCAGACGCATGCGATCGAA
CAGTGAACTGCCCGCGCAGCTCGCCGAACTCGGCGACACCCTCAGCCACCACGACCTCGATGACCTCCCGGCCAGCA
```

Figure 2-2

AATCCGTGGAATGGCTTCGCAACATCCTGGTGACCGCCGAGGGTCTGCCAGACCGCGACCCCTATCTGCACCGCACC
GAGCAGTACATCGCCGCCCGGCTGGCCACCATCAGCAACCGCGACGATCGCGCGGCCGTCCGCGCATTCACCGAATG
GAATCATTTGCGTAAACTCCGGGCCCGCGCCGACAAAGGACCACTCAAACGCAACCACGGCCTCGCCGCCCAGATCA
TGGCCGCCGCCATCACCGACTTCGTCTCCGAACTCAACGCGCACGGACTGGCCTTGGCCTCATGCCAGCAGGCGTTC
GTCGACGACTGGTTGGTGCGCAACCCCACTCGCCGCCAGATCCACCAATTCCTCGCCTGGGCGGTCCACCGTGGCTA
CGCCCACGACGTCGCGGCTCCCGTACCGCAAACCCGCCGCACCCGCCACACCCTGCCCGGCGACGACGAACGATGGC
GCCTGATCCAATACCTGATCGAACACCCCGACTTGGAGACGCGCGATCGGGTCGCCGGGCTGCTCGTGCTGCTCTAC
AGCCAACCCGCCGCCCGCCTGGTCACCCTCAAGGTTGCCGACGTCACCATCACCGACGACGCGGTCCAACTCACCCT
CGGCGCCGTCCCGCTCACCGTGCCCAGCCCCGTCGACCGCCTGCTCGCCGATCTCGTACAGCAGCGCCGCGGATACG
CCGCGGTCACCGTGGGCACCAATCCATGGCTGTTTCCCGGAGGACGCTCCGGTGGGCACCTGTCCGCCAACCAAGTG
GGGCTGCGGCTCAAACGAATTGGCATCTCCCCCGGATCGCCCGCAACACCGCGCTGATCGACCTCGCCGGCGAACT
GCCCGCTGTCGTGCTCGCCAAACTCCTCGGCTTCAGCATCAAACGCGCCGTCACCTGGAGCGAAGAAGCCGGCAACA
CTCGCCCCCGCTACGCCGCCGAGGTCGCCCGCCGCAACTCGTGA

Gene 219 (SEQ ID NO:11)
GTGTCAACATCTACTGAGCGCCGTTTGCGCTTACAGGTCGCCGTTCACGAGAGCTGGGCGCGCACCGAAAACCGTTC
CGCGCGAACGCATAACGCCCGTAAGGCGGCATGGGACCGCTTCGAAAAGCAGGTCGATCCCGAGGGCAAGCTACCCC
CCGCCCTGCGCGCCAAGATGGCCGAGAACGCCCGCGCGGCCCACTTCAAGAAGATGGCGTTGAAGTCCGTCGAGTCC
CGGCGCCGTCGCCGGGACGGGGTGGCGGCGTGA Gene 228 (SEQ ID NO:12)
GTGCCATACGCCGAATCGCCCAGGACCCGCACCGGGGGTGTGTTCACCCTCGAGCAGGCTCAGCCCGACGACGGCCT
CGTGGTTGTCCGCGCCGCTGGCCTTGGTCAACGCGCAATCGGTGATGATTCCGGTGTCGGGCTCGACGGCAAGGTGG
GCTTTGAAGCCGTCCTGGCGGCGGTGCACCGTCTTGTGAGCGTGCCGCGTGTCGGCATCGACGGTGGAGATCACGCG
ATCCCCACTGACCTGCTGCGCGATGCGCCAGTGCCCGTCGGTGCCATCAGAGCCCTCGACCGGTTCAACGTCTTGAC
CGGCGATCAACGCCAACAACGCCACCGCCTCAGCAGCCCGCGGCGCGAGTTCCTGGTCAGGCAGATAGCCCAGCACC
CGGTGAGCATCACCGACCAAACCATCCACCAGCCGATCCCGAGCGGCCTTATCCTCCCACGCAATCGCGGGTTTCCC
CGGATCGTCGTAATCATGGGCGCTGCAGTGGGCTTCGATCACCGCTGCAGCGCCAGGGACTTCGCGGCGCACTCGTC
GGATCGCGGCGATCAACTGCGTCACGGTGTCCTGCGTGGCCACCGCATCGTCGAGCACCGTGGAATCCAAGGCCCGC
CGTGTCTTGCCCGCCAACACCCCGGTCTCGGCCACCACCGTCTTGACCGCCTCGAAGATCCGGTTGGGCCGATCCGA
AGCCGCCAACCGACGCCGCCAATACGTCAACGTCGTCGAATGAAACGCGCCCGCCGTGATCGGCAACCCGCACGCTG
CTTTCCAGCGCAGATCGAAAGTCACCGCATCCACGGTCTCGTTATCCGAAAAACCGTGCAGGGCCTGCAAGGTGATC
ACCGAGGCCATCACCTCAGCCGGCACGCTGGGCCGGCCCCGCTGCGACGGGAACAAGTCCGCGAACATCTCCTCGGG
AAACAACTGGCTGCGGTGCGCCGCCAGGAACGCAAACATGCTGTCGGCCTTCAGAAGATGCCCGGCAACCGACTCCG
CATCCAACAACTCACGCTGATCATCAGAGCGACCCTGCACCCAACAATCATCCCCAAAACCCCAGGACAACTCGTCC
CGCCACGCGGAATTAATTCAGCAGGCTCCTAG Gene 240 (SEQ ID NO:13)
TTGGTCATTGCGCTAGCTGCCTTGTGGAGCATCCGTTTGGCCTGGCACATCCCGTTCGAGCGAGCAGCAGTGTTGGC
ACTGGCGTTTATGTGTGCCCAGTTGGTCCTGGCGCTCGGGCCGGTGGACGGGTGGCTGAGCCCATTGCTCCACGACA
TGACGGGCGTGTGGAACCTCGAAGACCTCATCGGCCATCTGCTCTACGTGTACGGCTTGTTCTCGATCATGTATCTG
GTCGCTGACCACTGCGACATGACGCCGGGTCAGCTCAGGTGGTTCGTTCGGAACCGGTTGGAACTGCCGTCGGTCGT
GATCTGCGCCGTCATGATCGCGGTCTTCGTCGCAGGCGACATCGGCGAGACCTGTGTTCCCGATGTTGTGGCCACAG
AACACACGCCCTGGCTCCGCGTCTACTGGTTCGTAATGATCGCGGCTCTTGCGTACATCATTGTCTCTACCGGTCGA
ATCCTGTTGATCCTGAGGCAGCACCCACGCTCGAGGCATGCCGCCACGGCCTATCTCGTAGCGCTCGGTATCACTGG
CGCGTGCTGCGTGGTTTTCATCATCGGAATCCCTTGGCTGCAATGGCTTCTCGTGCGGTGCGAGGTAGTCGGCTATG
CGGTGGCCGCCTCGTACTCCTGGCGTAACAAAGTGGCTTACTTTCGTGGACGCTAG Gene 241 (SEQ ID NO:14)
TTGCACGAAATCCTCCGGTTTGGCGGGAAAACCGACGAATTGATCGGTTTTGCCCGCGCTTTGTCGGTTCAGACTGC
TACCCTGCCGGGCATGTCTTCGCATTCGCCTGTGTCGGCCGCCGCCCTGGCCAGCCGATTGCGGATGATCATGGGCG
ACCGCAAGCTGTCCCGTACCCGTCTTTCTCACGAGACAGGTATCAGCCGCCCGAGCCTTTCTAGCAAGCTCGATGGC
AAGGTCGAGTTCACCTACAGTGAGCTACTTACGATGCCCAGGCGGTCGATGTTCCGCTGGACAAGCTGCTCGCCGG
AGACGACGATGAGCGGCCCTTCCGCCTGAGTGACTTGAGACCTCGACCCGATCGACCTCTGTGA

Figure 2-3

Gene 250 (SEQ ID NO:15)
ATGGTTGCGGCGCAAGGCTCCTCGATGCTAACCGCTGCCGATTTCGCCGCGCAATGGGCCGATGTTCCCCGTGGGA
ACCGCCGGACGAACCACCGCAGCGAAACGGCCAACGACAGCAGCAGGCAAGCGCCGAGCCGACCACGTGGGAGGCGT
TCGATCTCGGACCCTACCTGCGCGGCGAAATCGAACGCCCACATCCCGGTATCGGCATATCACGCTCCGACGGGCAG
CGGTCGCTCTACCCTGGTCGCGAGCACGCCATAGTCGGTGAAACCGAAAGCGGTAAAACCTGGTTCGCGTTGGGCTG
CGCCGCCGCAGAACTCAACGCCGGCAACGACGTCGTGTATATCCACTACGAAGAACCCGACGCGACGAGCACCGTCG
AGAAGCTGTGCTTGCTTGGGGGTCGACCCCGCGGTGATCAAGGCCCGGTTTCGGTTCGTCGCTCCCAGCCGCCCCGTC
CGTGAGGAGTGGCTGAACGCACTACTTGACCCTTCACCGACGCTGGTCATCCACGACGGCGTCAACGAAGCGATGGC
GCTGCACGGCGACGAGATCAAGGCCGTCGAGGGCGCCGCGGGCGTTTCGCCGGCCGACTGA Gene 251 (SEQ ID NO:16)
ATGGTGCGCGACGGCAGCCGCCGCGATGCCTACGGTTCGGTGCATAAGGGCAACGCGCTCGACGGGGCTCGGTTCGT
GCTCGAGAACTCGGCGCCGTTCGGCCGGCGGCTGCGCGGCGTCTCCTACGTCTTCGTGACCAAAGACCGCCCCGGGC
ATCTACGGGCCAACGGGCGCGCAACGAAGTCGCCCGGCAAGACGTTCATGGGAACTCTGGTCGTCGATGACTCGCAG
GCGTTCGGTCCTGACTTCACGATGCGGTTCTTCGCGCCCAGGGACGACGACGTGCCTGAGAGCGATCCGAACGCCGA
GCTGGCTGACGCTGTCTTTCGCGTCGTTGCTGCGGCTCCCGACCACGCTGTTGGGTCGATGCGGCTGTTGTTCGCTG
AGTTACGCAACGTCGACATCCAGTTCCGTGACGACGATGTGCGCGACGTCGTCGATGACCTTGTGGTGTCAGGCCGT
CTCGTAGAGATATCAGGCAAGCGTGGCGCCAAGGGGTTCAGGGCCGTTGTGGAGGACGCCGATGGGACAGCACGTG
A Gene 252 (SEQ ID NO:17)
ATGACCACCGACAACCCCACGCCCTCTGATGACCAGGCACTGGCCGCCCTCTACGCCACAGCACTCGGCGTGCTCCT
GGCCGGCCTCGTCAACGACGGACGCCTCACGACCGAGATCGAGCGCATCATCGCCGCCGGCGAGAAAGTCACCGCCG
GCGTCCTCGGCTTCCTGACCGCAGCAGCCGCCAACGCCTACGAATACGAGCACGGCAGCCGAGAAGCCGCCATCGAC
GCAGTCACCGCAGACCTGGCCACCGTGCTGCTCGCCGCCGGAGAGGGACAGCCCTCATGA Gene 253 (SEQ ID NO:18)
TTGACCGCGTTGACGGCGTTGCGCGACGTCCTGGCGGCGGCGATCGATGAATGCGGGTCGAAACGTGATTTGGCCGC
GTTGTTGCGGCAGTTCACCGCTGTCCTGGCGCAGATCGAGGCGGCGCGGGTACGGCCACCGCAACGTCGGATTGCCG
ATGAGATTGCGGCCCGGCGGACAGCTCGGCAGGCCGCGGCCGCTGCCGATGCGAAGAGCGCGGACCGCTGA Gene 254 (SEQ ID NO:19)
ATGAGCGACGAGTTACGCCAGCGCTACAAGGTGATTTTCGATGCAGTCCGGGTGAGCGAAATCGAGATCACCCCGGA
TCTTGCGCGGTGCCTCGTGCACTGGCTCGGTGATTACATCCGGCTCAAGCAGCAGCCTGGGCAGCCCGGTGTCCCGG
AGGGGTTAGTTGCGGCGCAGACGGCGCTTGCCGAGGCGTACGCCGCGGTTACTCACTCGCCTCGAAGCGAGCGGGAT
CGCCCGATCGGGGCTGGATTCGTATTCTCAGCCCATGACGCGTGGGTGGGCACTGCGGAAGCCGCTGAGATGCTCGG
GATCAAGGCGGGCAGCGTCGGTTGGCTTTGCCGGGAGAGTCATCTTGAGCACCGGAAAGTTGGCCGGCAGTACATGA
TTTCGACCGCATCGATCGAGGACTACAAACGCCGCAAGGCTGAAAGGAGCGCGTGA Gene 255 (SEQ ID NO:20)
ATGGTCAACGTGCCGCGTGCGGAACTTGCGCGGCTGGTGGGGGTTTCGCCGGACGTCGACGATCTAACGTTGCAGCA
GGCCATCGATTCCAAGCTCGCGCAGAATGAGGCCGAAAAGCACGCTCACGCGGTGTCTGCGGCCGAGCAGCGGGCCC
GCGCGGATGACCGGCGAATCGTCATCGCTGCCTACAACGAAGGCCGGATTCCGCAGAGCCGCATCGACTTCTGGTGC
GAAGCAATGCAACGAGACCGCGCCGGCAACAGGGCTATCCTCGCGGCTTTGGCGCCGGGACTGGCCCCGCCTGAAAA
GCTCCCTACTGACCCGCAGATCGAACATGTCCACGCGAAAGTCCTTGCTCGGATGGGCATCCGGCCGCCGGCATCTG
CTCCCACATCGCAGACTGTCGCTGCGTCATCGCCACCGCCGTCACCAGGCGTCGATGATTTGGGCATACCGATCGCG
CCGTTGCCGCCACCTGTGCGCATCGTGCGCATCGTGCACGGCAAAGATCCGGCCACGTGGTCCAAAGAAGAGCGCGA
TAACGCGCTGCTGTACGGGCTCGGCCCCGGTTCGCCGCAGCGGCGGCGGCGCGTGGGATCCCACGCCCACCCGGAG
GCTCCGGGTACTACCAGCCGACCGGCATCGAGCCCTACGAGCCCGTCGACCTGGGTGGCGGTCAGATCGAGTGGCGC
GCCAAGCCCGACTACCGGCCGCGGGGTGACTGA Gene 256 (SEQ ID NO:21)

Figure 2-4

ATGGCATACCGAATGAGTCCCCGCGTCGAGATGCTGGCCGTCAAGGACCAGAACGGGATCATTTGGCATCACTACCA
AAGACCTGTCGGGGGTGCCCGCAACCTTGGTCCGATCATTGCGTGGATTGGCCCTGACTACCGGGATCGCTGGCTAC
GCATGGGCCTCATCGAGGAGATCCCCGACGACGCCGCGGCCGCCCTGTCACAGCCCCCGCCCAGCGATGCAGTCGCC
GGCCCCAATACCGATCTCGTCGACGAGTGCATCGCCGCGCTCGACCGTTTCGATGTGCCAGCCGATGCCGGCGCCCC
GACCGCGCGGAAAGCCCTGCGCGACAGGGGGCAAGCCTGGGGCAACGAGACCATCGCTGCTGCTGTCCGCGCGCGCA
AGGCCCGTGCCGCGCCGTCCGGGACGCCGGCAGGGTCATGA

Gene 257 (SEQ ID NO:22)
ATGAGCACCACGACGGTGCCAGTCGGCACGACACCCGCTGCGATCACAGGGATTCCGCCGGACGTCGACTCGGTGCA
AGTCCTCAACTCCAGCGAGGGGCTCGGTGATGCCGCCGGCGTCGACATCGTCGTCAACAACTCCGGAGGCTGTTCGC
TGGACCCGCAGACGGGGATCCGGCTCAAACCCGGCGAGTTCTTCGTGTTCTCGCTACGCCAGCCACATGGGGGCCCG
GCCGNTTGCCGCTGTACGCGGTCGCGGCCGGCCCTGGTGGTCAGTTGA

481 (SEQ ID NO:23)
TCAACTGACCACCAGGGCCGGCCGCGACCGCGTACAGCGGCAANCGGCCGGGCCCCCATGTGGCTGGCGTAGCGAGA
ACACGAAGAACTCGCCGGGTTTGAGCCGGATCCCCGTCTGCGGGTCCAGCGAACAGCCTCCGGAGTTGTTGACGACG
ATGTCGACGCCGGCGGCATCACCGAGCCCCTCGCTGGAGTTGAGGACTTGCACCGAGTCGACGTCCGGCGGAATCCC
TGTGATCGCAGCGGGTGTCGTGCCGACTGGCACCGTCGTGGTGCTCATGACCCTGCCGGCGTCCCGGACGGCGCGGC
ACGGGCCTTGCGCGCGCGGACAGCAGCAGCGATGGTCTCGTTGCCCCAGGCTTGCCCCCTGTCGCGCAGGGCTTTCC
GCGCGGTCGGGGCGCCGGCATCGGCTGGCACATCGAAACGGTCGAGCGCGGCGATGCACTCGTCGACGAGATCGGTA
TTGGGGCCGGCGACTGCATCGCTGGGCGGGGGCTGTGACAGGGCGGCCGCGGCGTCGTCGGGGATCTCCTCGATGAG
GCCCATGCGTAGCCAGCGATCCCGGTAGTCAGGGCCAATCCACGCAATGATCGGACCAAGGTTGCGGGCACCCCCGA
CAGGTCTTTGGTAGTGATGCCAAATGATCCCGTTCTGGTCCTTGACGGCCAGCATCTCGACGCGGGGACTCATTCGG
TATGCCATGTCAGTCACCCCGCGGCCGGTAGTCGGGCTTGGCGCGCCACTCGATCTGACCGCCACCCAGGTCGACGG
GCTCGTAGGGCTCGATGCCGGTCGGCTGGTAGTACCCGGAGCCTCCGGGTGGGCGTGGGATCCCACGCGCCGCCGCC
GCTGCGGCGAACCGGGGCCGAGCCCGTACAGCAGCGCGTTATCGCGCTCTTCTTTGGACCACGTGGCCGGATCTTT
GCCGTGCACGATGCGCACGATGCGCACAGGTGGCGGCAACGGCGCGATCGGTATGCCCAAATCATCGACGCCTGGTG
ACGGCGGTGGCGATGACGCAGCGACAGTCTGCGATGTGGGAGCAGATGCCGGCGGCCGGATGCCCATCCGAGCAAGG
ACTTTCGCGTGGACATGTTCGATCTGCGGGTCAGTAGGGAGCTTTTCAGGCGGGGCCAGTCCCGGCGCCAAAGCCGC
GAGGATAGCCCTGTTGCCGGCGCGGTCTCGTTGCATTGCTTCGCACCAGAAGTCGATGCGGCTCTGCGGAATCCGGC
CTTCGTTGTAGGCAGCGATGACGATTCGCCGGTCATCCGCGCGGGCCCGCTGCTCGGCCGCAGACACCGCGTGAGCG
TGCTTTTCGGCCTCATTCTGCGCGAGCTTGGAATCGATGGCCTGCTGCAACGTTAGATCGTCGACGTCCGGCGAAAC
CCCCACCAGCCGCGCAAGTTCCGCACGCGGCACGTTGACCATGCCCATCACGCGCTCCTTTCAGCCTTGCGGCGTTT
GTAGTCCTCGATCGATGCGGTCGAAATCATGTACTGCCGGCCAACTTTCCGGTGCTCAAGATGACTCTCCCGGCAAA
GCCAACCGACGCTGCCCGCCTTGATCCCGAGCATCTCAGCGGCTTCCGCAGTGCCCACCCACGCGTCATGGGCTGAG
AATACGAATCCAGCCCCGATCGGGCGATCCCGCTCGCTTCGAGGCGAGTGAGTAACCGCGGCGTACGCCTCGGCAAG
CGCCGTCTGCGCCGCAACTAACCCCTCCGGGACACCGGGCTGCCCAGGCTGCTGCTTGAGCCGGATGTAATCACCGA
GCCAGTGCACGAGGCACCGCGCAAGATCCGGGGTGATCTCGATTTCGCTCACCCGGACTGCATCGAAAATCACCTTG
TAGCGCTGGCGTAACTCGTCGCTCATCAGCGGTCCGCGCTCTTCGCATCGGCAGCGGCCGCGGCCTGCCGAGCTGTC
CGCCGGGCCGCAATCTCATCGGCAATCCGACGTTGCGGTGGCCGTACCCGCGCCGCCTCGATCTGCGCCAGGACAGC
GGTGAACTGCCGCAACAACGCGGCCAAATCACGTTTCGACCCGCATTCATCGATCGCCGCCGCCAGGACGTCGCGCA
ACGCCGTCAACGCGGTCAACGCATCACCGGACTTCGCCGCCTTAGAAACCGAATTACGCGGTGTTACAACGTGACTC
GTAGTTCCAGCATTACGCCTGACCATCAGTCAATCATCCCCTTGACGTGTGGAAATCTGCCAGGGGAGAGAAACAAG
CGACCCGGCGGCGGTCGCCGAGGGGCCCCCTCCCCTCAAGAAAATCGGCGGGTGGGGTCGACGTGTGCTCCTCGGGC
ATTACACGTCGGTGCTTGGGCGTGGGTCCGATCGCAGGCGCGCACCGTTGGTCGGCGGTGGCTCTGTGTTCTTCTCG
GCGTGGGTCGTTGTGTCTGGTGTCGCGGGTGACCGGTCGTGGCCGGTAGCTGTTCATGAGGGCTGTCCCTCTCCGGC
GGCGAGCAGCACGGTGGCCAGGTCTGCGGTGACTGCGTCGATGGCGGCTTCTCGGCTGCCGTGCTCGTATTCGTAGG
CGTTGGCGGCTGCTGCGGTCAGGAAGCCGAGGACGCCGGCGGTGACTTTCTCGCCGGCGGCGATGATGCGCTCGATC
TCGGTCGTGAGGCGTCCGTCGTTGACGAGGCCGGCCAGGAGCACGCCGAGTGCTGTGGCGTAGAGGGCGGCCAGTGC
CTGGTCATCAGAGGGCGTGGGGTTGTCGGTGGTCATGGTGTGCCTTTCGGGTTGGGTGGATGGGGTGTTGCTTTCT
GGGTCGGCCGCGCTGTTGGGTGCGGAGCTGGCCCGCTACGACGCCGTGCGGCCGGTGTCTGGCGGGTAGGGCGTTGA
ACCATGCGCGGCAGCGGTCGGCGGCCGGACACCGCGAACACAGGCCGAGGACCTGGGCGTGGCGCTGCTCAACGACT
TCGGGGGCCTCGTTCGGTGCTGCTTCGTCGAACAGGTGATGCCGGCCGCGGCATCTGGCACCTGGCAACGACGGTGC
AGCGGCCAGCGCTTCGAGGAGGTGGTGCAGCGCGGTCATCGGGTGGCTCGGTTCAACGGGGTCGTCCCTCCGGGATC

Figure 2-5

```
GGGTTTTCTTGACTGTTTTCCGACTGCGTCCCGCGACCGCGTCCTGCGTCCCCCCTACGGGGGGTGGGACGCAGTCG
GACGCAGTCGCAGTCCGCTTGAACGCCACTGCGTCCGGACGCGGTGGGACGCAGTCGGACGCAGTCACGTGCTGTCC
CCATCGGCGTCCTCCACAACGGCCCTGAACCCCTTGGCGCCACGCTTGCCTGATATCTCTACGAGACGGCCTGACAC
CACAAGGTCATCGACGACGTCGCGCACATCGTCGTCACGGAACTGGATGTCGACGTTGCGTAACTCAGCGAACAACA
GCCGCATCGACCCAACAGCGTGGTCGGGAGCCGCAGCAACGACGCGAAAGACAGCGTCAGCCAGCTCGGCGTTCGGA
TCGCTCTCAGGCACGTCGTCGTCCCTGGGCGCGAAGAACCGCATCGTGAAGTCAGGACCGAACGCCTGCGAGTCATC
GACGACCAGAGTTCCCATGAACGTCTTGCCGGGCGACTTCGTTGCGCGCCCGTTGGCCCGTAGATGCCCGGGGCGGT
CTTTGGTCACGAAGACGTAGGAGACGCCGCGCAGCCGCCGGCCGAACGGCGCCGAGTTCTCGAGCACGAACCGAGCC
CCGTCGAGCGCGTTGCCCTTATGCACCGAACCGTAGGCATCGCGGCGGCTGCCGTCGCGCACCATCGGGAGGTGGTC
GCACGCCAGCGTGGCCGCGCCGACACGTAGGCATGGCAGGCATCAGTCGGCCGGCGAAACGCCCGCGGCGCCCTCGA
CGGCCTTGATCTCGTCGCCGTGCAGCGCCATCGCTTCGTTGACGCCGTCGTGGATGACCAGCGTCGGTGAAGGGTCA
AGTAGTGCGTTCAGCCACTCCTCACGGACGGGGCGGCTGGGAGCGACGAACCGAAACCGGGCCTTGATCACCGCGGG
GTCGACCCCAAGCAAGCACAGCTTCTCGACGGTGCTCGTCGCGTCGGGTTCTTCGTAGTGGATATACACGACGTCGT
TGCCGGCGTTGAGTTCTGCGGCGGCGCAGCCCAACGCGAACCAGGTTTTACCGCTTTCGGTTTCACCGACTATGGCG
TGCTCGCGACCAGGGTAGAGCGACCGCTGCCCGTCGGAGCGTGATATGCCGATACCGGGATGTGGGCGTTCGATTTC
GCCGCGCAGGTAGGGTCCGAGATCGAACGCCTCCCACGTGGTCGGCTCGGCGCTTGCCTGCTGCTGTCGTTGGCCGT
TTCGCTGCGGTGGTTCGTCCGGCGGTTCCCACGGGGAACATCGGCCCATTGCGCGGCGAAATCGGCAGCGGTTAGC
ATCGAGGAGCCTTGCGCCGCAACCAT
```

Figure 2-6

Gene 10 (SEQ ID NO:24)
VRPHTGGRRISIYWTWSYPWESQRDIQTLDNRFSTMTEVRRAAWPRYEGPDWDDAHFLQGIAGTLELFHRSTLAFQE
LAGEATGQQVAVFQRVDQAGYRLVIDERILADTDTLMVFGLDHLAGEDEAEPGEISAIRAWLEREGTCLLLAPHHDV
GGTDDMAQRQVEYLHHGDPLVPRQQRFSAYTRSLMKGLDVPVRNRWGLHPARVAATGQMAPLTCFRDLDAPGLLDDV
TTLNFHPHLPHYELTAPESDGLRVLATQRVDPARPHPFTEAGNSEFNALIWMPPHAERAGDIVLVDSTNFTTLFGGS
DSLRNFWHNLATMR*

Gene 11 (SEQ ID NO:25)
MVATEHEWSKPAALAIPREGYFELERGRYGPLYPRTPACYGFSIIAKVKEGREEAVRAYGKQIEEAIKADPHVLAAL
RLHYLRWLLFDVGSGLHFQYQGIFDTDFDKYTEDAVQLFSQTGITTVFTNLEGFPEDWRENPDAFVKFVREHQCPSF
LEYGEYPYVTADEIKKAYGSSRLPDHAGSDAMTSVRV*

Gene 38 (SEQ ID NO:26)
MVVSISAPTVPIPQAMTFSGLRSDIGQKPTRGQHRQRDAAIFELPVRPMRDVGHFDFLPALRFGVRPPDVDDQVAGL
VGRVQIRPVRIDTGGHDLEGTDIVRRQRRHPTAVADGGGVAWDAHPHRVARSCPEALHGCSGVGERAQGGMQIEDRS
KVICADAKPEAALMRAEPT*

Gene 56 (SEQ ID NO:27)
MNTSSSLPVDTLDVTAPPDATEVYGWAAHPDGLAARAFEAAVRDCAGYRVRVRGAQRSNVTCRRWVAIEAAPGADEQ
ALEPEAVRQLAPQMSVTPTTRRTAEMLDDAAFDAIVAVFSQRARCEMQTLSGGKCPRAARWRIDLHGCEQAIVCGQH
KKAWLQEALANLWRGIQPRCAHCGRVFNSFQDAVRITAI*

Gene 57 (SEQ ID NO:28)
MATNDDQDDGKPPITAAAGGDETAIGAAADETELVAPLTVPASELAWSHEDSDAGDYSWGRAAERASIIVLACAAVA
VVIGLLTWLALHLHDQAKPTAGPTAA Gene 128 (SEQ ID NO:29)
MSARDLINIGVFGALYIATVFAINVFAFINPLVMLVALAVSMIAGGVPFMLFLTRVRHAGMVTVFAIITAGLLALTG
HPPICFVITVACALVAEVVLWLGRYRSRTMGVLAYAIYAAWYIGPLLPIFYARDEYFSSPGMAQMGPRYLEEMERLL
SPAVLIAFDLSTVVFGLIGGLLGVRLLRKHFQRAGLA*

Gene 135 (SEQ ID NO:30)
MAGMPEEVAALLRGFPRIGAREQAFAFLTVDTGGFPHAALLSRCELEPGRDPQTLMAAIASRQTRANLRRSGTAGLL
AINGTSCHHLKLRVVASLVGRGILGCVFAVTEHKRDDMGIPLQPTLFRTSAEISVLEDWPRSRAMFDRLAALRSAAR
EVL*

Gene 159 (SEQ ID NO:31)
MRFALPTRILHWLMAPMVIGQLLIGVVMITSLTYYPLLLAIHRPLGALILAFAVVRLANRFTHRLPPFLATMGPVER
RVATWSEYLLYALLLAQPLIGWAMLSAARFPVVLVGPVHLPGIAPHNVDVYAALRQAHNVGAFLLFLTFTAHVCAVL
FHTLGLRDRLLDRMALWPTKPVASRQDEIKA*

Gene 217 (SEQ ID NO:32)
LRRLMAERGLFNTTALRPLLAERGVQLSASQVYRLVTEKPERLSLPTLVALVDILRCAMDELIEIVPATAASAKKAA
GAPERSKPVRTRELGGHRPVRAKIVDADS*

Gene 218 (SEQ ID NO:33)
MRGNRSEFVTVIVTAVGAIEPHLSHDDVRTAIEGMGLSAAQLQRLSRTLRRDGSVLTGPGGSDCAADIEQLILCLRQ
LGAMRVRAPRCAQCGRNDSETYSRKLKKRICRACSMQGWQPAVGECPGCGAVDKLIYRPRHGDGLLCRRCKPEPDVD
HAAKVRDGIAQLRTGLSATEIDRVASVFGTAVAQRELNWILQDTPGVFRGEIAHRSAVSVRLAELLVAAGADNVRLP
QCPLCLRTVKLGSQIDGLRCCHTCWGHHFSRGTCARCGCQRHLINYHGAGERLCHRCFEHDPVNHEPCTRCGRVDFI
NHHDGQAKLCRRCYPAPTAVCSSCGRTRPCTRTRTGKPICGTCSAKQRPPQPCSVCGNIRSVHTRTDAGEPVCNPCA
RSREPCARCGKTLGVSARLAGVGPLCSACLQREPAYFTDCVQCGAHGRTYHRGLCPACACPGELRELFAKNGELSGA
ASRIVEALLQCDAMPVLRWVRRMRSNSELPAQLAELGDTLSHHDLDDLPASKSVEWLRNILVTAEGLPDRDPYLHRT
EQYIAARLATISNRDDRAAVRAFTEWNHLRKLRARADKGPLKRNHGLAAQIMAAAITDFVSELNAHGLALASCQQAF

Figure 3-1

VDDWLVRNPTRRQIHQFLAWAVHRGYAHDVAAPVPQTRRTRHTLPGDDERWRLIQYLIEHPDLETRDRVAGLLVLLY
SQPAARLVTLKVADVTITDDAVQLTLGAVPLTVPSPVDRLLADLVQQRRGYAAVTVGTNPWLFPGGRSGGHLSANQV
GLRLKRIGISPRIARNTALIDLAGELPAVVLAKLLGFSIKRAVTWSEEAGNTRPRYAAEVARRNS*

Gene 219 (SEQ ID NO:34)
VSTSTERRLRLQVAVHESWARTENRSARTHNARKAAWDRFEKQVDPEGKLPPALRAKMAENARAAHFKKMALKSVES
RRRRRDGVAA*

Gene 228 (SEQ ID NO:35)
VPYAESPRTRTGGVFTLEQAQPDDGLVVVRAAGLGQRAIGDDSGVGLDGKVGFEAVLAAVHRLVSVPRVGIDGGDHA
IPTDLLRDAPVPVGAIRALDRFNVLTGDQRQQRHRLSSPRREFLVRQIAQHPVSITDQTIHQPIPSGLILPRNRGFP
RIVVIMGAAVGFDHRCSARDFAAHSSDRGDQLRHGVLRGHRIVEHRGIQGPPCLARQHPGLGHHRLDRLEDPVGPIR
SRQPTPPIRQRRRMKRARRDRQPARCFPAQIESHRIHGLVIRKTVQGLQGDHRGHHLSRHAGPAPLRREQVREHLLG
KQLAAVRRQERKHAVGLQKMPGNRLRIQQLTLIIRATLHPTIIPKTPGQLVPPRGINSAGS*

Gene 240 (SEQ ID NO:36)
LVIALAALWSIRLAWHIPFERAAVLALAFMCAQLVLALGPVDGWLSPLLHDMTGVWNLEDLIGHLLYVYGLFSIMYL
VADHCDMTPGQLRWFVRNRLELPSVVICAVMIAVFVAGDIGETCVPDVVATEHTPWLRVYWFVMIAALAYIIVSTGR
ILLILRQHPRSRHAATAYLVALGITGACCVVFIIGIPWLQWLLVRCEVVGYAVAASYSWRNKVAYFRGR*

Gene 241 (SEQ ID NO:37)
LHEILRFGGKTDELIGFARALSVQTATLPGMSSHSPVSAAALASRLRMIMGDRKLSRTRLSHETGISRPSLSSKLDG
KVEFTYSELLTIAQAVDVPLDKLLAGDDDERPFRLSDLRPRPDRPL*

Gene 250 (SEQ ID NO:38)
MVAAQGSSMLTAADFAAQWADVPPWEPPDEPPQRNGQRQQQASAEPTTWEAFDLGPYLRGEIERPHPGIGISRSDGQ
RSLYPGREHAIVGETESGKTWFALGCAAAELNAGNDVVYIHYEEPDATSTVEKLCLLGVDPAVIKARFRFVAPSRPV
REEWLNALLDPSPTLVIHDGVNEAMALHGDEIKAVEGAAGVSPAD*

Gene 251 (SEQ ID NO:39)
MVRDGSRRDAYGSVHKGNALDGARFVLENSAPFGRRLRGVSYVFVTKDRPGHLRANGRATKSPGKTFMGTLVVDDSQ
AFGPDFTMRFFAPRDDDVPESDPNAELADAVFRVVAAAPDHAVGSMRLLFAELRNVDIQFRDDDVRDVVDDLVVSGR
LVEISGKRGAKGFRAVVEDADGDST*

Gene 252 (SEQ ID NO:40)
MTTDNPTPSDDQALAALYATALGVLLAGLVNDGRLTTEIERIIAAGEKVTAGVLGFLTAAAANAYEYEHGSREAAID
AVTADLATVLLAAGEGQPS*

Gene 253 SEQ ID NO:41)
LTALTALRDVLAAAIDECGSKRDLAALLRQFTAVLAQIEAARVRPPQRRIADEIAARRTARQAAAAADAKSADR*

Gene 254 (SEQ ID NO:42)
MSDELRQRYKVIFDAVRVSEIEITPDLARCLVHWLGDYIRLKQQPGQPGVPEGLVAAQTALAEAYAAVTHSPRSERD
RPIGAGFVFSAHDAWVGTAEAAEMLGIKAGSVGWLCRESHLEHRKVGRQYMISTASIEDYKRRKAERSA*

Gene 255 (SEQ ID NO:43)
MVNVPRAELARLVGVSPDVDDLTLQQAIDSKLAQNEAEKHAHAVSAAEQRARADDRRIVIAAYNEGRIPQSRIDFWC
EAMQRDRAGNRAILAALAPGLAPPEKLPTDPQIEHVHAKVLARMGIRPPASAPTSQTVAASSPPP
SPGVDDLGIPIAPLPPPVRIVRIVHGKDPATWSKEERDNALLYGLGPRFAAAAAARGIPRPPGGSGYYQPTGIEPYE
PVDLGGGQIEWRAKPDYRPRGD*

Gene 256 (SEQ ID NO:44)
MAYRMSPRVEMLAVKDQNGIIWHHYQRPVGGARNLGPIIAWIGPDYRDRWLRMGLIEEIPDDAAAALSQPPPSDAVA
GPNTDLVDECIAALDRFDVPADAGAPTARKALRDRGQAWGNETIAAAVRARKARAAPSGTPAGS*

Figure 3-2

```
Gene 257 (SEQ ID NO:45)
MSTTTVPVGTTPAAITGIPPDVDSVQVLNSSEGLGDAAGVDIVVNNSGGCSLDPQTGIRLKPGEFFVFSLRQPHGGP
AXCRCTRSRPALVVS*
```

Figure 3-3

Gene 10 (SEQ ID NO:1)
GTGCGCCCGCACACCGGCGGACGGCGGATCAGCATCTACTGGACGTGGAGCTATCCGTGGGAATCGCAGCGCGACAT
TCAGACCCTGGACAACCGCTTCTCCACCATGACCGAAGTGCGCAGGGCGGCCTGGCCCCGATACGAGGGGCCCGACT
GGGACGACGCCCACTTTCTGCAGGGCATCGCCGGCACCTTGGAGCTTTTCCACCGCTCGACGCTTGCGTTCCAGGAG
CTGGCCGGCGAAGCAACCGGTCAGCAGGTGGCGGTGTTCCAGCGCGTCGACCAGGCCGGCTACCGGCTGGTGATCGA
CGAGCGGATATTGGCCGACACCGACACCCTGATGGTGTTCGGGCTGGACCATCTCGCCGGGGAAGACGAGGCCGAGC
CCGGGGAGATCTCGGCCATCCGTGCCTGGCTGGAACGCGAGGGCACCTGCCTGCTGCTGGCCCCGCACCACGACGTC
GGCGGCACCGACGACATGGCCCAGCGGCAGGTCGAATACCTGCACCACGGGGATCCGCTCGTGCCGCGGCAACAACG
GTTTTCCGCCTACACCCGCTCGCTGATGAAGGGGCTCGACGTTCCCGTCCGCAACAGGTGGGGCCTGCATCCGGCCC
GGGTGGCCGCGACCGGTCAGATGGCACCGCTGACCTGCTTTCGCGACCTGGACGCGCCCGGGCTGCTGGACGATGTC
ACGACGCTGAACTTTCACCCGCATCTGCCGCACTACGAGCTCACCGCCCCGGAAAGCGACGGGCTACGGGTGCTGGC
CACCCAACGCGTCGACCCGGCCCGGCCCCATCCCTTTACCGAGGCGGGCAACAGCGAATTCAACGCGTTGATCTGGA
TGCCGCCGCACGCCGAACGAGCCGGTGACATCGTGCTCGTCGACTCGACCAACTTCACGACGCTGTTCGGCGGGTCC
GACAGCCTCAGAAACTTCTGGCACAACCTGGCCACGATGAGGTGA 75% sequence identity to Gene 10 (SEQ ID NO:102)
CTGCGCGCGCTCAGCGGGGGACGCGGGAACAGGATCTAGTGGTCGTGGTGCTTTCCCTGGGATTCGCTGGGCGACTT
TCTCACCGTGCACAACGGCTACAGCACCTTGACTGAAGAGCGGAGGGGGGCCAGGCGCCCATTCCAGGGCCCCCACT
CCGACGTCGCCGACATTGTGGAGGCCATCGCGGGCTCGTTGGTGCAATTCCTGCGCACGACCCTTGCCTTCCTGGTG
CTGGCCCGGGATGCTTCCGGTCACCTGGTGGGGGAGTACCTGCGCGTCGAGCACGGCGGCATCCGGCTCCTGTTCGA
CGACCGGATATTGGCCGACACCGACACCCTGATGGTGTTCGGGCTGGTCCTTCTCCCCGCCGAAGTCGTGGCCCAGC
CGGGGCAGAACTCGGCGATCGGAGCCAGGGTGGATCGCGTGGGCTCCAGCCTGCTCCTCGCCCGGCAGCAGGACGAC
GCCGGCTCCGACGTCAAGCCCGACCGGGAGGACGATTAGCTGCACCTCGGGCATCGGCACGTCCCCCGCTACATCG
GTTATCGGCCTACACGGGCTCCCTGTTCAAGGCGCTGGACCTTGCCGTGCGCATCACGTCGGGGCTGCTTCCGGCGC
CCCTGGCCGCCACCGCTCTGATGGCTCCCCTGAGCAGGTTTCGCGTCCTCGAGGCGGCCGCGGTCCTGCACGTTGTC
TCGACCCTCAACATTGACCGGCAACTCCCCCACTTCGACCTCACCCGCCGGGTAAGGGACGGCCTAGGGGAGCTGCC
CAGCCTACGGGTGGACGCGCGCCGGCCCCATCGCTATAGCGAGCCGGCCAACTGCGATTTCTACGGGTAGTTCAGGA
TCCCGCGGCTCCCCGTACGTGGCGCTGTCCTCGAGCTGGTCGTCTCCACGATCTACAGGAGGCTGATCGGCAGATCC
GACAGTTTCAGAATCTCCTAGCACTTCCTGCCCAGGATGAAGTGA 80% sequence identity to Gene 10 (SEQ ID NO:103)
CTGCCCCCGCACTCCGGCCGAGGGCCGATCTGCATGTACTGGACCTCGAGCAATGCGTGGGATTCGCACCGCGAGAT
TCTGACCCAGGTCAAGCGGTTCTGCACCTTGACCGATGTGGGCAGCGCGGCGTCGCCCCGTTACGTGGGGGCCGAGT
GCGACGAGGCGCACTTTCTGCACGCCAACGCCGGCACGTTGCAGCTTTACCAGCGCTGGACGCTAGCCTTCCTGGAG
CAGGCGGGCGTAGGAACCGGACAGGAGGTGGCCGAGTTCGAGCGCGTCCTGCAGGCCGGCAACGGGCTGGTGAACGT
CGAGCCGATAATGCCCGTCACCGTCACCGTGATCGTGTACGGGCTCGACGATCTCGGCGGGGAAGAGGAGGGCCAGG
CCGGGGACATCTGGGCCTTCCGTCCCTCCCTGGAACCCGTGGGCACCTCCCTGCACCTGGGCCCGCTCCACGTCGTC
GCCGGTACCGACGTCAAGGCCCTGCGGGAGGACGAAAACCAGCACCAGGGGCATCCCCTCGAGCCGGGGCTACAAGG
GATTACCGCCTACTCCGGCTCGCAGATCAAGGCGCTCGTCGTTGCCCTCCGCTACAGGAGGCGCGTGCATCCGCCCG
GGGTGGCCGGGACGGGACAGTTGGCACGGCTGAGCTGCTATCCCCACCTCGACGGGCCCGGGCAGGTGGACGTTGTC
AGGACCCTGAACATTCTCCGGCATCTCCCCCACTTCGTGCACACCGCCCGGTAACCGACCGGCTTCGCGTGCAGGC
CACCGAACCCGTCGTCCCGCCCCCGCCGCATGCCTTAACCGTGGCCGGCAACTGCGAAATCATCGGGTTGTTCTGCA
TGCCGGCGCAGGCCGATCGACCCGGAGAGATCGTGCTGGTCGTCTCCACCTACATCACGTCGCTCTTCGGGGGGTGC
GACTGCCACAGATACTTCAGGCTCAAGCTGCCCACGAAGAGCTGA 85% sequence identity to Gene 10 (SEQ ID NO:104)
CTGCGCCCGCTCACCGCGGGAGGGCGGTTCAGCATCTACTGGAGGTGGAGCTTTCCGTGGGAAACGCAGCGGGACAT
TCTGACCGTGGACAAGCGCTACTGCACCTTGACCGTAGTGCGCTGGGCGGGCTGGCCCCGTTACCAGGGCCCCGACT
GCGACGACGCCCAGTTTCAGCAGGGGATCGCCGCCACCATGGACCTTTACCTCCCCTCGACCCTTGCGTACCAGGTG
CTGGCCGGCGAAGGAACCGGACAGGAGGTCGCGGTGATCCACCGCGTCGTCCAGGCCCGCTACCGGGTGGTGATCCA
CGTGCGGAAATTGGCCGACTCCGACAGCCTGATCGTGTTCGGCCTGCACCAACTCGCGGGGGAACACGAGGCCGTGC
CCCGGGACATCACGGCCTTCCGAGCCTGGCTCGAACGCGTGGGCACCAGCCAGCTGCTGCCCCCGCTCCACGAGGTC
GGCCGCAGCGACCACATGGCGCAGCGCCAGGTGGAATACCTGCTCCACGGCGATCCGGTCCTGCGGCGGCATCAACG
GTTTTCCGCCAAGACCGGCTCGCTGATCAAGGGGCTCGACGTTCGCGTCCGCTTCAGCTGGGGCCAGCATCCGGCCG

Figure 4-1

```
GGGTGGGCGCGACCGGACAGATGGCTCCGCAGACCTCCTTTCGGGACCTGGTCGCGCGCCGGCTGCAGGACCATGTC
ACCACGCTGATCTTTCACCGGCTTCTGCCGCTCTACGAGCACACCGCCCCGCAAACGGACGGCCTACGGGTGGTGGG
CACCCTACGCCTCGACCCGGGCCGGCGCCATCCCATTACCGTGGCGGGCAAGAGCGAATACAACGGGTTGATGTGGA
AGCCGCCGCTCGCCGTACGAGCCGGAGACATGGTGCACGTCCACTCGTCCATCTTCACGACGCAGTGCGGCGCGTCC
GACAGCATCAGAAACTTCTGGCACATCCCGGCCACGATGAGGTGA
```

90% sequence identity to Gene 10 (SEQ ID NO:105)
```
GTGCGGCCGCACTCCGGCGGACGGCGGTTCAGCTTCTACTGGACGTGCAGCTAACCGTGGCAATCGCAGCGCGACAT
TGAGACCGTGGACAACCGCATCTCGACCATGACCGAAGTGCGGAGGGCCGCCTGGCCGCGATACGAGGGCCCCCACT
GGGACGACGCCCACTATCTGCAGCGCATGGCCGGCACCTTCGAGCTATTCCACCGCTCGACGCTAGCGTTGCAGGAG
GTGGCCGGCGAAGCAACGGGTCAGCTGGTGGCGCTGTTCCACCGCGTCGACCAGGCCCGCTTCCGGCTGGTGATCGA
CCAGGGGATATTGGCCGTCACCGTCACCCTGATGGTGTTGGGGCTGGTCCATCTGGCCGGGGAAGACGAGCCCGAGC
CCGGCGTGATCTCGGCCAACCGTGCCTGGCTCGAACCCGAGGGCACCTGCCAGCTGCAGGCCCCGCACCACCACGTG
GGCGGCACCGACGACTTGGGCCAGCGGCAGGTCGAATTCCTGCACGACGGGCATCCGCTCGTGCCGGGGCAACATCG
GTTTACCGCCTAGACCCGCTCGCTGATGAACGGGCTCGTCGTTCGCGTCCGCTACAGGTGGGGCCTCCATCCGGGCC
GGGTGGCCGCGTCCGGTCACATGGCACCGCTGAGCTGCTTTCGGGAGCTGGACGCGCCCGCGCTGCTGGACGAAGTC
ACGACGCTCAACTTTCACCCGCTTCTGCCCCACTACGAGCTCACGGCCCCGGTAAGCGACGGGCTAGGGGTGCAGGC
CAGCCAACGCCTCGACCCGGCCCGCCCCCAACCCTTTACCGAGCCGGGCAACAGCGTATTCATCGCGTTGATCTGGA
AGCCGCCGCACGGCGAACGTGCCGGTCACATCGTGCTCCTCGACACGACCAACTTCACGAGGCTGTACGGCGGGTCC
GAGAGCCACAGAAACTCTGGCACTACCTGGCGACGATGAGGTGA
```

95% sequence identity to Gene 10 (SEQ ID NO:106)
```
CTGCGCCCGCACACCGGCGGACGGCGGATCAGCATCT

Figure 5

```
>paratb_26
CAGACGGTCTGGCCGCCCGTGCATTCGAAGCAGCGGTGCGTGACTGCGCCGGCTACCGGGTCCGGGTGCG
CGGTGCGCAACGCTCCAACGTCACCTGCCGCCGCTGGGTGGCCATCGAAGCCGCACCCGGCGCCGACGAG
CAAGCGTTGGAGCCCGAAGCGGTGCGGCAGCTGGCGCCGCAGATGAGCGTCACGCCTACC
>paratb_27
ACGCGCCGGACAGCTGAGATGCTCGACGACGCCGCCTTCGATGCGATCGTCGCGGTGTTCAGTCAACGGG
CCCGATGCGAGATGCAAACGCTGTCGGGAGGCAAGTGCCCACGGGCTGCGCGCTGGCGCATTGATTTGCA
CGGGTGCAACAGGCCATTGTGTGCGGGCAGCACAAGAAAGCGTGGCTGCAGGAGGCCCT
>paratb_28
AGCCAACCTCTGGCGCGGCATTCAACCTCGCTGCGCCCACTGCGGAAGAGTGTTCAACAGCTTCCAAGAC
GCGGTCAGGATCACCGCGATATGAGCGCCGCACTACGGCTAGTCACAGATACGGGCACTGGCACGAGCGA
CGGCGAGCTACCGCCATTGCAACGGTACGAGATCTGGATGAAGGGCCGCGGCCTGTCAGC
>paratb_29
CCGCACCATCACCGACTCCATGCTGACGCTGCGGCGCCTTGAACGCGTCACTAGGCGGCCGGCACACGCG
GTTGCGGCACTGGCGATTTCACGGTTCCTCGCCGACGAGGCGCTGGGCCCGCGGTCACGCTACACCTACC
ACGTCCAGTTGGCAGGGTTCTTCCGCTGGCTGGCCAACGAAGACGGCGCCCCCAACATCA
>paratb_30
TGGCGCAGATCCCGCGTCCGCGGCTGCCGCGCAGTGTTCCGCGACCCATCACCACTGGTCAGCTTCAAGC
GCTGTTGGCGGTCCGAATGCACAAGCGCACCAGGGTGATGATCTTGCTGGCGGCCTTCGCCGGGCTGCGG
GCCCACGAGATCGCGAAGGTGCGTGGCCAAGACGTCGACCCGGACGCTCGGACGCTGCAC
>paratb_31
GTGGTCGGCAAGGGCGGTCATGCGGCGACGATTCCGCTGCATCCGGTGCTAGTTGAAGCGGCTGAGACGA
TGCCTCGTCATGGTTGGTGGTTCCCCGCCAATTCCCGGCGCCCCGGGCAGCACGTCCTGTCTCGGGGCGT
CGTCGATGCCATCGGCGATGCGATGCGCCGGGCCGGCATTCCCGGCGGCACGGCGCACCG
>paratb_32
GCTAAGGCATTGGTACGGAACCACTCTGGTCGCCAGCGGCACGGACCTGCGCACAGCGCAGACGCTGTTG
CGGCACTCCAATCTGGCGTCTACGGCGATCTACACAGAGGTCTATGACGACCGGCGAATTGAGGCGATCG
ACCGGCTGACGATACCGCTGCCCGGCGAAGCCGAGCGGGCGCAGGACGACCGGCTGCGGC
>paratb_33
GGCAGGTGGATCGTTGTAAGCAGTCCATCATCCGCCTGCTGGGCGGCCTGGAGCCCGGCGAGCACATGTC
GCGCACGAAGCTCAGTCAAGCACTACGGTCCGACGTCCGGCCTCATATCAACGAGGCGATCGACGAGCTG
ACCGCGGGCGGCATGTTGGTCACGGTCATAGCTGGCCACGGCCGCCACTACAGGCTCGAT
>paratb_35
GATCGGGGCGGCCGCTGATGAAACCGAGCTCGTCGCGCCGCTCACCGTGCCCGCGTCCGAGTTGGCCTGG
TCCCACGAGGACAGCGACGCTGGTGATTACTCGTGGGCCGGGCTGCGGAACGCGCCAGCATCATCGTGC
TCGCCTGTGCGGCGGTCGCTGTCGTGATCGGTTTGCTGACCTGGCTCGCCTTGCACCTAC
>paratb_36
ACGACCAGGCCAAGCCGACAGCCGGCCCGACGGCCGCGCGTCCGGTCACGATCGAGCCGGCGGCGGCGCT
TCCCACGGTCACCGCGGTGCAGGCGCCGGCCGCCGCGCCTCCGGCGACGGTCACGGTCACACCCCCACCG
GCGCCGCCTGCGACGGTGACTGTGCAAGCCGCGCCGGCACCGGCGCCTACGGTGGTGAAG
>paratb_37
CCAGCTCCCGCGCTTCCGCCGCCGGGCGGCACGACCGTCTTCTCCATCTGCCCGGACGGGCACGAGGGTG
TCGTCGGTGGCCACACTTCTTGTGCGTTCGCCGAGAACGTCCGCCGCACCTTCTACGCCTCAGGCATGGC
CGACACGTTCACCGCGTTCTCGCCCGTCACCGGTGACGCGTACGAAATGACGTGCGCCGG
>paratb_38
CAGGTATCCGGCCTATTTCGAGGACGGGTCGACGAAGGTCTCGACGCGCTGCTACGGCGGCAACAACGCC
GAAGTGGTCATCTGGTAGTTGATCGATCACCTTCGAGTACGAGGGCACTGTCTACGGCTCGAACGCGTGG
AAGTCGAACAGCCGCGACCGCCGCTACTACCGCCAAGGAGGCACGGATGGGTAAGAGTCT
>paratb_39
```

Figure 6-1

```
TGAGGATCGGCTCGCCGCGATCGGCGACGCAGCCGAAGCCGGCGAAGCAGACCAGACCGACCGACCGATC
CCTGCGCACGTCAAAGTCACCCGCGGTAACCCGCGGAGCAAGGTGCTGCAGGTGCGGCTGAACCCGGAGG
AGCTGGCGGCGCTGGAGGCGATCGCTGAACGGCGCGACCTGCCGGTGTCGACGGTGGCCC
>paratb_40
GCGAGCAGCTCTTGCCGCTGGTGGCAGAGGAGTTGAATCGGTGACTACCGATCACCCCGACCAGCCGCGG
CGGGAACTCCCAAACACCCTCGCGGGTCACAACCTCGTCTTCATCTACGACGATGACGACGACGATTGGG
ATGACGAGGATTTCGACGCGGACCATGGCGACTGCGCATTCTGTCTTGGCCGCAAGCCG
>paratb_41
CCCACCGCGGCGAAAGCGAAGACCAGAACCCCTACTCGAAGACCGGCGCGCGGCCCGGCTCAACCGAATG
GTACGAAACCGACTACGGGCTGTGGCTCCTCGGCCACGACGTCGGAACTAAGATTGACCCTGAAATGAGT
TGAGGTCAAACAGTTCTGGGCAAGAAGGCGCGTCGCCAAGCTTGATCCGCCCATCTGTCG
>paratb_47
CGCCGCCGATGAACGGACCCATGGGAAGTGGTTTAGGTCCACTAGGAAGGGGGCCACCGCTTCCTGCACC
GCCCAGCATGGACTGCTGCTGCTCAAGGGGGGACTTCATCGGACCGGGCGGAGCCGGGGGCGCTACATGA
ACCGGGCCCCAGCGCCAATCCGAGCCGTGCGACGGCGGCCCGTATGCGTTCGGGGACGGC
>paratb_48
GTTGGGACGGGCCCGAGTGGAGTCGGATACCAAGTGCGGTAGAAGGAGTCCGATGCGCCTTGGCCGTACC
AGCTCTTGTAATCCGCCGGTGGCGGGGCGCTATCCGGCGCGGGCGGCCGGGCAAGCGGTCCCAGAGGTAA
TCCGGGCTTCGACGGAGACTTCACGAACTCGAATTCACTGCCTCCCCCAGCACCAGCGCC
>Contig16_56
CGAAGATGTCGTTGGCAGCCATGGAGCCGGCCGCCGCGATGCCGAGGGGGCCGGCAGCAGCGGCGAGTCC
CGCACCGCCGGTCCTGCCGCCGGACAATGCCGCGTTGGCTTCGCCGGCTGCCGCCGTGACGCGGCCTTCG
GCGGCGACTTCGGCGTCCGCGGCGGCCAGCACCTCGGCTTCACCTGCCATGGCCGCGGGG
>Contig16_57
CCCATGTTGCGCATCGCCGTGCTGGCTGTGGTGGCCTGGGTCTCGACGCTGAACAGCTTGTCCTTCAACA
TGCCCAGACCCGTCCCGATCGGTGACAGGATCGTCGAGGCGATGTTGTAGCCCTTGATCGCCAACCATGC
CGTGCCCATTGCACCCACACCGACGGTCACCGCATCCAGCAACGGCTTGTGCTCGGTGAG
>paratb_58
CCAATGCGCCGACTCCCCAAGCACCCCAACGACTTCAGTCATCGCTGGCAGAAAGTCCTGGCCGATCTCG
ATGCGGGCTGCGCTCAACGCCCCCTTGAAGTCCTTCATCTTGGCGTTGTAGGTCTCCTGGGATTCGGTGA
ATCCCTTGGTATTGCCCGCACCGTCGGCCTGCGCCTGACTGACCTCCTTGACCGCGGCAG
>paratb_59
CGGCTTTGGGCCCGTTCTCCCCGACCAACTGCAATACCGTCCGCAGATTGTCTTGGCCGCCGACCATGAG
GGCCAGCGCTTGGATCATCGACTGGACATCACCCTTGCCGGACTTGAGCTGATTGTTGAAGCCTGTCAAT
GCTTTTTCTTGGTTCCACCACTGCTCGACAAGGTTGGCTTCCTCAACGCTCAAGCCGCCG
>paratb_60
CGGTCCTTGCGGAACTGCTTGTACGCCTCAGCATTGTTCTGGATCGCCGTCGCGACCGCCTGCGCCTGCG
CGGGCAGCTTCGAGAACATCTCATTAGCGCTGTCGGCCACCTGCTTGCTCTTGAACCAGGCGTCCAGCGT
GACCATCCCCGACGGGCCAAGCTTCGACTGGATCGTGTCATACAACAGGTTCGCGGTGCC
>paratb_61
GATCAGGCCGCGCTCCCCGAAATGCTCCTGAATGTCACGGGCATCCAAACCGAGCTGTCCCATCTCCTGG
GACATTTGCTGGGTTGGCTTGGCCAGCGACGTGATCGCGTGCGTCATATTCTGGGTGGCCTGATCAGCAC
CCATACCCGACTGAGTGAGCATCGCCAACGACGCATACAGGTCATTGACGCTTTCACCAA
>paratb_62
CTCCGGCCGCGACCGGCTCGACGTTGTGCAACGCCCCCGCGAAGTCTTGCAGCGAAACCTTCGACAACCC
CACGGCCACATTCAATTTCGAGGTGACGTTGGCGGCCTGCTCGACCGGGATGTGGTAGTCGTGCATCGTG
GTCGTGACCGCGCTGATCGTCTCGCCCAGGTCCGCGCCCTCTTCGGACGCAAGCTGCGCT
>paratb_63
```

Figure 6-2

```
GAAGCCGTCAACACCTTGATCGCATCACTGCCCCGATAGCCGGCCTTCTCGACACCCAGCGCAGCGTCCA
TCAGCTTTTGAGGCGCATAACCGACCACGCTCGACAGTTTCAGCACGCCATCGCTGATCGCCTTCAGATT
GGCCGGCGACTCCTCGGCCACCGTGTGCAGCCTCTGCAACGACTGCTGGAAATTCCCCGC
>paratb_67
TCGCGTCGGCGCGAGCGGTGCGCGATGATCGCCGGTATGCCTAGCGGAATTGAGCATCTACGAGCGATGA
CTGAAGAGGAGCTCATCGCGGCGCACGACAACATCAACTCCAACAGGGCCCTTCCCTCGAGTTACTTCCT
CGACGAATTACGTCGCAGAGAAGCTGAGCGCGCCGAGTTAGCGAGCTACAAACTTGCAGC
>paratb_68
TGAGAGCCACAACCTGGCACGACGCGTTTTTTGGCTGACTGTCGTCAGCACCGTGTTCGCTGGATTCGCT
GCCATCGTCGCGATCATCGCTCTATTTCTACGGTAAAGACCCAACCGAAACTATTGACGATGTCTCGTGT
TTACCGGTTACCCTTGACAGGTCGCAAGGGAAACGAGGACCATGAACAGTGACATCGCGG
>paratb_69
ACATCGCCAAGTGGGCGCGATCGCAGGGATGGACAGTTTTTGACGACTCAAAGGGCTACACCCGGTTCTA
CAACCCGCAAGGCGAGTACATCACCAACTACCCGGCCACACCGAGCCGCCCCAACCGACGGATGGCCGAC
CTGAAAGTGGACCTGAAGAAAGCCGGCCTGCCGATCCCACCGCCGAGCAAGAAAGAACAA
>paratb_70
CGCGCACAACGCAAGAAGGGAGACACGAAGTGACGAAAACCGATTGGGTCATCACGTTCACCTTCGACGT
CGACCCACCGATCGAGACGATGGACGAATGGGAGTCCAGGCTCGACGGATTCGACGCGTCGGTCGCGCGC
ATCCCAGACCGCGGCGTGGACCTCACGGTCTACGCACCCGGCGACCTGTCCATGTTCGAC
>paratb_71
GCACTCAACAAGACGATCAACGAGGTCGCCCACGTGGTGCAGTCCGGGCCGCCGATCGGCCTGGAGGTCG
TCACCGAGCGTGAGCACACGCGCCGCGCCGAAGCTCCGAGCATGCCCGAACTGATGTCGGCAGCAGAAAT
CGCCGACGAACTCGGTGTCCGCCGGCAGCGGGTGCATCAGCTGCGCGCTACTTCGGCGTT
>paratb_72
CCCTGCCCCGCTCGCAGAGTTGCGCGGGGGCGCCGTGTGGGACGCCGCCGCGGTGCGCAAGTTCGCCCAG
GATTGGCAACGCAAGCCCGGCCGGCCGCGAAACAGCGCCGTCGACAGTCAGCAGAGGGACTACGCGCTGG
GACACTGAGCGGTCGGACTTCACCGGTCAGGTTTGCGTTCTGCACACGAGCAGTCGAACT
>paratb_73
CCCTGCGGCCGAGCCCACCGAGCGGTCAAGTCGCCGTAGCAGCAGAACTCGATACGCTCGCCTGTATCAC
TGGTGAGCGCGACTTCGTGCCAGTCCTCGTAGAACGTGCGGAAGAACGAGCGCCGAAATGCGAGCATCGC
AGGGGACGCCCCCCGCTTTTTCTTGGACCACCCCCACCCCCGAGCGACCGCCGCGCCGTC
>Contig16_74
GCTTTTTTGTGTGTACGGAGCGAAAAAATTCGGGGGAACCCCTAATGCGAGGCAGAAACTCGCCAGGTCG
GAAGTCGCTTTAGGGCCTTCGTCAGTCCGGGATCAACCGTCACCATCGACGGCAAGCGTTGGGCTGTCGC
CGCCGACATCTGCGCCGCCCTCGACATCAGGAACTCCCGCGACGCCGTAACACGCCTCGA
>paratb_75
CGAAGCTGATGTCGCTACCACCGACATCAGGTCCGGCGGCCAGATCCGCAAGGTCACCGTGGTCTCCGAG
AACGGCGCCACCGATCTGATACTCGACTCCCGCAAGCCCGAGGCGCGCAGGTTCCGCCGCTGGCTCACCC
ACGAGGTATGGCCCGCGATCCGCGACACTGGCTCCTATTCGACAGCCCCACCGCTGACAG
>paratb_76
ATCAGAACGGGACGTGCATGTAGTCCATGCCCGCATCTTGCCCGGCCCGGGCACGACGGCATTGGTTGAG
TAGCGCGGTAATCGGGTCTTGGCGAAGCTGTCCGGGGTGCTCGCTCATGCCGTCGAGGGCATGGTGTGTG
GCCAGCGCCACCAAGCGCTGGCATTGGATCGCGTCGGAGTCCACGATGCTCAGACTCCTC
>paratb_77
TCGGGAAGCGCGGCACGGTAACTGCGCCGGACGCCACGACTACGAAATCCATTGCTCAGCTTCCCTTCTC
CGTTTTGGGGTTCCGGCACCGGCCACCGCGCCAGGGGACGCGCCGACGAGGATTACGTTCCCGTCGCAGG
CAGCCGGTGCCGCCTGTCCGAGCGCTACCCGAGAATGACGCACGGACCAGGTTTATGGCG
>paratb_79
```

Figure 6-3

```
CCGGCGGCATCACCGAGCCCCTCGCTGGAGTTGAGGACTTGCACCGAGTCGACGTCCGGCGGAATCCCTG
TGATCGCAGCGGGTGTCGTGCCGACTGGCACCGTCGTGGTGCTCATGACCCTGCCGGCGTCCCGGACGGC
GCGGCACGGGCCTTGCGCGCGCGGACAGCAGCAGCGATGGTCTCGTTGCCCCAGGCTTGC
>paratb_80
CCCCTGTCGCGCAGGGCTTTCCGCGCGGTCGGGGCGCCGGCATCGGCTGGCACATCGAAACGGTCGAGCG
CGGCGATGCACTCGTCGACGAGATCGGTATTGGGGCCGGCGACTGCATCGCTGGGCGGGGGCTGTGACAG
GGCGGCCGCGGCGTCGTCGGGGATCTCCTCGATGAGGCCCATGCGTAGCCAGCGATCCCG
>paratb_81
GTAGTCAGGGCCAATCCACGCAATGATCGGACCAAGGTTGCGGGCACCCCCGACAGGTCTTTGGTAGTGA
TGCCAAATGATCCCGTTCTGGTCCTTGACGGCCAGCATCTCGACGCGGGGACTCATTCGGTATGCCATGT
CAGTCACCCCGCGGCCGGTAGTCGGGCTTGGCGCGCCACTCGATCTGACCGCCACCCAGG
>paratb_82
TCGACGGGCTCGTAGGGCTCGATGCCGGTCGGCTGGTAGTACCCGGAGCCTCCGGGTGGGCGTGGGATCC
CACGCGCCGCCGCCGCTGCGGCGAACCGGGGGCCGAGCCCGTACAGCAGCGCGTTATCGCGCTCTTCTTT
GGACCACGTGGCCGGATCTTTGCCGTGCACGATGCGCACAGGTGGCGGCAACGGCGCGAT
>paratb_83
CGGTATGCCCAAATCATCGACGCCTGGTGACGGCGGTGGCGATGACGCAGCGACAGTCTGCGATGTGGGA
GCAGATGCCGGCGGCCGGATGCCCATCCGAGCAAGGACTTTCGCGTGGACATGTTCGATCTGCGGGTCAG
TAGGGAGCTTTTCAGGCGGGGCCAGTCCCGGCGCCAAAGCCGCGAGGATAGCCCTGTTGC
>paratb_85
ACGTCCGGCGAAACCCCCACCAGCCGCGCAAGTTCCGCACGCGGCACGTTGACCATGCCCATCACGCGCT
CCTTTCAGCCTTGCGGCGTTTGTAGTCCTCGATCGATGCGGTCGAAATCATGTACTGCCGGCCAACTTTC
CGGTGCTCAAGATGACTCTCCCGGCAAAGCCAACCGACGCTGCCCGCCTTGATCCCGAGC
>paratb_86
ATCTCAGCGGCTTCCGCAGTGCCCACCCACGCGTCATGGGCTGAGAATACGAATCCAGCCCCGATCGGGC
GATCCCGCTCGCTTCGAGGCGAGTGAGTAACCGCGGCGTACGCCTCGGCAAGCGCCGTCTGCGCCGCAAC
TAACCCCTCCGGGACACCGGGCTGCCCAGGCTGCTGCTTGAGCCGGATGTAATCACCGAG
>paratb_87
CCAGTGCACGAGGCACCGCGCAAGATCCGGGGTGATCTCGATTTCGCTCACCCGGACTGCATCGAAAATC
ACCTTGTAGCGCTGGCGTAACTCGTCGCTCATCAGCGGTCCGCGCTCTTCGCATCGGCAGCGGCCGCGGC
CTGCCGAGCTGTCCGCCGGGCCGCAATCTCATCGGCAATCCGACGTTGCGGTGGCCGTAC
>paratb_88
CCGCGCCGCCTCGATCTGCGCCAGGACAGCGGTGAACTGCCGCAACAACGCGGCCAAATCACGTTTCGAC
CCGCATTCATCGATCGCCGCCGCCAGGACGTCGCGCAACGCCGTCAACGCGGTCAACGCATCACCGGACT
TCGCCGCCTTAGAAACCGAATTACGCGGTGTTACAACGTGACTCGTAGTTCCAGCATTAC
>Contig16_89
GCCTGACCATCAGTCAATCATCCCCTTGACGTGTGGAAATCTGCCAGGGGAGAGAAACAAGCGACCCGGC
GGCGGTCGCCGAGGGGCCCCCTCCCCTCAAGAAAATCGGCGGGTGGGGTCGACGTGTGCTCCTCGGGCAT
TACACGTCGGTGCTTGGGCGTGGGTCCGATCGCAGGCGCGCACCGTTGGTCGGCGGTGGC
>paratb_90
TCTGTGTTCTTCTCGGCGTGGGTCGTTGTGTCTGGTGTCGCGGGTGACCGGTCGTGGCCGGTAGCTGTTC
ATGAGGGCTGTCCCTCTCCGGCGGCGAGCAGCACGGTGGCCAGGTCTGCGGTGACTGCGTCGATGGCGGC
TTCTCGGCTGCCGTGCTCGTATTCGTAGGCGTTGGCGGCTGCTGCGGTCAGGAAGCCGAG
>paratb_91
GACGCCGGCGGTGACTTTCTCGCCGGCGGCGATGATGCGCTCGATCTCGGTCGTGAGGCGTCCGTCGTTG
ACGAGGCCGGCCAGGAGCACGCCGAGTGCTGTGGCGTAGAGGGCGGCCAGTGCCTGGTCATCAGAGGGCG
TGGGGTTGTCGGTGGTCATGGTGTGCCTTTCGGGTTGGGGTGGATGGGGTGTTGCTTTCT
>paratb_92
```

Figure 6-4

```
GGGTCGGCCGCGCTGTTGGGTGCGGAGCTGGCCCGCTACGACGCCGTGCGGCCGGTGTCTGGCGGGTAGG
GCGTTGAACCATGCGCGGCAGCGGTCGGCGGCCGGACACCGCGAACACAGGCCGAGGACCTGGGCGTGGC
GCTGCTCAACGACTTCGGGGGCCTCGTTCGGTGCTGCTTCGTCGAACAGGTGATGCCGGC
>paratb_93
CGCGGCATCTGGCACCTGGCAACGACGGTGCAGCGGCCAGCGCTTCGAGGAGGTGGTGCAGCGCGGTCAT
CGGGTGGCTCGGTTCAACGGGGTCGTCCCTCCGGGATCGGGTTTTCTTGACTGTTTTCCGACTGCGTCCC
GCGACCGCGTCCTGCGTCCCCCCTACGGGGGGTGGGACGCAGTCGGACGCAGTCGCAGTC
>paratb_94
CGCTTGAACGCCACTGCGTCCGGACGCGGTGGGACGCAGTCGGACGCAGTCACGTGCTGTCCCCATCGGC
GTCCTCCACAACGGCCCTGAACCCCTTGGCGCCACGCTTGCCTGATATCTCTACGAGACGGCCTGACACC
ACAAGGTCATCGACGACGTCGCGCACATCGTCGTCACGGAACTGGATGTCGACGTTGCGT
>paratb_95
AACTCAGCGAACAACAGCCGCATCGACCCAACAGCGTGGTCGGGAGCCGCAGCAACGACGCGAAAGACAG
CGTCAGCCAGCTCGGCGTTCGGATCGCTCTCAGGCACGTCGTCGTCCCTGGGCGCGAAGAACCGCATCGT
GAAGTCAGGACCGAACGCCTGCGAGTCATCGACGACCAGAGTTCCCATGAACGTCTTGCC
>paratb_96
GGGCGACTTCGTTGCGCGCCCGTTGGCCCGTAGATGCCCGGGGCGGTCTTTGGTCACGAAGACGTAGGAG
ACGCCGCGCAGCCGCCGGCCGAACGGCGCCGAGTTCTCGAGCACGAACCGAGCCCCGTCGAGCGCGTTGC
CCTTATGCACCGAACCGTAGGCATCGCGGCGGCTGCCGTCGCGCACCATCGGGAGGTGGT
>paratb_97
CGCACGCCAGCGTGGCCGCGCCGACACGTAGGCATGGCAGGATCAGTCGGCGGCGAAACGCCGCGGCGCC
CTCGACGGCCTTGATCTCGTCGCCGTGCAGCGCCATCGCTTCGTTGACGCCGTCGTGGATGACCAGCGTC
GGTGAAGGGTCAAGTAGTGCGTTCAGCCACTCCTCACGGACGGGGCGGCTGGGAGCGACG
>paratb_98
AACCGAAACCGGGCCTTGATCACCGCGGGGTCGACCCCAAGCAAGCACAGCTTCTCGACGGTGCTCGTCG
CGTCGGGTTCTTCGTAGTGGATATACACGACGTCGTTGCCGGCGTTGAGTTCTGCGGCGGCGCAGCCCAA
CGCGAACCAGGTTTTACCGCTTTCGGTTTCACCGACTATGGCGTGCTCGCGACCAGGGTA
>paratb_99
GAGCGACCGCTGCCCGTCGGAGCGTGATATGCCGATACCGGGATGTGGGCGTTCGATTTCGCCGCGCAGG
TAGGGTCCGAGATCGAACGCCTCCCACGTGGTCGGCTCGGCGCTTGCCTGCTGCTGTCGTTGGCCGTTTC
GCTGCGGTGGTTCGTCCGGCGGTTCCCACGGGGGAACATCGGCCCATTGCGCGGCGAAAT
>paratb_100
CGGCAGCGGTTAGCATCGAGGAGCCTTGCGCCGCAACCATGGCCGCTGCCGATGGATATCCTCGTGGTCC
CGGTTCCGTCGCCCGATGCGAGTCCAGTCCGCCGCAGCCGAAACCGCCTGGGACGCTTCAGCCATGGCCG
TTTGAGCTGTCTCGACGCGCAGGACATGATGCTCCCCCGCGACAGCTAAGGCGAGCAACT
>paratb_101
TCCGCGGATCGCCATCAGCCAGTGCCGACCAGGCCGGTGTGCCCGCCGGCGGCAAGGGGCCGGTATTCGC
CTGCGTGATTAGCGCTTCGATGAACTGATGAGTTTCCCACCACGACACTTGCCGGGAATTGGTTGTACCC
GGCGTTTCTGCCGACGGTGCAGTAAGCTCAGTCGTGCGGTTGTAGGCGGTTGCGTGGCTG
>paratb_102
CCGACCTTGCTGGTTGAGGGTCGGTCCCGGTGGTGCGGGGCTCGGCCCTCGACTTCTATCGGTGGACCGT
TTCGGTTCTGCGTCACGACGCGCCACCGAACGGCTTCATCGCCGCGTCGAGCTCATTAAGATCGACACGC
ACTAGCCGGTTGCCGCTGCGATAGCCGGCCAGGCGCCCGTCCGCGATCATTTGGCGGACA
>paratb_103
GTGCGATCGGTGACGCCTAGGTACTCGGCTGCCTGTTGAAGCGATGCCCATCTGCGCGCTTGGCGGGCCG
GAGAAATAGTGGACGACGAAGGCACGACGAAACAAAACCTTTCGGAGTGTTTCGGTTGCCGAAGCCGAGT
CCCGATCTAGCGATCCGGGTTCCGCGCACCGCGGGGCTTGACCGGCAGCCTACACGGAAG
>paratb_104
```

Figure 6-5

```
TGCCCCGAAATATACGGAACGTGCGCCGCTTTGCGTGTGTGGTCGGAATCAGTTGACCGCGCATCGCGGC
AACCGTGGTCGCGGGATCGGGTAGTGCAACGGTGCCGTGATCCGGGCAGACGATATAGCCGATCCACTCA
AGAGGCATTGCGACCGACGGGTCCGCATGCCGTCTCGAGACGCGCCGGGTCTTATCGACC
>paratb_105
GAACGGATAGTCAGGGAGTCCACTTCACGCTGCCGGCGCTGGATGTGCTCGGCTAGAGTTATCCCGCTCG
CGTCATATAGTTCTGTTGCCGGCGGCAGGCCGAGCGCTGCGAGACGTTCGTCGTCTATGGGCTCGTAGTG
CGGCACGGTGGTCTTGCCGGACTTGTGGTGCATGAGCGCGATAGCGACACCGGGATCCGT
>paratb_106
TTTGTCGGATTTGACGATGCCGACGCATATTCCGCAACCGCCAATCCCGCACCGCAGCACCAGTGTTGGC
GGCATCGCGGCATTCGTGAGCCACCACTCGCGCTGCTCAGGCAAAAGGTAGTCGAGGTTGTCATCGGCCA
TCAGGCCCCCCGGTTCTCGGCGATCTTCGACAGCAGCGCTGCAATCTGTTTGTCGCGGCC
>paratb_107
TTGCGCGGCGTGCTGGTAGCGCATCGCTGCCTGTGGCGTCGAATGGCCTAGCCGGGCCATGAGTTCGGCG
AGGCTGGCGCCGGTGGCGGCGGCCAGGACTGCGCCGGAGTGCCGTAGGTCGTGCCAACGCAAATCGTCGC
GGCCGGCTGCGGCCCGCGCTTTGTACCCCAATGCCGGTTGAGGGTAGACGGTTGCAGATG
>paratb_108
CCTGCCGCGCTCGTTCGGAAATAGCAGTGAATCGCGCTTCTTGCCAACATATTTCGCTAGGTGTGCTTCG
ATGGCCGATACGAGGTGCGGTGGGATTGCGACGTCGCGGATACCGGCGTCAGATTTAGGCGTGGTGACTT
CGAATGTGCCGCCATGTGTGCGTACCGCTGCGCGGCGAATCCGAATCACTTCATCGGCCA
>paratb_109
GATCGATATCGCCGCGCTGCAATTCGATCGTCTCGCCGAATCGGAGTGCGCACCAACTCGCGAGTGCGAC
CATGAGCCGGAGACGCTCGGGCATTGCTTCGGTAAGGATCGGGAGTTCCTCGACTGTCGCGGGCCGGATC
TTGTGGACGCGCTTGGCCCGTCCGGCACCCACGATGCGGCACGGGTTGGCGTCGATCAGC
>paratb_110
TCGTCGTTGACCGCGCTACCCATGATGGTGCGCAACAGGCTGTAGGCGTGGCTGCGCATCGTGGGTCGGT
TTGTCAGAGTGCCTGAGTACCATTCGCGGACATCTTTCGGGGTGATCGAGGTGAGCTGACGACTCCCAAA
CGCTGGCAAGAGATGGTCATCGAGGATGGCTTGATAGTGCTCTCGCGTGCGGGCCTTGAT
>paratb_112
AGCGGACCTGAAACCGCCCTGAGGGCAACTTTCTGATGTTCCCGAATGCACGCTTATCCCGTTTCGCGTC
GGCATCACGTGCCAGACTGCGTGCCAATTCAGACCGCCTCAATCGGGTCGAATGGGATGAACCCAGTACC
CCATTCCGTGCCAAATACGTGCCACATGAGCATACGGCATGTTCCGCTTGCTTCCGCTTG
>paratb_236
TTGGCTGCTGGACGGCCGGGTCGGCCGCCAGTGGTGGGCCGGGGTGGCCATCGGGTTGACGCTCACCCTC
AAGCCGGTGCTGGGGCCGCTGCTGCTGCTGCCGCTGCTGAACCGGCAGTGGCGGGCGCTGGTGCCCGCGT
TCGCGATCCCGATCCTCATCAACGCGGCGGCGTGGCCGTTGGTCAGCGACCCGATGGACT
>paratb_257
CGCTCGCCGGTGGCGACCAGCACGCCGGAGCAGTCGGGAAACGCGGTGTCGCCCGGCACCGCGAGCGCCA
GCACCACCGACGACGCGGCGACGACGCGGCCGGCGGCGGCGGCGCTGCGCGGGGCGATCCCGGCCAGCAG
CCGCGCGACCTCCCGCGCCGGCACGGCCAGGATCACCGCGTCGGCGTGCCGGCGGGCACC
>Contig16_280
CCGGCAGAGCGGAGAATCCGCCGGTGGACTCCGAACCGCCGAACGGACCGCCGCCGCCGGCGCGGTGGAGC
CGGCGCAAACCGGAGGCGGCCGCGCGGCTGGAGGCCGCGCGCGCGGCGCTGGCCGAGGTGTCCGAACGCG
TGCACGTCCCCACCGAGAACCTGGTCGCGCCGGACCTAGTGCGACGGCTGTGCTGGGACT
>paratb_330
CGGGTGAGCCGGCGCAGATACCCTTGGGCCCCCATGGCCACTCCTGACAATGCTGATAAGCCTCGACGCT
TCCATTTATGCCAACGGACACCGTAGACCTCTTGGTTCCCCGCGCCAACCGACTCAAACACCCCGGTTG
GAGCCCCGGTGAACGCCGGGGCACTATCAAGGGGTGGTGGTCGATCTGCGCGGCGTCAGG
>paratb_354
```

Figure 6-6

CGCGCGGTCGCGGCGTTAAGGTGGGCGGACAGCCCAGTGACGCCGAGGAGATTCGATGACCAGCACCGAC
TCGACCGCGCACACCCCCGCCGCCCCGGCCGCCGGCCCGCCGCCGCGGCGCGGCTTCGGCGTCGACGTCG
GCGGCAGCGGCATCAAGGGCGGCATCGTCGATATGGACACCGGGCTGCTGATCGGCGAGC
>paratb_518
GCGGGCAGGGTGGCGATCAGCCGGCGCAGCGGCCCCGGGTCGCGGGCCGGCAAGCCGATCTCGGCCCGCG
CCGCGGCGCGCTGCCGCAGCCCGGCCCGCCAGGAGCGCGCGGTCAGCGCGCGCATGGTGGCGTCGCGCAG
CCGGCCCCGCAGGCGGTACCCGGGGCCAGCCCGCTGCCGATCGGCGGCAACCCCTTGGA
>paratb_584
AGGAGGAGCCGGGCAATCTGACCCCGCCCGGCGACGATGCGCGCCGTGCGGCCGCGTCAGGCGACCGCAC
GCAGCGCCAGAGCCAGATCCCCGCGGTCGGCGACGCTGAGCCCGCCCAGCCCCAGCCAGGACGCCATGGA
CCACAACTCACCGGCCAGCACCGCGGCGACCCGGGGCCGCGGCGCCTGCGGCTCGGCGAA
>paratb_585
GGCGCCGAGGACGCGCAGCGTGCCCTCGGCCCGGTCGGCCTTCAGGTCGACGCGGGCCGCCAGCCGCCCG
TCCATCAGCAGCGGCCACACGTAGTAGCCGTACCGGCGCTTGGCGGCCGGCGTGTAAATCTCGATGCGGT
AATGGAATTCGAAGAGCCGCTCGACGCGGGGCCGGAAGAAGATCAGCGGGTCGAATGGGC
>Contig16_586
ACAGCAGCGCGGTGCCGCGGTCCGTGCGCGGCACGGCGCGGCCGGCCCGCAGGTAGGCCGGCGCCGGCCA
GCCGGCCACCTCGACCCGTTCCAGGTCGCCGGCGGCCACCAGCTCGGCGATCGCCGGCTTGACCTGCGCG
GCGGACAGCCGGAAGTAGTCGCGAATGTCGGCCTCGGTGCCCACCCCCAGCGCACCGGCG
>paratb_587
GCCCGCAGCGTCAGCTCCCGGATCGCCTCGTCGTCGTCGACCCGGCGGGCCAGCACGTCGGCCGGCAGCA
CCCGTTCCACCAGGTCGTAGTGGCGGGCGAAGCCGACCCGGGTGGCGGTGGTGAGCACTCCGGCGGCGAA
CAGCGCCTCGGCGACCCACTTGGTGTCGCTGCGGTTCCACCAGGCGCCCTTCCTGCGGCG
>paratb_588
CGGCTCGGCCGCCAGATGCGCCTCGATCTGGCCGGCCGTGCTGGGCCCGAGCTCGGCGACGGCGGCCACG
ACCGCGTCGGCGAGCCGCGGATTGGCCTGCACGATGTGGGTTCCCCACCGGCCGTGCCGGTACTGACGCA
TCCGCCAGCGCAGCAACGGCCAATCCTCGACGGCCATCAGCGCGGCCTCATGCGCCCAGT
>paratb_589
ACTCGACCAGCAGCCGCGACGAGCGCGGGCCCCACGCGGCGCGGTCGAGCACCTCGCGGTCATACGGGCC
GAGCCGGCTGAACACCGGAGCGTAGTGGGCACGCACCGTCACCGACACCGAATCCAATTGCAGCACTTGG
ATTTTGGATATCAGCCGGTTCAGGTGCGCGCGGGTGACGGCACCCGCGGGCCGGGGCTCG
>Contig16_609
GCGTCGGCGTACCCGGGCGGCGGGTAGTGCGGCGACGGCAGGATGGTGGGCTGATAGCTGACGTAAACGT
AGTGGGCGCCCTGCTTTTCGGCGGCCGAGCGGGCGGCGGCCGCGGCCGGCGGGAAGCCGGCCACCACCAG
GGCGTCGCATTCCCGGGCGGCGGCCGCCGCGTCGAACTGGGCGGCGATGAGCCCGTCCAG
>Contig16_744
CGAGTCCGGCGACGGCGCCGAGACAACGGTGGACCTGGGCAGCCCCGCCGCCCGGGCGATCTGGGTGACG
GCATAACTCGCCTGTTGAGCCCTCGCGCTTTCGCGCCTCGCGCCCCGCGCCTCGCGCCGCGCCTCTCCCC
CCGCCGAGCGTGCACTGGTTGCGATTCCGCCGCCGTTTTTCGCGCGCCGCGCACGTTCG
>paratb_811
CGCGCCAGCCGCACCGCCGCGCTGCCCGGGACGGCCACCGCCGCCGCCACCGGGGCGGCCGCGGAAACCA
CCGCCACCACCGGGCGAGGCGCCGACGCCGCCGCCGCGGTAGTTGCCGCCGCCGCCGTCACGACCGCCGG
GCCCACCGGGCCGGCCGCCGCCGGGCCGCGGGGCTCCGGGCCGCGCCGGGCGGCCCGGGC
>Contig16_813
GCGCCCGGGCGGGGCGGTTGCCCCGGGGCGGGCGGCTTGGGCTGCCCGGGAGCCGGCGCCGACGGCCGCG
CGGCCGCGGGCCCCGGTCGGGCCGGGGCCTCGGGCGTGGCCTGCGCGGCCGGGGTGGTCGCGGTGCCGCC
GGGCTGGGCGGGCGGCGCGGCCGCCTCGCCGTTGCCGCCGGCCTTGATCGCGTTGTCCAG
>paratb_935

Figure 6-7

```
CGGCCTCCCACTCGGCCGAGGCGATGGGGTGCCCGGAGTTGGCGACCTCGAGGGCGGCCAGTTCGTCGCG
GTGGGCGTCGACGGCGGCGGCGAAGGCCCGCAGCCCGGCGGCCCGGTCGGCCGGGGCGAGCCGGGCCCAC
CGCCGCTGGGCCGCCCGCGCCCGGTCCACCGCGTCGTCGACGGCGGCGGCGTCGGCGTGC
>paratb_1001
CGCCGTAATACGCCACGTACAGCCCGACCAGCACCAGCACCGCGCCGCTGATCCGGTCGACGAACGGCAG
CATCCGCCGCAGCCGGTCGGCCGTCGCCGCGCCGGCCGTCGCCGCGGCGACGGCCGGCACCCCCACCACC
AGCGTCAGGCCCGCGACGTAGCCGAGGTAGACCGCGGCGCCGGTCAGCAGCGAGCCACTG
>paratb_1007
GGTTCACCGCCCGGCCCCGCCTGCTATCCCTTCTCGAAGGCCAGCTACCCGCCTTCGGCGGCGAGCTGTC
CGCAGGCCCAGGCCCGATCGCCTGCGCTCCAGCTACCCGCCTTCGGCGGCCAGCTGTCCGCAGGCGGCGC
TGATCTCGCGGCCGCGGGTGTCGCGCACCGTGCAGGACACCCCGGCGGCGCGCACCCGCC
>Contig16_1027
CGTGACGACCTGACCCGGGAGGGCCAGGCGCAGCAGGACAAGGCCGAAGCGCAGCGCGACGCGGCGAAGA
AGGAAGCCGAGGCCGAGGCCGCCCGCGGCGGCGCCGAGGCCGCCGAGGAGCGCCAGAGGGCCAACCAGTA
GCTCGCTGGAAAAGATGGGTCCGGTCCGTGAAAATGGGCCGGGCCCATCGCTTTTCTGGG
>Contig16_1104
CGACGAACACCACCGTGGACGTGGCGTCCACTGGCGGAAGGCACGTATTCGAAGGGTGCGCTATTCGTCG
CGTCAACATCTGAGTCCGGGTTGAGCCGTGGATTGGCATGCCTGGAGGTAGGCGGCCCAGCTGCTCTGGG
CGTACTGCGCCCACTGGTAGGCCGTTGTCGGGTGTATCCCAAAGAGTTCTGCAACGACTG
>paratb_1105
GTGGTGGAAGTGTGGCGGCGTTGGTGATCATGGCGGTGTTGCGTGCGTGGATGACCGGCAGTCCGTGTTT
CGTCAGCCGTTGCTGCAGGGAGCGCGGGTTTACGGGCCTGCTCGGCGGCCGGCCTGCCAATAGGTAGGCG
GGATTGTCTGCAGACCCGTTGCGCAGCAGCGTGTTTACCGGGCCTCGTGCGATGAGTTGT
>paratb_1106
TCGATGAGGCGGGCCAGGGTTGGTGGTAGCAGGACCGGGTGGCGGCCGATGGTGAGATATGAGCCGTCAT
CGTCGGTGTGATACCGGTCGGTGGTCAGTTCGGCGATGCGCACCAGGGGTGGGGCGTAGAGCCTGATCAA
CGCTCCGACCACGCGAACATCGAGCGGGAGTGTGTCATCGGTGAGGCACCGCTTGAGTTG
>paratb_1107
CTGTTCGAGTTCGTCGTCGGAGAGCAGGCGCGACGGGAGCTGGGATCGGCGTTGGGGAACGACGAGCTCT
GCTTGTGTCAGGCGCTGCTTTTCCAGCCAGCCGATGAATGCGGCCAGGTATTTGTGTTTGGTGGGATGGG
CGTCCAGCCAGCGGTCCAGGTGAAGTTGGGTGACGGAGTCCAGCGGGATTTCCTGGTCAT
>paratb_1108
CGAGCCAGGTCAAGAATGCGATGGTGGTGCTGATCTTTTGGCGATCGTTGGCTGCTGAGCCGATGGTGTA
GCGGCGTCGTGCGGCGCGTTTTCTCGCGTCACGGATGACGCGCCATTCGGCGAACGGTCGGACGACACGG
GATTGATGCGGTGGAAGGTGTTGAATTTTGCGGCTCGCCCAGATCTGCAGTTGCGCGAAC
>paratb_1109
TCTTCTTGGCGCGACGTCAGGATCCCGGTAGTGACCAAAAGTTGGCGGATATAGCGGGTGGCGTTGTCCT
GGTCGAGTTCATCGAGGAGCTCATGGGAGATCGCGCGGCGCTCAGCGACTAGCTGCGCGAGCAGTCGGGC
AGACGAACTTGCTTGCAGCCAGGTCTGCACCGATTCGGGATTGGCCGCCGAAAGAGCATC
>paratb_1110
CGCCAACGGCTGCAGCTGCGGCACCACCGTACCGTCGTCGAGGCTGAGTAGGACGTTGACGCGGTCAGTC
ATTACGCAGCACGTGCACTTCCCGTCGGCGTAGTTCAGGCCCTCTATCCCGCATGTCCTGCAGGAAAAGT
CGAGGTCCACCCCGCAGCACGGGGCGCAGATGTCCTGGCCGTCCGGGTTGCGGCCAACCA
>paratb_1111
TCACCGCGGTGCGATGACAGTTAGCGCAAGGTTGCGGGTGCAGGCGTCGACGGTGATAGCAGTCCCGGCA
TACGGTCCCTAATGGCCATGTGGCGCAAGCAATCCCTGGCTTTTCGCAGCTGTCGCAGTGCCGCGGGTGG
TGCGGCCAGCAGGTAACGCAGTGCAACGACCCTCCGCGATATTTACCGCCGGCGCGGGTT
>paratb_1112
```

Figure 6-8

```
CGCCCGCAGACCACACACTCGCCGATGTTGCGGTAGCACCGCACGCAGGTATCGGGGTGCGTGTCGGTGG
CGCGAGCCTGGATCTGCGCGATCTCGCCGCATACACCACATTTCCTTGCTGGTGATCGGTAGCAGGTCCG
ACAGATCGGGCCGTCTGCGGTCTGGGCGTGGACCCGGCGCACATTGCCGCAGCGGCAACA
>paratb_1113
CGATTGTGTGGGCGGCAGGCTGCACCTTTGGCAGAGCACAGTGCCGTCGTCGCGGCGAGCATTGGGCGGG
CGTTTCCGTCCGCAGCCGGCGCATACCTGAAGGAACTGGGGGTCTTTGTTGTAGCAGCGACGACAAACCG
GGCCGTCTGCACGACGAGCGATGATGTATCCGTCTTCGCCGCAGCGCGCGCATGGCCGTA
>paratb_1114
GTTCGGTGCGGATCACACACCAGGGACAGCAGCGCCCCTCGGGGCTGTTTCGCCGCAGCGCCAGATCGGT
GCGACCGCATTTCGCGCATCCCAGCAGACTGACCGCGTCCGCGTGCCCGGCCGCGGCAAGCAAGGTCAAC
AGGCGGGGAAAGGCTGCCGGGCACTCATGAGTGGGCGCGGTGAAGGCGCCCGGATTCTCG
>paratb_1115
CCGAGATATTCGTGAAGGTGCCGGGCGTTGGCCGTGGACCATCCTTTGGCTTCCACTAGCAGCTGCTGTG
CTCGCTGCCGGGTCATGCCCGAACCGACAGCGCTGATCACCGACGACACCAAAGACTCGCGCACGTGCGC
GATCGGCGCCGTCGAGTGTGGCCGTGTCATGACTTGCCAGGCCGTCGTACGACTGTTTTT
>paratb_1116
CTGGGCGTGACCGCCGGCGCACCACTCCCCCCCCGCGCCGGCGGTCTTGCGGACGGGTTTGTTGACGACC
TCGAGGACGATGAGGTCATTGGGTGTGCATCCGAGGATGTCGCACAACGCCACCAACGTGTCCATGCTCA
AGCGCTGAGGAGGCTGTGTCACCAATCGAAAAACCTGCTCGCGTGAGAGCGTGATCCCGC
>paratb_1117
GCTCCACCAGGTGCGGAATCAGATCAGTGGTCTTAAACATCTGCTGATCGGCCATCAAGTCACGCAGCCG
CCAGCGATAACCCATCTTCTTGATCATGTCGGTGCTCCATCCCAGTGGTCGCCGAGACGGCCCATCAGCG
AGGCCTTCAGCAGCTTGTTGCGGTATTCATTAGAGACATGGGTGTAGATCGACGTCGTCG
>paratb_1118
AAGCATGCGCATGACCCACCTGTTCCTGGACAAACCTTGCGGGATAACCGAATTCGGTCCAGTGCGTTAC
TGCAGAGTGGCGAAGGCAATGCAGATTCAGTGAACGGTCTAACCTCGCGTCGTCACGAGCGGCCACAAAC
GCTTCGTTGATCGATCGTGGAGATAGCCGGCCCCGCGCTCGGTCACCCACAGCGCCGGG
>paratb_1119
TGGCGATCCGGCGGTGAAAACCGTGGACGGATCTCGGTGAGCCACTGGTCCAATGTCTCGACCACCCAGT
CCATCTCGGGGACGAGCAGCACAGTGCGCCGCTTAGGCGGTGCTCCCTTCGGGGCCTTGCCGTAGCGGAC
CATCACCACCCCGAAGCCACCGAATTGTGGTGCTTGGCTGTTACGGCGCAGATCGACCAG
>paratb_1120
GTCCAGCCGAGACGCCTCGGTTCTGCGAAGGCCAAAGGCGTAGATAGTTTTCAAAACCGCGGCATCCCGC
GCGGCTCCCAACGCGCCCTTCACGCCGCGACCCTGGATTGTGCCTGAGCGGGCATCCGCTGCGTCAAAGA
GCGCTTGGATCTCGTCATAGCTAAGCGGGCGACGCCGGGGATCACCCTCGTAGTCCAGCT
>paratb_1121
TGTGCTGAATCGAATTGCCCTCATGGAAGATCGCCTGCGGGACATCGCCGAACTGATCGGCACACACACC
GGCCCAGCCGTAGCGGGGATCCAGCAAGTACTCCATAAACAGGCTGATATCGATCTCGTAGGACCTCGCC
GTCGACACCGCCTCCACCGTCGTCGACCGCAAGTGATCGATGAACGCCTCGCCGTCGGCC
>paratb_1122
GGCGCCCATTGCCACGGATACAGCCCGCTGAACGCTTCCAGCCGGCGAATCAACCGCAGCCTGGCGCCGA
TCGTGCCCGCTCGCAGGAAACGCGCTGATTGCTGGCGGCGCCAGCCCTCCAACATCGCCTCGAACACCGC
CGCAGCCTGATCGAGGTGAACCACGTTCTGCGCCAACACCAGATGCGCCGAACCAGGCGC
>Contig16_1123
CGATAACGTCACCGCTCTGTTGTATCAGATGCAATGACGATGCGTTGGAAGTGACATGGCTGATCACGGC
CCCAACGCTCCGATCCCGGAATCCACCACCGGTCTCCACCACCTAGCACTACGCTGATCCCGCAACAGTC
CCGAAATGTTGCATCCAATGCAATTCCGCGCATTTGTCGCAGGCGATGATGTCGAGTTCT
>Contig16_1130
```

Figure 6-9

```
GGTGTCCATCACCATCGACGTGCGCGCGGTGTGCAGCCATTCCAGCATCGAGGGCACCAGCGGCGCCTTG
GATATCGCCGCCGAGGCCGCCGTCGCCGCCACGGCCGGCACCCGCACCGGCCGCCCGCCCAGCGCCTTGG
CCACGTCGGCCACCGTCACCACCCCGTCGCCGGCGATGTTGTACGCCCCCGGGGCGCCG
>paratb_1549
AACCACAAATAGGCGGTCAGTGCGTCAACCTGGACCGTTCGCCGGCGAATTCAGGCCGCGGTTGACTCGT
CGCCACCGATTGTTTGCCCGACCGCGGGCCCGACCGCCTAACCGAAGAACGCGGCGGCGTCGTCGTAGCG
GCTTTCGGGCACCAGCTTGAGCTGACGCACCGCGTCGGCCAGCGGCACCCGTCCGATGTC
>paratb_1733
CGGTCAACACTTTCCGCACGCTGATCCCACATTCGGCGAACCAGGCATTAGCGCGTGTCCAGAACTCGGC
GGCGGTTTCTTTGATCTCATCGTCGAGTACCTCGCTGTAGGCCAGCCGGGAATATCCATCGATGGCGGTG
TGGAGATAGTGATATCCCCGTATTGGGTTGCGGTGCTTGCTGAACACCCCGCTGCTCTTG
>paratb_1735
CGTCGAGGGATGTATCCCCAGCAGATACCCGATGCGCGCTGGTCCCCACCGGCGGATCACCCGGACTTTG
ATGATGCGCCGCTCGGTGCGCGTGGGCGTGCGGTTGGGGCTGTGATGCGGTCGTGAGCTGCGGTCGGCCA
TTCCGGCCTCGCCCAGCTCGCGGTAGCGCCTGGCCCAGCGCTCTGCGGTGGTTACCGAGA
>paratb_1873
CGTCGCCGAACGGGCGGGACAACCAGTCGATCGCGTTCTTGATGACCGCCGGGATGCTGCCGTTGTACTC
GGGGGTGACCACCAGCGCGGCGTCGGCGTCGGCCGCCGCGGCGCGCAGCGCGGCCACCGGGGCCAGCGGC
GGCGCGTCGCTGGTCATCGCGTCGTCGATCTCCTCGTTGTAGAACGGCAGCTCGCCGAGC
>paratb_1904
TCTAGCAGCTCAGTGAGCTAGCCGCCGGGCAACCGCCAAACGCGGCTTCCAGCGGCTAACTCCATTTAAT
TCGGCCGATTGTTTGACCAGTCGGATCGATTCTGCGTTGGCCGACGTGGCGCCGCAAACGGGTTTGCACC
ATGCACTTATTTGCGTTGTGCCACTCAATCAAAGCCGCGTCCCATCCTGGGCAAATTATT
>paratb_1905
AATTTAGCCGCGCTGCATGTGCGTCATTTCAGCTACGCCGCCGGAGCTGGAACCTGTTGTGCTGCAGCGA
TTAACTCTGCACTCATGCTGCCATCGAGCCGCTATTGAAATCAGAATTTGGGTCTTTACGCATGTCTAAT
AGGCGCTATAACATTGCTTCGTCGGGCAAACTACATGCCGAGTATGCCCTGGATGGGAAG
>Contig16_1906
GATCTGAATATGAATTCAATTGGGGTAAAACAGCTCCTTAAAGTTGCCGCAGCGGCCACAGGATTTACCG
TGATGCTGTTCGTCCCGACCGGATGTTTGGAGACCACAGGAGCCGCCACAGGCGGGACGACCGGCGGCGG
CCTCTGCATTCCCCTGCTGACCTGCTGACCAACCAAGACCCGCGGCCCGCCGGATCCCCT
>Contig16_2459
CAACCCGGACAGCGCGACGCACGCCGGCGGGGGTTCGACGTCACGACGGTCACGGCCGCCAGCAGCACGG
CAATGGTTGCGGCGGGCCGCAATACGGTGCCCGCCGCGACCGCGATCAGGGCCGCGGCCGCCGCGACGGC
CGCCGATTCCGGCCGGCCGCCGGCGGCCAATCCCACCATGAGCAGACCGAACCCGGGCGC
>Contig16_2476
GCGACGACCATCAACAGCATCGCGACCGTGCCGGCGAGCAGGATGCCCAACGTGTCCTGCGACCCGTCGC
GCGGGCGCTGCGGGTGCTGCGGCGGCGGCGCCGGGGGTGCCGCCGGGTGCGGTGGCGGCGACGCACCGGT
GCCGGGCGGCGGGGCGGGCGAGAGCCCGTGCGACGCGAACAGCCGGGCCAGCAGCATCAC
>paratb_2634
CCACGTACGGTGTGCCGCACCGCGCCACACCGATGTTGCGCGCCGCTGCGCCGGCGTTGCGGCTCAGCGG
TATGACGGTCACCCGGCCGGCGGCGGCGATGCGGCTGGCGGCGGCGACCGAGTCGTCGCGGGATGCGTTG
TCCACCACGATGATCGGGCACTCGGTGGTGTCCAGCAGGCGGGTCAGCGTGCCGGTCAGC
>Contig16_2842
GGCCCGGACCAGCGCGTGCACCGTGTAGGGCGTCCGCGCCAACAGGCTGCTCAGCAGGAACGGCCCCAGG
AAACCGGTCGCCCCGGTCAGCAGGATGTCGGTGGGCGTGCCCGCGCGGCGGGCGCCGGGTCGGGCAGCG
GCAGCGCCGCGTCGGCGCGCATCTGGGCGGCCTCGTGCGCCTCGTACTCGGCGGAAATCT
>Contig16_2863
```

```
ACGTGGGGCGCAAGCTCGGTGAGAAGGTCGTCGCGGCGACCACCGCGGGGCATGCCGAGGCGGTGATGTG
GGCCCGGGAACGCTTCGGAACCGAGGTGGTGTGGGCGATCGAGGATTGCCGGCATTTGTCGGCCCGGTTG
GAGCGTGACTTGATGGGCTTTGGCCAGTCGGTGGTGCGGGTGCCGCCGAAGTTGATGGCC
>paratb_2865
GCACGAACTCGATCCCGACCACGCACCTAAGGCTGGTTCGCTGGATCTGGCCAAGCATCGCCGCATCCTG
GGTGACTGGCTGGTCACGGTGCCCGGCCTGGTCGCCGAACTCGCCCGTGACGAGCTGGCCGACATCACCC
GGCTCACCGAGACCATCAACGCGTTGGCCAAACGGATTGGCGAGCGTGTCCGCGTTGTGG
>paratb_2932
ATGGCCACGGATCCTGGTGACTTCGGGTCCGTGGCCATCTGGGGAAAACCGGGCTGGTGCTTACCTTGCC
TTCGGCGGGCCCCCGACTCGTACGGACGCGTCGGTCGCGGCGGCGGCGCGATGCTTACGCGCGGGCGCCA
GGGCGGCGGCGTGCGCGGCGGGAAGGCCGGCCGCGGACAGGGCGGGACGGGTCGCGCAAG
>Contig16_3034
GCTGGGCGCTGATCGACAAGGCGCTGGGGCTGGACGTTCCCGAGCCCGCCGAGACCTACTCCAATTCGCC
GCACCTGTACGAAGAGCTGGGCATCCCGGCCGGTGCCGGGGGCCGGGTGGGCGCCGCCCGCAAGCCGCAG
GGCCCGCGCCGCAGCGCCGAGCGTGCGACCGGAAAGCCGGACCAGAAGTCGGAGACAGCC
>Contig16_3156
CGAGCTTCTGCTTCCAGGGCACCGTGTGCAGCGCGGGCCGCACCCGCGGACCGGGACCGGCATCACGCCT
CGGCGTCAGGCCGCGCCACGGGGCGAAATCCCGTGCGTCCACGCCGCTCTGTCATGGCATTACCTCGCGC
CGGTCGGTTCGCCGGAGGAAACCGCTTAGACGACCCACGGGAACCGTCACCGAAACGGTC
>Contig16_3254
GCAGGAACAGGTCGAGCATGCCGCCAGTGTGGCGGGCGGGGGTGACAGGTGGCGCCGCTAGCGATCGCCG
CTAGGAGCCTGCTGAATTAGGGGATTTTTTGGGGCGGGGCGTCTCGAACCGTCTAGCGGCGTGTTGTAGT
CAGACCCTGTGGGTCGACAGAAAAGAGATCGCCCCGCCGTTGTTGAGCGTGGCAGCGGTC
>paratb_3255
GGCGGCTGAGGCAAGGCCTTGGTGTGAGGGCGTGTTAGGCGATGGCCCAGGTGGTGTCGGTGCGGGTCAG
GCCCATGGTGAGCAGCCGACGTAGGTTCAGTGCTGCGGCGCGGTGGTGCAGCCAATGGTTGTTTTTGGCG
GTTCCTCGGTAGCGGACCTTGCGGTTGCCGCGAGTGAGCCAGGCCATTGAGCGTTCCACC
>paratb_3256
ATGGGCCGGTGTTGGCGGTATTCGGCTTGCCAATCGGGGTCGCGGGCCGCGACGCGAGCAGCGCGCAATA
ATTGCTCGTGGATATGAAGGGTGAGTTTGCGTCCGCGCGTGGCGGTCGTGCACCGGGACGCCAACGGGCA
TGAGCGACAGTATCTTTCGAAGGTGACTCCGCCACTGGGACGGATCGGCATTCCGTGTCC
>paratb_3257
AGCCGGGCAGGTCACGATGCGGGCGTCGAAATCGATGAGGAAATCGTCGCTGGTGAAGCCACCCGGAACC
GGCGAGCGTAGCGGTAGCGGTTTGATCACCGCGACATGGCCGGCGTCGGCCAGTGCCGCCCGGGCGGCCC
CGGTGCCATACGCCGAATCGCCCAGGACCCGCACCGGGGTGTGTTCACCCTCGAGCAGG
>paratb_3258
CTCAGCCCGACGACGGCCTCGTGGTTGTCCGCGCCGCTGGCCTTGGTCAACGCGCAATCGGTGATGATTC
CGGTGTCGGGCTCGACGGCAAGGTGGGCTTTGAAGCCGTCCTGGCGGCGGTGCACCGTCTTGTGAGCGTG
CCGCGTGTCGGCATCGACGGTGGAGATCACGCGATCCCCACTGACCTGCTGCGCGATGCG
>paratb_3260
TCCCCGGATCGTCGTAATCATGGGCGCTGCAGTGGCTTCGATCACCGCTGCAGCGCCCAGGGACTTCGC
GGCGCACTCGTCGGATCGCGGCGATCAACTGCGTCACGGTGTCCTGCGTGGCCACCGCATCGTCGAGCAC
CGTGGAATCCAAGGCCCGCCGTGTCTTGCCCGCCAACACCCCGGTCTCGGCCACCACCGT
>paratb_3261
CTTGACCGCCTCAAAGATCCGGTTGGGCCGATCCGAAGCCGCCAACCGACGCCGCCAATACGTCAACGTC
GTCGAATGAAACGCGCCCGCCGTGATCGGCAACCCGCACGCTGCTTTCCAGCGCAGATCGAAAGTCACCG
CATCCACGGTCTCGTTATCCGAAAAACCGTGCAGGGCCTGCAAGGTGATCACCGAGGCCA
>paratb_3262
```

Figure 6-11

```
TCACCTCAGCCGGCACGCTGGGCCGGCCCCGCTGCGACGGGAACAAGTCCGCGAACATCTCCTCGGGAAA
CAACTGGCTGCGGTGCGCCGCCAGGAACGCAAACATGCTGTCGGCCTTCAGAAGATGCCCGGCAACCGAC
TCCGCATCCAACAACTCACGCTGATCATCAGAGCGACCCTGCACCCAACAATCATCCCCA
>paratb_3358
GCACGGGCTGGTGCAGGCCGCCGCCGGGGTAGACGGATCCAACGTCGGCCGCGACGAGCTGGCGCTGCTG
CCGCTGGACCCCGACGCCAGCGCCGCGGCGCTGCGCGCGCGGCTGCGCGAGCTACTGGGCGTCGAGGTCG
CCGTGCTGGTCACCGACACCATGGGCCGCGCCTGGCGCAACGGCCAGACCGACGCCGCGG
>Contig16_3614
CCCCGTTGGGGATCAGGCGGGTGACCGCGACGCAGCGCTGCCAGGTGCCGTCGGGCTGGACGGGGCCGTC
ACACTTGCTCAGCACGGGCCCGCCGTACTGGCAGCCGGCCCGGGCCGGCGGGGCCGCGGCGATCACCCCG
GCGGCCAGCAGCAGGGCGGCCGCCGCTGCGACGGTGCCGTGCCTCATGGTTGCCTCCCGT
>Contig16_3681
AAGTCGACGAGGCGTTGTCGGCCAAGGCCGAAGACGAGCTGGCCGAGGAGCGCGACGACGAGGAGACCGA
CGAGGCGGACGAGGCCGCCGAGGCGCCGGCCGACGCGACCGAGCCGGACGAGGAGGCCCTCGAGGCCGAC
GAGGCCGACGGCGAACCGGACGACGACGCCGACGAAACCGAGACCCGCGCGGCCGGCGAC
>Contig16_3695
CAACTTCATGTCCAGCCACACTATGCGTCAAACGGGCCGGTTGCATCGACCGCCGCCCGTACCCGCGGTG
CCGATGACACCGGCGGTCGCAGACGACGCGACCTGGTCTAGGCGGGCCAAGACGTCGACCTACAGGCGCG
GCATGTCGACGTCCGTCCTAATTTTCGCGTTCACGTCGCGGGTGTGAGTGCAGGCGGCGG
>paratb_3696
TCGAGGCGTGGGCCCCTCATTGAGCGGGGTGGCGAAGCGGATCGTCTAGCGTCCACGAAAGTAAGCCACT
TTGTTACGCCAGGAGTACGAGGCGGCCACCGCATAGCCGACTACCTCGCACCGCACGAGAAGCCATTGCA
GCCAAGGGATTCCGATGATGAAAACCACGCAGCACGCGCCAGTGATACCGAGCGCTACGA
>paratb_3697
GATAGGCCGTGGCGGCATGCCTCGAGCGTGGGTGCTGCCTCAGGATCAACAGGATTCGACCGGTAGAGAC
AATGATGTACGCAAGAGCCGCGATCATTACGAACCAGTAGACGCGGAGCCAGGGCGTGTGTTCTGTGGCC
ACAACATCGGGAACACAGGTCTCGCCGATGTCGCCTGCGACGAAGACCGCGATCATGACG
>paratb_3698
GCGCAGATCACGACCGACGGCAGTTCCAACCGGTTCCGAACGAACCACCTGAGCTGACCCGGCGTCATGT
CGCAGTGGTCAGCGACCAGATACATGATCGAGAACAAGCCGTACACGTAGAGCAGATGGCCGATGAGGTC
TTCGAGGTTCCACACGCCCGTCATGTCGTGGAGCAATGGGCTCAGCCACCCGTCCACCGG
>paratb_3699
CCCGAGCGCCAGGACCAACTGGGCACACATAAACGCCAGTGCCAACACTGCTGCTCGCTCGAACGGGATG
TGCCAGGCCAAACGGATGCTCCACAAGGCAGCTAGCGCAATGACCAACGTGGCTGTGGCGATGATGCTCA
CAGAGGTCGATCGGGTCGAGGTCTCAAGTCACTCAGGCGGAAGGGCCGCTCATCGTCGTC
>paratb_3700
TCCGGCGAGCAGCTTGTCCAGCGGAACATCGACCGCCTGGGCGATCGTAAGTAGCTCACTGTAGGTGAAC
TCGACCTTGCCATCGAGCTTGCTAGAAAGGCTCGGGCGGCTGATACCTGTCTCGTGAGAAAGACGGGTAC
GGGACAGCTTGCGGTCGCCCATGATCATCCGCAATCGGCTGGCCAGGGCGGCGGCCGACA
>paratb_3701
CAGGCGAATGCGAAGACATGCCCGGCAGGGTAGCAGTCTGAACCGACAAAGCGCGGGCAAAACCGATCAA
TTCGTCGGTTTTCCCGCCAAACCGGAGGATTTCGTGCAATAGTCTCCGCCGTGGCTGAATTGGACATGCA
TACAACACCGCGATCCGGGACACCGCAGCAGAAGTCGGTGGCCGCGGGCGGGGCGCCCAC
>paratb_3702
TCGTCGGCCCCGGTGTGCAAACGTCGTCCTGGTCTGGCATTCGCCGGCTGGGTCGGCGTTGACGACGGCG
CAAGGACGGTCGAGCGATGATCCATGACGCGGTCACCTAAGGAGGCCGCCCTGTTCACGTTTCTGTTGAC
CCCCGCGTTCGTCGGGGCAAGCGCCCTGATCGCGGTCGTGACCCTGGTCGTGTTGGTAGC
>paratb_3703
```

Figure 6-12

```
CCTGCTGCTGAACGAGCACAACGGCGACGACAAGGACGTTGACATGGAAGACACCTGGTGGTGACAGGGA
GCATAACCACGCCGAAGCGAATCGCGTTTGCCCGCACGGCAATTGGAGCGATGCTTACGGACCCGAGAGT
GGCGGATTAGGCGGATGACGGTGAGCTTCAGCGACGGCATGGACTCGCTGCGCCAGTACG
>paratb_3704
CCCAGTTCTACGACTATCACTAGGGACGAAGCCATCGACATCATCGAGAAGGCAGAGCTTCAGCTAGAGC
AGCTGCGCACGTACGACGCTTCGCCGCTCACCGAAATTGTGCGCGAGCTGATCGCAGAGCTGCGGCGGGC
CCGCGCCGAGGTAGCGCGGCTGCGGCACGTCGGCGTGGAGACAGCCCTAAAGCTGGGCAT
>paratb_3705
CGTCAAACGCGAACTGACGCTCAAGCGGTCCGAATGCGAGCGATTGAGGAGACAGCATGATCACGGAGAC
GTACCACCCCACGGTGACGGTTAGCGGAGCAGCCGAAGACCGCGCACGGCCGCTCAGCCGATCAGCACCG
CGTACCGGGGTTTGATCACCTCGTCGATAATGGCCAGCCGCTCGTCGAACGGGATGAAGG
>Contig16_3852
GGCCGCCACCAAGGCATGGCCGGACGCCCGCCCCGCACCGAGTCGATGGGCATCCCGGTGGCCGCCCACC
CGCCCGCACCCGCGGCCTGGTCGGCCCAACTGGCGCCGCCGGTCGCCGCCCCGCCCCGCCGGCCGGGCG
CACCCCCAACTGGGCCGCGCCACCGCGCCGCCCGCAGCCCGCGCCGCGCCCCGGCCCGCC
>paratb_3876
GTTGCGGCGCTGACGCGCTAGGAGCCTGCTGAATTAGGGGATTTTTTGGGGCGGGGCGTCTCGAACCGTC
TAGCGGCGTGTTGTAGTCAGACCCTGTGGGTCGACAGAAAAGAGATCGCCCCGCCGTTGTTGAGCGTGGC
AGCGGTCGGCGGCTGAGGCAAGGCCTTGGTGTGAGGGCGTGTTAGGCGATGGCCCAGGTG
>paratb_3877
GTGTCGGTGCGGGTCAGGCCCATGGTGAGCAGCCGACGTAGGTTCAGTGCTGCGGCGCGGTGGTGCAGCC
AATGGTTGTTTTTGGCGGTTCCTCGGTAGCGGACCTTGCGGTTGCCGCGAGTGAGCCAGGCCATTGAGCG
TTCCACCATGGGCCGGTGTTGGCGGTATTCGGCTTGCCAATCGGGGTCGCGGGCCGCGAC
>paratb_3878
GCGAGCAGCGCGCAATAATTGCTCGTGGATATGAAGGGTGAGTTTGCGTCCGCGCGTGGCGGTCGTGCAC
CGGGACGCCAACGGGCATGAGCGACAGTATCTTTCGAAGGTGACTCCGCCACTGGGACGGATCGGCATTC
CGTGTCCAGCCGGGCAGGTCACGATGCGGGCGTCGAAATCGATGAGGAAATCGTCGCTGG
>paratb_3880
GCAATCGGTGATGATTCCGGTGTCGGGCTCGACGGCAAGGTGGGCTTTGAAGCCGTCCTGGCGGCGGTGC
ACCGTCTTGTGAGCGTGCCGCGTGTCGGCATCGACGGTGGAGATCACGCGATCCCCACTGACCTGCTGCG
CGATGCGCCAGTGCCCGTCGGTGCCATCAGAGCCCTCGACCGGTTCAACGTCTTGACCGG
>paratb_3881
CGATCAACGCCAACAACGCCACCGCCTCAGCAGCCCGCGGCGCGAGTTCCTGGTCAGGCAGATAGCCCAG
CACCCGGTGAGCATCACCGACCAAACCATCCACCAGCCGATCCCGAGCGGCCTTATCCTCCCACGCAATC
GCGGGTTTCCCCGGATCGTCGTAATCATGGGCGCTGCAGTGGGCTTCGATCACCGCTGCA
>paratb_3882
GCGCCAGGGACTTCGCGGCGCACTCGTCGGATCGCGGCGATCAACTGCGTCACGGTGTCCTGCGTGGCCA
CCGCATCGTCGAGCACCGTGGAATCCAAGGCCCGCCGTGTCTTGCCCGCCAACACCCCGGTCTCGGCCAC
CACCGTCTTGACCGCCTCAAAGATCCGGTTGGGCCGATCCGAAGCCGCCAACCGACGCCG
>paratb_3883
CCAATACGTCAACGTCGTCGAATGAAACGCGCCCGCCGTGATCGGCAACCCGCACGCTGCTTTCCAGCGC
AGATCGAAAGTCACCGCATCCACGGTCTCGTTATCCGAAAAACCGTGCAGGGCCTGCAAGGTGATCACCG
AGGCCATCACCTCAGCCGGCACGCTGGGCCGGCCCCGCTGCGACGGGAACAAGTCCGCGA
>paratb_3884
ACATCTCCTCGGGAAACAACTGGCTGCGGTGCGCCGCCAGGAACGCAAACATGCTGTCGGCCTTCAGAAG
ATGCCCGGCAACCGACTCCGCATCCAACAACTCACGCTGATCATCAGAGCGACCCTGCACCCAACAATCA
TCCCCAAAACCCCAGGACAACTCGTCCCGCCACGCGGAATTAATTCAGCAGGCTCCTAGC
```

Figure 6-13

>Contig16_4008
CGTCATCAAATTCACCGAGGCCTGCTACCGGGAAAACGCCCTCCAGCCCGACCCGCGGTTCGCCGCGGCC
GTACAGACCGCACAGCGGCGGATCGCGCCGCGCGCCCTCGGCGGCGGCGCGGCGACCATCCCGTCCGGCT
GACGGCAGCCCGAGCCCATTTCCGGCGGGGCGGCTACTCCCACTCGATGGTGCCGGGCGG
>Contig16_4412
CGTCGTGGGAGTTCCACCGCGCCAACGTCGACCCGCGGCGGGCGCAGACGGTGGTGACCTGTGCGCGGCG
CGCCGCCTCGCTGGAACGGCTGGTGTCGCGGCCGGCCGCGCAGGCGCGCGCGGCGTTGACGTCGCTGCCG
GGGGTGGGGGAGTGGACTGCCGCCGAGACGGCGCAACGGGCCTTCGGCGACGCCGACGCC
>Contig16_4769
GCGCTGGCCGACCCGGACCCGGCTCCCGCCGATCCGGGCGCGGTGGCAGCCCCGCCCGGCCCGCCGGCTC
CGCCGGATCCGTTGGCGCGGCCGCCCCCGCCCGACCCGTTGGCACCACCGCCGCCGACCGCCCCGCCGGC
GCCGTGGCTGCCCCCCGCCGCGCAACCGGCCGCCGCCCCGGCCGCCGGACAGGACCCCAC
>Contig16_4824
TCTGGGCCTCGGTCGGCTGGTTGGGCCGGGCCGGGATGCGGGTGGTGCTCGCGGCCGGTTCCTGCGCGGG
CCGAGGCTCCGCGGGAGCGGGGCGCGCCGCCCGCGACGGCTCCGGCGCCGCGGGGTGGGTGGGGTCGTGC
GGCGGGCGCGGCGCCGCGGCGACCAGGCTGGCCGCCACCGGCGGACGGGCGGGCCGGCCG
>Contig16_4976
TCGGCGCGTGGCGCGAACGCTTCCACGCCGAGCCGGTTGGCCGGCGTGTGCGACGGCAACGCCGCACCCG
TGACCGCGGCGACCAGCCAGGGCAGCGCCGCCGCCGCCGCGGCGCCGATCGCCGCCGCGGCGCACACCCA
ACGCCGCCGGCCCGCACCGGCCACCGGCACGCAGGCCAGCGCCACCGCCGCCGCCAGCAG
>paratb_5008
GCCAGGCGCTACCGCGAGCTGGGCGAGGCCGGAATGGCCGACCGCAGCTCACGACCGCATCACAGCCCCA
ACCGCACGCCCACGCGCACCGAGCGGCGCATCATCAAAGTCCGGGTGATCCGCCGGTGGGGACCAGCGCG
CATCGGGTATCTGCTGGGGATACATCCCTCGACGGTCCATCGGGTATTGACCCGCTACGC
>Contig16_5010
ACCGCAACCCAATACGGGGATATCACTATCTCCACACCGCCATCGATGGATATTCCCGGCTGGCCTACAG
CGAGGTACTCGACGATGAGATCAAAGAAACCGCCGCCGAGTTCTGGACACGCGCTAATGCCTGGTTCGCC
GAATGTGGGATCAGCGTGCGGAAAGTGTTGACCGACAACGGGTCCTGCTACCGATCGCGC
>Contig16_5012
ACTTGGCGGCCAACCACCCGCCAGCCGCGTACCTAACCTCTCAGGTCAGTACACCTAACGCTCTCGGCGC
GCGCACGCCCCTTCGCGAGCGCCTGCCCTTCGCGAGCGCCTACCCCTCGGCGAGCGTCTGCCCCTCAGCG
AGCGCCTCTCTCGGCGAGCGCCTGCCCCTCGGCGAGCGCCTGCCCCTCGGCGAGCGTCAC
>paratb_5103
GCCCAGCGCATACCGCAGACCCAGCGCGGCGCCCAGCACCGCCACCCCGGCCGCCCCGGCGATCACCGCC
CCGGCGGCCAGCGCCGGGACCGCCGCCCACACCCCGGGCCGCCACGGCCGCGCGGGCGGGTCGTGGGTCC
CCCGTTTCCGGGTGCGCCAGCACGCCAGCAGCGCCAGCACCGGCAGCAGCGCCAGCCCGA
>paratb_5119
CGGTGCCGCGCAACATCTCCACCAGCGACGACCATTGCGTCGTCACACCCGAGGATTCGATGAAGTCCAG
GAACGGCGGGCTGATGGCGCGCAGCATCACCAGGCCCACCACCCACCACAGCGTGGCCAGCACCAGCGCC
ACCAGCCACCACCCGGTGTAGCGCCACCACAACCGGTTCGGGCGGTGGCACGCCCACCAG
>Contig16_5186
TCCAGCTCGGCGATGTCGAACAGTTCCAGCAGATCGGGCCGCATCGGCGTCTGCTCTTTCTTCGTGATGG
TGATGTCGGGGATCACCGCGGCTTCAACGTCGCCTGGCTCGGCGACTGCCTCGCAGACCAGCAACAGCTT
GCGCCACGACGAGTCCATCGACGGGTGGTCGTCGCGGGTGTGCCCGCCCCGGCTCTCGGT
>paratb_5188
ACTGCTGCAGCTCGAGCTGCAGGGTGTAGGGGTTCTCGCCGGGGCCGCCGCCCGCCGGCGCCTCGAAGGG
GGACAGGGCCCGCTTCGCCGCCGCCTCGACGGCGCTCTCGCCGATCGTCGGACGGCTGCTCAGCGCGCGC
ACGTAGTCGGCGGCGCCCAGCCCGGCCCGGCGGCCGAACACCAGCAGGTCCGACAGCGAG
>Contig16_5306

Figure 6-14

```
GCCGGCGCCGGCGCGACCGGCCGTAGGCGACGGCAGCCCGACGAATTCGCGGATGACTCCGGCACCGGTA
CGACGAGTCAATTCAGCGGTCCCCCTCAGTGGCGTAGATGGCCCGGTAATAGATGTTGGCCAGGGTTTGG
ATGCAGGCCTCGTCGTCGGGTTCCCCGCAACGTGCCGAACCGAGCTGGACGTAGCAGAAC

>Contig16_5316
GTGCGGGTTTGGCCCGCGCACCGGCTCGAGGGCCGGACAACTGTATCCCGAGTTGCGGGCGTAGCGGGCC
GAATCGGCGATAAGTCGTCGCGAATCGACCCCGCCCGGCGTGGCCAGGGCCGTTGAGGGGGAAAAGATTA
CTGCACCGCCGGCGATCTCGCGGCGGAATTCGAGTCTTGACAAAACCGCGAAATATTCGC
>paratb_5317
CTGCGTCAGCTAGCGTCCACAGCAGCGACATAGGGGTATGACCGGCGGGGTAGTTCACCAACACAGGCGA
AAGTCCGTCGGACAATTTCAAGCGCGACACACATCGACGATCCTCGAAAAGCCAAGCGCCAACCGCACTT
CCAGCACCCCAGACCGCCCCGCAAACGTCGTCGTCTCACAGCACAAGGACTCGAGGAAA
>Contig16_5326
GAGTTCCACCGCCACCTCGGGCGGGGGCGGCTGTCACGGCGAGTCGAGCGCTCCGCCTTGCCGTTTGGCC
GTCATCGCTGGGTGGCGGCCGCCGAGTGCTCCCCCTTGGAGATCGTCGCGCCGCCGCGGGAGCGCGAGGA
CATCGACGCGTGGCTCGACGAGCAGACCCACAAGCGGCCGGACGCCGAGCGCGGGCCCGG
>Contig16_5328
ACGACGCGCTCGATGTCGGCCGCGCCGTCGGTGCCGCGGCCCGGATGCTCCGGCAGGGCCGCGACGGCAC
CGCGTCCGTCGCCCCGCCACGCGGGAAGCGGCCCGCGCCGCCGGCCGCGCCCGACGACCGCATTGCCCTG
CCGATGGAGACGATCTTCGTCAGCGCCGACGACTGGGACGCGCGCGCAACCGCCTTGGGC
>Contig16_5340
TATCTGCCGCGGTTCATCCGGCAGTTCCCGTTCAACGTCTTGCTGCACGACCTGGACCGCCGGATCAAGA
AGGGGCGGCCGCTGGTGTAGCGGCCCGGCGAGCGCGGAAGCCCATGAACTGCGGGCTGTATTTCTTTATG
GCCGATCCTGGAAACATGCATCGTGAATGTAGCCCCGCAGGGGTAGGGACCTGGCGCTTC
>paratb_5341
CTTGCGTCGCCTTCTCCCTGGCCGGGTGATCGCGCCGTCGGGGTAGTGGCCCGCTACGGTCGTCTCGGTC
TGTTGCTCCTCGATGAGCTTGGCTACGTCCAAACCGACTCTCGCGGAGCAGAATTGCTGTTCCCGATCAT
CACCGAACGCGAAGAATGAGCCAGCATCGGGCTGGCGAGCAAGCTTCCGTTTAGTCACTG
>paratb_5342
GGGAGAGACCTTTTCCGACGACGTTGTTGCGGCGGCCATGGTCGACCGCTTGGTACACCACGCGGAGGTG
CTCACTCTCACCCGCAGACTCCTACCGTACCCATCAGCGCCGACGACTGCTCACAAAAGAAAATCGCGCC
GCCAACGATCAACACCCATATCCCGCTTGGGATTTCGAGCAATCGGTGGGCGGGTGAAC
>paratb_5343
TCCATTCGACTCCGTTGTCGAGACCTCGACGCACCTGCTGGGAGGCAGGCACGACGCTGAGTGCCCACCT
CCCGAGTCTCGCTTTACCTTTGGCGGTTGGATTGAGGTCTGGGGTGTCATCGGCGCTTTTTGCTGGCTCT
GCGCCCAGATAGCCCGTCAACGGTCACAGCTTGCCCTGAATGATCCATCGCCAGACGGTG
>paratb_5344
ACGAGCCTGCCTCTCAGTAGTGCCACTGGTTAGTGGAAACCCAAGCTTGCCCACGCCTTGGTCGTATCGA
TGCCGCCGCGAAGCGGAGACTTCAGATGATTCACCGTAATTGCGGAGCTAATTCACAGTTGAGAACGTAT
TTGCGGTAAGAATAGCCGCGTATCCTACGTGCATGCGGTCGACCTATTACCTGCAGCTCG
>Contig16_5345
GCACCTGCGGAGTGTGGGGGTGGAGGCACCGACCGCGTGGTGAACCTGCGCGAATGCCAGTGCGGTCCCG
TTGATTACCACGATAGTGCGACCGGCCGATTCGGTGTCGCTGCGTGACGGTGCTGCTAGGGCGGCCTGTC
TGACTTCTGGATCAAGACGATGACTGCCCCGATCTGGATGGCGTTTCCGCCGGAAGTCCA
>Contig16_5346
TTCGGCGTTGTTGAGCAGTGGGCCAGGGCCCGGCCCACTGCTGGCCTCTGCGGGTGCGTGGAATTCCTTG
GCTGCTGAGTACACCTCGGCGGCTGAGGAACTCACGGCGGTGGTGGAAGGCGTGCAGGCTGGGGCGTGGC
AGGGCCCCAGCGCAGAATCGTATGTGGCCGCCCACGCGCCCTACCTAGCGTGGCTGACAC
>Contig16_5348
```

Figure 6-15

```
GTCCAGGCGGCCACCACCATGACGACGTATCAGGCGGTGTCGACCGCGGCTGTGGCCGCAACTCCTCAGA
CCATGCCTGCGCCGCAGATCGCAAAGTCCACCGCCGCCACCATTCCTTTCCAGCGGCCCTACCCCAACCC
CACCAACTTCAGCCAGGTCTGGGCGGATCTGTGGTATGACATCCCGTATTCGATCGAGAC
>paratb_5349
CTTCCAGGGCCCAGTCGATCCCGCCAACTGGACGCAATTGTTCCAGTTCTGGAATGTAACGTTTGCCAAC
CTGGCCGGGACCCCTGCCAAGCTGGCTCAGATCTTTTCGAATCCGTCGGTGTTGTTCAGCTGGCCCACGC
TGCTGTGGGTGTTGGATTTCATCGCCGGCCGCATCTTCGACATCCTGGTCACCCTCAAAT
>paratb_5350
TTCTTCTTGAGCAGCCGTTGCTGTACGTGGTGGGGCTCGGCATGGCGGTCACCAGCTTGGGTGCGGCCGC
GGGCGCGGCGGGTGGGTTGGTCGGGCTCGCCGGCCTGGCGAGCCCGGGCCCGCTGCCCACCGGGGCCGAG
ATGGTCCCGGTGACCGCACCACCACCCGGCGCTACGCCGGCGCCAACCGCGCCGCTGATT
>Contig16_5351
GGCGGTCCGGCCTCGGCGCCGGCCACGATTCCCGTCAGCTCGGCCGCTGCTGCCCCACCGCGCCAGCGC
CGGCACCCGCCGTCGCGGCCGCCGGCTCGGCTGCGCCGCCGCCGGCGGGCCCGGGCGGCTTTCCCTACCT
GGTGGGCGGCATGAGGGTGAGTTCGGCGGCCAGCGCATCAGCCCAAAGCCGCAAACCGAA
>paratb_5352
ATCCGCTGCCGCCGCCGCGGCTCGGGCCGCCGCTGCCGCCGCGGCTGAAACACACCATGCCCGCCGCCGC
CTGAGGGTGAAGGCGAAAATGCTCGGTCGTGGTTATGAATATATGGATCTCGAGGACGACCACCTGAGCT
CGAGCGCCGCGTCGGAGCATGGTGCGGGCCGCTGGGGTTTACTGGGACGATGCGAGAAT
>paratb_5353
CCGGTGCTGCGACCCCGGCGGGTTTGACCGCGCTGGGCGGCGGCTCGTTCGGTGGCGGCTCGAAGATGCC
GATGCTGCCGACCAGCTGGGTCACCAACGGATCAGGCGAGGCCTAGCGGTTGACGCTGATCAAGCGGTGT
GTCCGCGGGAATGGTTGGCGCACAACGCTGCTGATGCTGTTGCTGCTGACCGCGGTGGCC
>paratb_5354
GCATCGCTGATGGTGGGGCGCTACCCGGTGGGGGTGGGCGCGATGGCCGGGATGCTGTTTGGTCGTCTTC
CTCTGCTGGACACTAGCTTTACTCCGGTGGATCAGACGGTGCTGACCCAGATCCGGTTACCGCGCATCGG
CTGCGGGGTCTTAGTCGGTGCGGGGCTGGCGGCCTCGGGTGCGGGCTATCAGACGATGTT
>paratb_5355
CCGCAATCCGCTGGTGTCCCCGGACATTCTGGGGGTGTCGGCGGGCGCAGGCTTCGGCGGAGCGCTGGCA
CTGTTACTGCATGCGCCGTACTGGCAGCTAGAAGCGATGGCGTTCGCCAGCGGATTGCTGGCCGCGGCGT
TGGCACTGATCATCGGGCGCGGCATCGGCCGCGATTCGGCGATACTGCTGGTACTGGCCG
>paratb_5356
GGATGGTGATCGCCAGCGTGTTCGGCGCGTTGATCTCGGTGACCGAATACCTGGCCAACCCCGATGACAC
CCTGCCGGCGATCGTGTTCTGGCTGATGGGTGGGCTGGGACGCCAACACCTCGACGGGTTGTTGGCCCCG
GCGCTGATCATCGCCGCCGCGGTCCTGGTGCTCTACGCGTTGCGATGGCCGGTGACGGTG
>paratb_5357
GTGGTATCCGGGGATGAAGACGCACACACCCTCGGCGTCGACACCCGACGCACCTGGGCTGCGGTGGTAG
GCGTCTATACGTTGATCACCGCAACCACAGTGAGCCTGGCCGGCATCGTGGGCTGGGCAGGCCTGTTGAT
TCCACATATCGCTCGAGCGTTGGTCGGCCCGGGATTCGGTCGGCTGCTGCTGGTGTCGGC
>Contig16_5358
GGCGCTGGGCGGGGTTTTCGTGGTCGGCGTGGACGACGTGGCACGCGCGGCGGCCAGCGCCGAGATCCCG
CTAGGCATCCTCAGCGCTCTCATCGGGGCGCCGTTCTTCCTGGTGGTGTTGGCCAAGATGCGCCGGCAAT
GGACGTGAGCAGCGCGGCGATCGCCGCCGAACAGCTGTCATTCGGCTACCCCGGCGACGG
>Contig16_5360
CGCAACGCAGCAACACCCCGTTCCCGTTTTCCACCCTGGACATCGCGGTCACCGGCCGCACCCCGTATCT
GCGCGCGATGACGTCCCCGTCGGCGACGGACCGCCGGGCGGCCGCCGCGGTGCTCGACCGGCTGGGGATC
GGCGCGCTGGCCGATCGACCGTATGCGGTGCTTTCCGGCGGGGAACGGCGGCTGGCGTTG
>paratb_5361
```

Figure 6-16

```
CTCTCGCGCGCGATGGTGCAGGACGCGCCGGTGCTGATCCTCGACGAACCCATGGCAGCACTGGATTTCG
GCAACGAGAGCCGCATCCTGCAGGTGGTGGCCGAGCTGGCCGCCGCCGGCCGCGCCGTGCTGATGACCAC
TCATCAGCCCTGGCATGCGCTACACAGCGGCGATCAGGCAGTGCTGATCGCCGACGGCCG
>paratb_5362
CCTCATCGCCGACGGCCCCGTCGAGCAAGTCGTCACCGCGGCCGCCCTCAGCGAGCTGTATGGGGTGCCG
GTGCGGGTGCTGACCGCTACCGACGACGCCACCGGGCGCCCGGTCTACGCCTGCGCGCCGGTGGCCGCGG
GGGATGACCGATGATCCGGGCGGTGCTGGCCGCCGTCTGCGTCGCCACCTCGGCGGCCGG
>paratb_5363
CTGCGGCGCCGCACACCATTCCCCGGCGGAGCCGACGCGCACCGTGGTGGATATGACCGGACAACACGTG
CAGATCCCCGGCCACCGTAACCCGGGTGGCCACCAACATCCCGCTGATCCCGGCCACCATCGAACTGCTGG
GCGGGATCGACACCGTCGTTGCGGCGGCCCGCGGCTCGTTCAACGCTCTGTTCACCACCA
>Contig16_5364
TCGCGCCGGCAACCCAACAGATTCCGCGGTCCCCGCCTACCAGCCTCAACGCCGAGCAGCTGCTCGACCT
GCACCCGCAGGTCTTTTTCATGACCGACCTGACCCCAGGCCTGCTGCCGATGCTGCAGCGGCTGCAGATC
CCGGTCGTGCAGATCACCGCCTTCACCAGCCCGCAGGATCTGCAGAAGGCGGTGAACCTG
>paratb_5365
GTGGCCCAGGTGCTCGGCGGGGCGGCACCCGCGCGGGCCCGGCAATATGACACCTATTTCGACGCCGTGA
TCCAGCAGGTGCACGCCGGCGCCCAAACCGACCGGCCCACCGTGTATTACGCCCCCGGACCGGACCCCAC
CACCACCGTGGGTGCCGACAACATCATCACCGCATCCATCGAGGCCGCCGGCGGCCGCAA
>paratb_5366
TATCGCCGTCGAACACGGCATCGGCGGGCATCAGCCGGGTGCATTCGCGTTCCCGACCATCACGGCCGAA
ACCTTGCTGGCCTGGAACCCCGACGTAATAGTTGCGAGCAACGCCCGAGTCGCCGACCAGCTTGCGACCG
ACCCCACGTTCGCCACCCTGAACGCCGTCCGCGATCACCACATCTACACCTGCCCGGTGG
>paratb_5367
GGATCTTCCCGTGGTGCGCCTCGAGCAGCGAGGCCGCGCTTGCGCCGCTGTTCCTCGCCAAAAAGCTGGA
CCCCGAACGCTTCTCGGATCTAAACCTCGCCAACAAGGTGGCCAACTTCTACATCCAGTTCTACGGCTAC
AGCCTCACCGGACCGCAAGTGACCGCGATCCTGGACGGGGCGGGCTAATGCCGTTGAGCC
>paratb_5368
TGCGCCCTGCCGCGGCGTTATTCGGCGCCGAGATCGGCGGGATCGATCTGCGGGCGCCCCTGACCCGCGA
GCAGCGCGATGAACTCCAGCGACTGCTACAACGCTACCGGGTGTTGTTCTTTCGCGGGCAGCAGCTTTCC
ACCGCGCACCAGATCGAGTTCGCTGAAGCTTTCGGCCCGATCCTGATCTTCCGCAGCGTC
>paratb_5369
GTCCCCGCCGACCCCCAGCATCCCGGAGTGCACAACGTGGACGGCAGCACCGTGGGCTGGCACCTGGACG
CCAGCGGTCTCATCGAACCCCCGGTGGCCAGCGTGCTGCGGGCGGTCGAGATCCCCGACCGCGGCGGTGA
CACAGTCTGGGCTGACGGCATGGCCGCCTACGACGGGATGCCCGATGATCTCAAGTCCCG
>paratb_5370
GCTGGAAGGTTTGTCAGCGACCCACACCGCACCGAACCAGCATCCGCTGGTCGCGCACCCGCTGGTGTCC
CACCACCCCGACATCGGCCGGCGCTACCTGAACATCAACCTGGCGCCGTGGGTGGACACCCGGATCCTAG
GGATGAGCACCAGCCATAGCAGCGCCCTCGTCGAGCAGCTGCGGGCGCACCACCTGCGAT
>paratb_5371
CGGACTACCAACTTCGATTCCGGTGGAGCGCCGGGGCGGTCGTGTTGTGGGACAACCGGGGTATGCAGCA
CACCGGGATCCGCGACTACGGCGACGACACACGCCGTCGGCTGCAGCGCATCTGTATCGCCCACTTCACC
GAAGGCGTTACTGGCCGTGCATAACGGCCGCGCCAGTAATCACACACCAGCAACCGCCCA
>paratb_5372
AGCAACAAAGCGCCGAACCATCTACCTAGATCGAATCATCAAGCTCGGTCCGCCTAGGACAAATCGTTAG
ACACAGCCCAACTGGGTAGCCGGCGCGCAGGAAACCCACGATCTTGGCGATAACCTCGGAAACAGGCATC
GGGACCCCTCGCGCACTGCAGCTGTCGGCACCTTGACGCACCGGCTTGGTGATTAGCCAA
>paratb_5390
```

Figure 6-17

```
TACTCCGAGCAGTCCGCCGATCAGCCCGAATACCACCGTGGACAGGTCGAATGCGATTAGCACGGCTGGC
GACAACAACCGTTCCATCTCTTCGAGGTAGCGCGGACCCATCTGTGCCATGCCGGGACTGGAGAAATATT
CATCGCGAGCGTAGAAGATGGGCAGCAGCGGCCCGATGTACCACGCCGCGTAGATTGCGT
>paratb_5391
ACGCCAGTACACCCATGGTGCGGGAGCGATAGCGTCCCAGCCACAGGACGACTTCGGCCACCAACGCGCA
CGCAACTGTGATCACGAAGCAGATCGGGGGGTGCCCGGTCAGTGCGAGCAGTCCGGCCGTGATAATCGCA
AACACCGTCACCATGCCCGCATGTCGCACCCGGGTGAGGAACAACATGAACGGCACGCCG
>paratb_5417
GCCTGGGAGAACTTCGTCATGAACCTCATGGATCAACTGTTCGGTGTCGATAGCCCACCCGACCTCGCTT
CGGCGGTGGCGGCATTCTTGGCGAATCCGTCCCCGGCACTCTTTAGCGCGCTCCTGTTTGCGCTGGCCTA
CGAAATCGCCTTTGACACGCTGTTCTTCTCGCCCGTGGCATTGTTGGCCGCTCCGTTCCT
>Contig16_5418
GCCGTTTGTCGGTCTGGCCGGCCTGGCGGGTCTGGCAGGGTTGGCTGGGCTGGCCCCTGCGCCCGAGCCG
GTTCCAGCAACCGTCGCGGACGTGCCGGCCCCGACGTCCCCTCCGAACCAGGCCCTACCGGTCGCGGGGA
TCCCATCGGCGTCCACGCCGGCATCTGCTCCTGCATCCGCGCCCGCGACGAGCGCGACGG
>paratb_5419
CACCGGCATCCGCGCCGGCGCCGGCCCCCGCATCGGCCGGTTCACCCGTGTTCGGCTACCTGGTCGGCGG
CGGTGGCGGTGGGGAATCCGGGCCCACGCTGACTGGCCGCTCCAACGCAACAGCACCCGCGGGTCTTGCC
GCGGCCTCAGCGGCCGCAGCGAAAGCGCCGACACGTGACCAGACGCGGTCGCGACGGCGC
>paratb_5420
CGCCGAACCGTAATGCGGGACCACGGCGATGAATTTATGGATCTGGACATGGGCGCGCCGGTCGACTCCC
CGCCCGGCGGAACATTTGTGTCGGGGCAAGGTGCGGGTTCCCTGGGATTCGCCGGAACGGTAGCGAACGC
GGCCGGTGCACGGGCAGCGGGTTTGGCAACGCTGGATGCCGATGGCTTCGGCTCGAGTCC
>paratb_5421
CAAAGCGCCGATGCTGCCGGGTAGTTGGCATGGCGACGCGACCCAGGAATCGCAGGGAAGCGGTGACGAC
GAGCACCCGACCGAGGGCAACGCTGGAACCGAGTAATCGTCCAGATCTGGTCGGCATCCTCTCGTCAGCG
TCGAGCCCAGAACTCGATTATCTCGCGCTCATCGTGTCTCGCGCTCACCGTGGGTGCAGC
>paratb_5422
ACACCGATGATCGGGTGTAGCTGCTCAAAGGTCATGTCGTGTGCTTCGGCCTCGTGGGCGAGTTCGGCGA
GGCCCACGGTGTGCCACGTGTGTTCGGCGGTGAATTCTCTGGTGACCTTGTCGCCTTCGCTCACCACATA
GCGCATCGTCCAGTGTTCCGCGTCGCTGCCGGCGGGCTGGCCCGATATGCGAACTTCATT
>paratb_5423
GTGCCGCACACCAATGCGCTGTTGGGCAATGGTCATCTCGGGCACCGGCATGGGCTGGTCGAGGGCCATG
ACTTCGACGATCACCGGTGCGCGGGGGGTGAGACGTGGGCGTAGCGCTGCCCAAAAGTGTTGGCGGGCTT
GCTTGTCCATATACCCGATGACGCCAAACAACACCACGGCCCCAAGACGCTCGGGAAGGT
>paratb_5424
CGAGTTCTTCGAGATTGACCGGGTGCACGGTGACCCGGTCAATCAAATCAGGCCGGCTGAGGATCCTGGA
GACGAGCGCGGCGCGCATCGCCGCTGACGGCTCGACCGCGTGGATGGGGACGTCTGCGATGGTGTCAGCA
ACGGTCACTGTCGAGAGCCCCGTACCTGCCCCGATATCAAGCACGTGATCTTTCACCGGT
>paratb_5425
CCACGTGCGGTCAACGCGGATACCAGCACTTGGCGCTTCATATCCCAATGTGGGATCGCCATCACCTCGT
AGAACTCCGCCGACAGGGCGTACGGATCGGCGCCAGGTGTCACGCTCATTCGGTCACCGACTCCGGGCTT
TCAGCGGCCACACGTGGACGATGTGTGATGAGCGCGCCCGACAACCCCGCCGCGACCAGG
>paratb_5426
GCGGCGCATCCTGCAATTCCGAAGATCAGGCGAAGCGCATCGGTGAACGCAGAGGTCGCGAACGCGGTCA
TTGCCTGGGTGGGAAACCTCAACACCCCCGCAACGATGGCGGACGCTACGGAATCTGCACTGTGCACCGG
GATAACCCCTGAAGCAGCGACTTTCGCATGCACGAACGATGACAACACGACACCAAAGGC
>paratb_5427
```

Figure 6-18

```
GGCCACGCCTGTCGCTGTCCCCAGTGGAAACGCGGTGTTTGCGGCACCGGTCGCCATGCCGGCCTTGTTG
GAGGGCACGACATCGACCGCAAGGTTCATCAGGTGGGGCATCGCGACGCCGTTACCAACCCCTAGCACGG
CAAGAGCCGGCAGGATCGTCGTCCACGACCCGTCTCCCCTGATCAGCGTGGCAAGGAAAA
>paratb_5428
GTCCCGCGGCTGTTATCACCATGGCGATCGACATGGTCGCGCGCACTCCGACAGCGCGGGCAACCGACGT
GCTGAGGACTGCGCAAACCATCAGTGGCAGGGCGAGTGCCGACAGGATGAGTCCGATGTCGAAGGCAGAG
CGACCGTGCGCGCCGGCGAGCCAGAGGATGAGGAAGGGAAAGACACCAAAGCTCAAGGCG
>Contig16_5429
CGCACGGTGAATCCCAGGACAATAGCTGCCAGGAATGTGGGGATTCGAAACAAGGTGAGGTCGAGTGTGG
CCTCGGAGCCCCGCCGCAGCTGGTGCAGGACAAACCCGACTCCACCCGCCAGTCCGATGGCCAGTGCCGC
GAGCACATCACCGCGGCCCCAGCCTTTGGCGGCGCCGGTCAACAGACCGTAGTTGAGGGC
>paratb_5430
GAACAACACCACTATGGCAACGACGGCTCCAACCGAGTCCACCCGGCTGTTGTCAGCTGCGTGCGGCGCG
TGGGGTTCCCTGACTTTGAGTGCGGTGCATATCGCCAAGGCGACGCCGACGGGCACGTTGATGGCGAAGA
TCCATTGCCACGTCCCGATTTCGACGAGCCCGCCGCCGATCAGCGGTCCCAGCGTCGCCG
>paratb_5431
CGGCGGCGCCTGCGGCCATCGCTAGACCGACCGCCTTACGGCGTTGCTCTTCCTCAGCATCGGTGTAGGC
GTCGGCAATCAACGCAAGGCACGTTCCGAACACCAGCGCCCCGCCGATCCCCTGTAGGGCACGGGCTGCA
ATCAGGGGGCTTTCGGTGCGCGAAGCCACGCACAACGCCGATGCGACGGTGAACACGGCC
>paratb_5432
ACGCCGGTCAGGAACAGTCGTTTTCTCCCCAAACGGTCCGACACACTGCCGACGGTCAGTAAGAGTGCGG
CAAAGGCCAAGACGTAGGCGTTGACGACCCACTGCAATCCCTCCAGCGAGGCACCGAGATCCTTCTGGAT
CGACGGCAGCGCCACGTTGACCACGGTGATATCGAGGGTCATGAGGAAACATGCCAATGC
>paratb_5433
GGCGACGGCCGTTGTCCATGTTTGGTTCGATCTGGCATGGTCGAGCATTTGAGCCCCTATCGACAATGAA
AATCGTTTTCAGTAAGGTGCATCCTAGCTCATGCGTCACCACATGGGGGGACCGCGTCCTGCTCGGCTAA
ACGCAAGATCGGCAGGCTTCCCTGCGCGATGAAATGCTTTGCAGGACAACAGAACAGTAC
>paratb_5434
GGAGACCGGCGCCGAAAATGATGAGCTCGACACCTGGCCCACCAGCACTGCACGACGGTGATCGGAGTGT
TCCTGCCGTATTCGCGGAATGGGTTGGACGGCGACCAGACGCCGTTGCGCTGCGAACCGTTGCCGCAACC
GGGATCGACGACTGGACATATCAACGGCTCTGGGATCACGTGCGCGAGATCCGGGACGTC
>Contig16_5435
GCCTTCTCCGGACTCTCCGCAGGTATACGGATCCCGATGGCCTTGCCGGGCGGCGCCGATTATGTGGCAG
GCATGCTCGCCGCGCTGGCGGCGGGCCTGATCCCGGTACCGGTGTACCTGCCCTCGACTCGCGAACCGCA
GCGGTTTCTGGCCCGCGCGCAGCACATATTGCGCGACTGCGAACCCTCAGCGGTGTACAC
>paratb_5436
CTGCGGCGAGTTGGTCGAGGTCCTCGAGCGTGATCCCATCCTCGGGGCGCTGCCAATCCGCACACCGGCC
TCGACGGCCGACGGTCTCGCCCCCCATCCAGGTGGCACAACCGCCGACGCCGACCATGGAGAACACGTCG
CCTTCCTCCAGTATTCGTCCGGATCTACCGGGAAACCCAAAGGTGTTGTCAACACCCATC
>Contig16_5437
AGTCGATTCTGCGGCAGGCGGCCTTCGCCGCGAATGTGTGGAACGGCGACGACGACATGCACATGGTCAG
CTGGTTGCCTCTCTACCACGATATGGGGATCTTCTGGGGCGTGTTCATGCCGCTGCTCAACGGCGGTTGC
ACGACGCTCATCCCGCCGCACGATTTCGTACGCAATCCGCGAATCTGGCTTGAGACAGTC
>paratb_5438
AGCAGGTTCCGCGGAAATTGGATCGGCGGACCCGATTTCGCGTATCGCCGCTGTATCGAAGCCTTTGACG
GTACCGCGCTGCAGAGTCTGGACCTGTCGTGTCTGCGGCTTGCGACCAATGGCGCCGAACCGGTTCGCGG
AACCACGTTGCGGGACTTCACTGCGAAATTCCGGGCGGCTGGTCTGCGGGATGATGTCAT
>paratb_5439
```

Figure 6-19

```
GGCGCCGCAGTATGGCCTCGCCGAGGCCGGTCTGGGAGTGACAGGCTCTCAGACTGTTCGCGTATGGGTC
GAAAAGAGCTTCGACGCTGACGCATTGGAGCGCGGCATCGCCGTCGAAGTGGCGCAACCCAACCCGGCGG
ACGGTCGCTCCCGCGCCTTGGTCAGCTGCGGCGATGGCGCCTTCGGCTGGGATATCCAGA
>paratb_5440
TTGTCGATCCGGACCGCCATATGACGTTGACCGATGGCGAAGTCGGCGAAATATGGGTCGGAGGTCCGGG
TCTGCCTGACGGGTACTGGCGGCAGCCGGAACAGACGGCGACAACATTCGGCGCCAGGACCGCAGACGGC
CTCGGTCCATACTTGCGTACCGGGGACGCGGGATTCCGCTACCAAGGCGAACTCTACGTC
>paratb_5441
TGCGGCCGATACCGCGACCTGATCATCGTTGGCGGGCGTAACCACTTTCCGAACGACATCGAGAAGACCG
TCGAGGAAGCCCATTGCGGGGTGGCGCCGGGGGGCGCCTGCGCCGTGCAGCCCGACGCCCCCAGGCAAA
CGGCGAGTGGTGGCTGGTGTTGGAAACCGGCTCTCCCGTCGAAGACCTCGACGACCTGAG
>paratb_5442
CCGCATCCTGCGCCGTCGCATCTTGGCCCACCACGAGACCGCTCCCGAGCGCGTGGTGTGGGTGCCGTGT
CGCACGCTTCCCACCACGACGTCCGGAAAGATCAGACGACGCGAGACGCTCAACCGTCTCACCGCGGGCC
AACTCGAGGTCGTCCATGAGGTATCGCCGCGAGCGCAGGCGCCGGACACTCCCGCCGCAC
>paratb_5443
CCGACGACCCACCCACCGAGCTGGCTCAACACCTCGCAGCCATGCTCGGCGTCGAGCCTTACGAGCTGGC
GCCCGACGCCGACTTGACCACGCTGGGCCTGACCTCGATGATGACCGCCCAGATCGTCGAATGGTCGTCG
TCGCAGTCGCGGCGCCTGGACTTCGCCGACCTGTACGCCGAGCCGACGCTGCGCAGCTGG
>paratb_5444
CAGCGGCTCTTCGACGCGGCGCCCCGGTCCAGACCGGCACGAGCAGCGTCGCCGCATCCGGCCCGTGGC
CCACGACACCGCTGCAACAGGCCTACTGGGTCGGTCGCGGGGCCGAGCAGCCGCTCGGCGGTGTGGGGTG
CCAAACCTACTTCGAACTCGTCGGCGCGCGCGTCGACGCCGGCCGACTGGCAGCCGCTCT
>Contig16_5445
CGACGCGCTGACCCGGCGACACCCGATGCTGCGCGCCACCTTCCCCGACCCCGGCCGATGTCTCATCACG
CCCGAGGCCGTCCGCCTCCCGCTCGCAGTGCATGACCTGACCGACGCCCCCGTCACCACCCGCGACACCC
ACCTTGCCGAGATCCGCCGCCGACTGCGCACGCACCGCTTCGACATCGAAACCGGGGACA
>paratb_5446
CCTGGACGGTCGAACTCACCCGCCTGCCTCACGGCTGCATCGTGCATTTTGCGGTCGACCTCATCATCGC
CGACGTGACCAGTATCGGCACCATGCTGCGCGACCTCGCCGCGTCGTACCGCGGCGAGAAGCTTCCCGCG
CCCTCCGCCACGTTCGCCGATCTAATACAAAGCACGTCACCGCCACCCCAGGCGTGCGCG
>paratb_5447
GACCGGCTCCCCGAAGGCCCGCAGCTACCCCGAGTTCAGGAAGCTGACATCTCCTTCCTGCGGCACCAAC
ACACGCTGAGCGCCCTCGCGACCAAAGCCATCGACGACGCGTGCCACAACCACGGCGTGACCCGGGCCGC
GGTATTGCTGGCCGCATACACGTTGGTGCTGCGACGATGGGCCAGCCAGGACGACTTCCT
>paratb_5448
GGTCAACGTGACCACCTTTGGCCGCTCACCCGAAGTGTCCGATGTCGTCGGTGATTTCACCGAGACCCAT
CTCTATCGTGCTCAGCTTGACGGCCAGATCAGCTTCGTCGACCAGGCGCAGGTCACCCAGAAAGGCCTGC
GCACCGCACTGCGGGCAGCACCGGCCCCGGACCTGCTCGCCACCCAATTACGCTCGGGCA
>paratb_5449
CCGGGCATTCCGGAATCGTGCCGGTGGTGTTCACCTACGCCGCGGACAGCCCCCTACTGAGCGCCGAGGA
TGCGAACACCCTCGGCGCCATCGACGAAGTGGTATCGATGACGCCACAGGTGCTCATCGACCACCAAGCG
TGCCGCCTCGGTGACGATGTGGTGCTGTCTTGGGATTACCGCGCGGGCTGCTTCCCCCCG
>paratb_5450
GGTGTGGTCGACGACATGTTCGAGGCCTATGTGACGCTGCTGGAGCGCCTCGGCGGCCACGACTGGTCCA
CCCCAGCGACGCCGGGGCTGTCAGCGCACTCTCGGCTGGCCCGAGCGCACCGCAACGCGACCACCACGCC
GGCACCGGCAGGGCTGCTCTACGACGCCTTCCGGGAGAACGCCGCCACCCACCCCGCCCG
>paratb_5451
```

Figure 6-20

```
TCTCGCCCTGCGCTGGCGGCCCGACGACTACCGAGGTGAACGCCACGGCGACGTGATCGCGCAGGACAGA
TCCCAGTTGACGTACGGCGAACTAGACGAACTGGCACGCAGCGTCGCGCGGGCCGTAGCCGCACGCCACG
CTGCGGGCTCGGTGATCGGTATCCAGCTGCCCAAGGGACCATCCCAGATCGTTGCCGTGC
>paratb_5452
TCGGCGTCATGATGGCCGGCTGCACCTATCTACCCGTCGGTGTCGACCAGCCCGCGGAGCGGCTCAGCCG
TATCTGCGCCAGATCCGCGATGGCGGGACTGATCCGCACCGACAGCGACACACAGGACGCGGGGGTCGCG
GTCTCTGACATCACGGCAATGATCGAGTGCGCACCGACCGATCCGATCCGGATCGACCCA
>paratb_5453
CACGACGCCGCATACGTCATCTACACGTCGGGTTCCACCGGCGAACCCAAGGGCGTCCTGGTGTCCCATG
CCGCGGCGTTGAACACGATCGTCGACGTCAACCGCCGCAACCGCATCGACACCCACGACCGCCTACTGGC
CTTGTCGGCGTTGGACTTCGATCTCAGTGTCTACGACACTTTCGGCGCACTCGGCTGTGG
>paratb_5454
CGCTCAGCTGGTGACCATCCCCGAACACGCACGCCGCGACGCATTCCACTGGCTCTCGCTGACAACGGAA
TTCGGTATCACAGTGTGGAATTCGGTTCCTGGTCTGATGGACATGCTGCTGATCGCCGCGGGGGACAAGG
CGGGATCCCTGCCGACGTTGCGCTCGGTCTTCCTGTCCGGCGACTGGATCCCGTTGGACT
>Contig16_5455
TGCCGCGGCGGCTGCGTCGCGCCGCCCCGGTGTGCGCCTGGTGGCAATGGGGGGAGCGACGGAGGCGGC
GATCTGGTCCAACGAGTTCGTCGTCGACGACGTCGACCCGGACTGGGCTTCAATTCCCTACGGATACCCG
TTGGCCAATCAGATGTTTCGGGTCGTCGACGACAACGGCGACGACCAGCCGGACTACGTC
>paratb_5456
GCGGGCGAGCTGTGGATCGGCGGGGCCGGCGTCGCACTGGGCTATCACAATGCACCGGAGCTGACCTCCG
ATCGGTTCGTGCACGACCCGACCGGATCACGCTGGTACCGCACCGGCGACATGGGGTGCTACTGGCGCGA
CGGCACGTTGCAATTTCTGGGCCGGGCGGACTCACAGGTCAAGATCCGCGGACATCGGGT
>Contig16_5457
GGAGTGCGGGGAGATCGAGCACGCGCTGCGCGGCCACCCGCTGGTCGCCGCCGCGACGGTGGTCCCCATC
CACAACTGCACTGCGCTGGGCGCCGGGATCGTCGTAACCGGCAGCGGCGCAGAGCAATTTGACGACTCCA
CACCCGGCGCGCTGCGCGCCCATCTCGCCGTCCGACTCCCGCAGTACATGATCCCCAAGG
>paratb_5458
TGTTCGTCTCATGCCCCGAGCTACCGCTCACCGCCAACGGCAAGGTCGACCGGGGCAAAATCGCGGCGCG
CCTCGAAGCGGCCGCGCGGGCACCCCAGCCGCTCGACACGTCATCCACCCTCACTGTGGTCGAGCGGCTG
GTCGCCGAGGTCTGGTCCGATGTGCTGGGCGCGCCGATCACCGGCCGCGAGGACAATTTC
>paratb_5459
TTCGCCCAGGGCGGCGATAGCCTGCGCGCCACCGAAGCGGTCGCCCGACTGACGCGCAGGGGAGTGGCCG
GAGCGGAGGTGGGCCAGCTGCTCAGCCACCAGACGCTTGGGCAGTTCAGCGCGGCGTGTGTGCTCGCCGA
CCCGGCATCCGAGGCATCCGAGTCGGCGGCCGATGTCGGCGAACCCGTGACACCGGGCGA
>Contig16_5460
GGGGTTCCCGCTCACCCGGTTGCAGCAGGCCTACACGCTGGGCGCGGCCGGACTCAATGGGAGCACCTGT
GCACCAACGTATTTCGCGGTGGTGCTGGCCGCCGCGCCCGAGTCTGCCGGTATAGACCTGGATCGGTTTG
CCCGTGTGGTCACCAGATGCGTCGACGAATTCGCGATGCTGCGGTGCGCGCTGGACGCCG
>Contig16_5461
ACACCACCCAACGGGTGCAGGTCGACGCCGGGCCGGTGCCCGTCCATGACCTTGATATACAAGACGACCC
CGACCTGTTACTGCGGCGCATGGCGGCCGCCCCGTTCGATCCGCATTCGGTTCCGGTGATCCAGTGCTTC
GCACCGTCGAGGTCACCCCGTCACGTCGGTCTGCTGATCAGCTATCTGGGCCTCGATGCC
>paratb_5462
CGCAGCCTGTCCACCGTCGTCACCACGATCATCGCCGAATACCAGTCGCAACCCCGGCCGCGGCAGGTCG
ACCCGACCGCGGCGGTCTTCGCCCGGTTTGCCTCCGAAAGCGCTTGGGGCGAAAACGATGTCGACAACAG
CGTTGCCGGCCCTCCGCTGCTGCCGCTGCACGACCAGCGACGTGACCCCTTCGAGCGGGT
>paratb_5463
```

Figure 6-21

```
CACCTTCGCGCGGCGCAGCTTCACCATCGAAGAACAGGCTGCCGCCACGCTGCGTGAGCACGCCGCACAC
CTCGGCGTCACCCCCACCGCGCTGGTCTTCGAAGCCTTCGCACATGCGCTGGCGTCGATCGGCGCCGGTC
AGCGATTCGCGGTGACAGTCCCCAAGTCGTACCGTCCCGACTACGCCCCCGCGGACCGCG
>paratb_5464
AGGTGTTGGGCAACTTCACCCGCCTGGCGCTGTGCGAGGTCGACTACGGCGCCGTGAGACCGGGATCTGC
CGAAGCGGTTGCCGCGGCGCAGCGGGAACTGTGGCGCGCGGTGAGCCACGACGGTGACATCACCGGCGGG
CTGGCCGCAACGCGGACCGCGGGTGGCTACCCCGTGGTGTTCACCAGCACCCTGGGGCTC
>paratb_5465
ACCCATCAGGACGCCAGCGGGCTGACCAACGTGCGGACATTGACCCAGACCCCGGGCGTCTGGCTGGACT
GCCAGACCGAGGACGAGGTCGCCGGAATTCGTATGAGCTGGGACATAGCTACCAATGTGGTTGCCGCGGA
ATCGATCTCGGTGGCTTTTTCCCGATTCGAGGAGGCGGTGCGGCGCCACGCGGGGCAAGC
>Contig16_5466
CGAGCCGCCGGGCACGGCCGTTGCTCCGGCGGTGGGCGGGTCACCCGGGCCCGAGTGGGCGAGCGCGGTG
ATCGCCGCCGCGCTGCGCCACTGCCGACCCGAGCAGGTGCTGCCGCAATACACCATGCTGGTGCGGCGCT
GGGAGGCACTGCGATACGTCCCCTCAGGATACGCCGCTTCCGACGTCGAACGGGCGGCTC
>paratb_5467
GCCGGTTGGCCGGCATCGTCACCGGAGCCGTGTCACCCCAGACGCTGATCGGAGACCCGCAGCTGACGCC
CGAGGCGCTGCTGCTGCGTGACGACCGCATGCGGATGGCCCTCGACGACCTGGCCGGGGCCATCTTCGGG
CACGCGCGCACGCTGGGGCGGCGGCTTCGCGTCGTGGAAGTCGGCTCCCGGACCGGCCTG
>paratb_5468
ATCACCGAACGGTTGACCGAGCTGGTGGGCGTGGTGGTCGAGGAATACTTGTGCCTGGAGCCAAACCCGA
CGCTCGCCGGAATCGCCGCCGGGCGGCGCTTCCCGGCCCCGACCCGCCACGTCGACGCACCCGACGCGGC
GTCGGGCGTCGACGTGGTGATCTGCTGTGGGTCGCTGCATCAGCTGCCCGACGCGGAGGC
>paratb_5469
GGTCCTCGAGGCGATCACCGTGTCCGACGACGGTTGGCTGTGGATGGTGGAGAATTCCGAGGCCACCCAA
GCGACGCTCATCAGCGCGGCCGTTCTCGACCCCGGCCTGCTCGCGTCCGATTCGAAGACGCTGCGTCCGG
CCGATCGGTGGTGGCGGCTCATCGCCGACCACGGTTGGCGACCGACGCACATGATCCAGG
>Contig16_5470
ACGGACCCGGCCTCACGCTCATCGCGCACCGCCCCGACAAGCCCGGCATGCCGACACCGCCGGCCGAACA
GCGCCGCGACGGTAGGTGGTCGCGACCGGCTGTGCCGGCGTCGTCGCTGCCGACCGACGCCACGGTGGTG
GCCACGCTTGCCGAGATCTGGCAGCGTCATCTCGCCATTCCAACACCCGGCGTCGACGAC
>paratb_5471
GACTTCTTCCTGCTCGGCGGTGACAGCCTCGTCGCGACCCGGGTCTACGCCGACCTTCGGGCCGCCGGTT
TCGGCCAACTCGCTTTCGTCGACCTGTTCAACCACTCGACGCTCGGTGAGCTCGCGGCACACGCCGGCCC
GCGCACCGGCCCGGAAGTGTCGGTGGCGGCTGAGTCGACCCGGGGCGGCACCCACGACCC
>paratb_5472
GAACCGATTCCCGCTCACCGTCGTGCAGAACGCGTATCGGGCCGGGCGAGAAGGCGCGTTGATCCTCGGC
GGCGTCGCCGCGCACTGCTACTTCGAGTTCGAGCTCGCGGACTTCGACCGGCCGAGATTCGATTCGGCCG
CACGCCAACTCGTAGCACGCCACGCCGGACTGCGCACCACGGTGTCACCGGCGGGCACCG
>paratb_5473
ACGCGGCCTCCTCGGGTGAGGTCGCCGTCGTGCACACCGCGCCGATCGAGCCCGTCGTGCGAGACCACGA
CGACGTGCGAGCCGCGATGCGCGACCAGATCATCGACTTGACGGCCCGCCCGGGCATCGACTTCGGGGTG
CAAACCCGCGGCGACGGGCGCACCGTCGTCGGCATCAGCATGGACAACACCATGCTCGAC
>Contig16_5474
GGCGCCAGCATGATGATCGCCCTGTCCGAACTCGATCACCTCTATCGCGGCGAAACCGTTGACCAATTGC
CGCCGCTGGAAACGTCTTTCGCGCACTACGTGTGGAACCACCCGGAGCTGCTGCCCGACGCCGACGAGGC
GGTGCTGCCGCGGCTGGCCGCCAGCCGAGACTATTGGCGCGCACGCCTGCCATCTTTGCC
>paratb_5475
```

Figure 6-22

```
GCCGGCGCCGAAATTGGCCGACATGTCACTGCTGTTCGAGATCGAGGAGCCGAGGTTCGAACGGGCAACC
GCGACCATTCCCGCCGTCGACTGGTCGCAGGTAACGCGATCGTGCCGTGCCGAGGGCGTCACCGTCGCGT
CATTTCTGCTCGCCAACTATGCACGGGTGCTGTCTCGGTGGTCGGGGACCGACCACTTCT
>paratb_5476
GCATCAACGTCACGCTATTCGACCGCGACCCCGATGTCGTGGGGATCGAAAACGTCGTCGGAGATTTCAC
TTCCCTGGTGTTGTTGGAGTGCCGAGTCGATGAGCCCGCCTCGATCTGGGAGAGCGTGCGCGCTCTGCAG
CGGCAATTGATGACCGACCTGCCGCACCGCGGCGCGGACGCGGTGTGGCTGCAACGCGAA
>paratb_5477
CTGCTGCGGTTTCACGGCAACCCGACGGCCGCGCTGTTTCCCGTCGTCTTCACCAGCGGACTGGGCCTTG
TCGACGCCTCGGCTCGGGCGGCGGTCCGGTTCGCCGAACCGGTATTCGCCGCCTCGCAGACACCGCAGAC
GGTGTTGGACTTCCAGGTGTGGGAAAGCGCGGGGGCGCTGAAGCTGTCGTGGGACTTCGT
>paratb_5478
CAGTCAGGCGGTGTCGCCGGCCACCGCGCGCACTCAGCTCGAGTCGTTGGTGGACGGCATCACCGGTGTC
GCCACACGCAGCCGCCGCATCGAACACAAGTTGGGCGAGGGGGCATCCAATGACGAGCTCCTGCAACGTG
TTTCGAGGATCTGCGCGTCCGCCCTGGGTCAGCCGAGGGTCGAACCTCACGACAATTTCT
>paratb_5479
TCCAGCTCGGCGGCGATTCGGTCAGCGCGACCAAGGTGGTCGAACAGATCGGCCGTGAGCTGTCAGCCTC
GGCCACCCTTCGACTGCTGTTCGCCAATCCGGTGATCGGCGACTTCGCCGCCAAAATCGCCGACACTGAC
AACGCCGACGAACCCGACCTGACCGTTGAGGAGGGCATGTTATGACCGCGGCCGAGCTCG
>paratb_5480
TCGACCACCTGCGGGGTATCGGCGTCCAACTGTGGGCCGACGGTGAGAATTTGCGCTACCGAGCACCGCA
ACAAGTCCTCACCGCGGACCTGAAAGCTCAACTGGCGGCGGTCAAAACGGACGTGATTACCCTGCTGGCG
GAAGAGACGACCCTGCTGCGCGCGCCGCAGGACCGGTTCGAGCCGTTTCCGCTCACCGAC
>paratb_5481
GTGCAAGCCGCATATCTGGTCGGGCGCACGTCGGCGTTTCAGTGGGGCGGGGTAGGCTGCCACGGCTACG
CCGAGTTCGCGGTCGACCACACCGTGGCAACACCGAGCGCCGAGCAATATCGGGAGGCGTGGCGCAAGGT
TGCCGACCGCCACGACATGTTGCGCTGCGTCGTTCATCCCGAGGGGTATCAGGTGATATG
>paratb_5482
CCCCGACGTGCCCGACGACGGGCTGGTCATCCATCAGTGTCACACGGTCGAAGACGTTGCCGGCGTACGT
GCCGGGGTCACGGAACATCTGCGTAACCGGATATATCCGCTGGGCGAAGCGCCGATGTATGACCTGGTGA
TCACGATGGGCCCTGACGACACCGTGGTCCATCTGTCCGTTGACCTGCTGATCGCCGACT
>paratb_5483
TCGTCAGCATCTCCATCCTGATGACCGACTTTCAGCAGTGCTTGCTTGACCCCGAATGCGACCTTGCGCC
CGTCGATTTCAGCTTCCGCGACTACCTGCTGAATCTCGCTCGCGAGCGAAGCTCGGCCGCCGGTAGTGCC
CGCCGGGAACGCGATCTCGCCTACTGGCGGGATCGGCTCGATCAGCTGCCGTCACCACTG
>paratb_5484
TCGTTACCGGTGCTGCCCGACGACTAGACGCCGTCAGCGTCGCGGACGGCACCGACCTTTTCACGGCGTT
CGATGCGCCTGTCGGCCGAGCGTTTCGAGGTGCTCAGCCGGCGCGCGGCAGAGCACGGAGCGACCGTCAA
CGTCGCCATCGTGACGGCATTCAGCCGGGCCATCGCACGCTATGGCGATCGCGACCATTT
>paratb_5485
CCTGCTGACCCTGACGACCATGGACCGCCACGCGTTCACTCCCGCCGTCGGGCAGTTGGTCGGGGATTTC
ACCGGCACCAGCGTGCTCGAAGTCGATGTCCGCGGACAGCGCACCTTCGCCGAACTGCTGCACGGCGTCG
GTGATCGTCTCTTCGACGACATGGACCATTCGACCACCGGCGGCGTCAACGTCGCCCGGC
>paratb_5486
TCCTGGGGCACGCGACGACGACCGAGGTGAGCAGACGCCCGTCGTGTTCACCTCGACACTCGGCGCCAC
GACCCGAATCGACAGCGGCGCAACATCTTTGTTGCACCCGATTCAAGGTCGCGGTCTGAGCCAGACTCCT
CAGGTGCTGCTGGACTGTCAGGTCGCCGAAATCGACGGCATGCTTGAGGTCAACTGGGAC
>paratb_5487
```

Figure 6-23

```
ACCCGCGATCAGGCCGTGCCCGCCGAGGTCCTCGACCGCGCGTTCGCCGACTTCCGCCACGCCCTGGATC
TGCTCAGCACCGACGCCTCGGCCTGGCACCGGCCGCTATTGCCGGCCCAGCCCCCCGAGACCACACCGGT
CGAGGGGCCACGCACACACCATGAACCGGCGCTGATCCATACCGGGTTCCTGCGCAACGT
>Contig16_5488
GCTGGTGACACCGGATGCCGTCGCCATCCGCCACGGTGATCGGGCCACCACGTACGCCGAATTGCTCGCT
GCCGCGACCGCGGTGGCCGACACGCTGGCCGCGACGGGGGTGCGGCCGCGTGACTACGTCGGTATCCGGT
TGCCGCAGGGCCCCGCCCAGATCGCGGCTCTCCTGGGCGCATTGCTGGCCCGGGCCGCCT
>paratb_5489
ATGTGCCGTTGGACGTCGGCTGGCCCACTCACCGCGTCGACCAGATCGCGGCCCAATGCTCGCTGGCAGC
GCTGTGCGAGCCGGACGGAGAGGTGGACCGGCTGCTTGCCGACCCGCAGACCTGGTCACCGCGCGCGGCG
GTGGTGCCGGAGCCCCACAGCGAGGTGCTCGCCCCGGACGACACGGCCTACGTCATCTTC
>paratb_5490
ACGTCCGGCTCGACCGGTGTACCCAAAGGCGTGATGATGGCCCACGGGGCGGTGGTGAACACACTGACCG
ACATCAACGACCGGCTGGCCATCCGCGCAAGCGACTCGGTGCTGGCGGTGTCGCAGCACACCTTCGACCT
CTCGGTGTACAACATCTTCGGAGTCCTCGCCGCCGGGGGCACCATCGTGTTCGCCGACGG
>paratb_5491
AAACGAAACAAGCAACCCGCAAGCCTGGTGCGACGCCATCACCGACCACCGCGTCACCGTGTGGAACTCC
GTCCCGGCCCAGATGCAGCTTCTGCTCGACCACGTCAACGGCACACAGACCTTGCCGTCACTGCGCAACG
TCATGCTGTCGGGAGACTGGATTCCGGTGTCGCAGCCCCCCGAGATCGCGGCGCTCGCCC
>paratb_5492
CGAACGCGTCGATGCTCAGCCTGGGCGGGGCAACGGAAGCGGCGATCTCGTCGATCTGTCATCCCCTTGC
CGCGCAGGTCTATCAGCGCAGCGTTCCGTACGGAACCGCGATGCGCAACCAAAGTGTGCGCGTGCTGACC
CACCGCGGCGAACCCGCGTCGCCCTGGCAGATCGGCGAGATACACATCGGCGGACTGGGC
>paratb_5493
TTGGCACAGGGATACCTCGGCGATCCCGAGCGCACCGCGTCCGCATTCGTCGTCCATCCCGTCAGCGGGG
AGCGGCTGTACCGCACCGGGGATTACGGCCGTCTCATCCACGACGGGGTCATCGAGTTCCTCGGACGCCG
CGACAACCAGGTCAAGATCCACGGTCACCGAATCGAATTAGCCGAAGTGGACTCCGCGTT
>Contig16_5494
AAGTGCGCTCGCCGGCGTGCACGCCGCGGTCAGCACCGTCGTCGGTCAGGGTCCGCACGACCGGCTCCTG
GCGGCCGTCGTCGTCGCCGACGCGGCCGACGACGACGAAAAACGGCAACGCCGCGACATCGCGGCCGCGG
TGAGATGCGCTGCCGCCGACGCGCACCGCAACAGCACCGCCGACCTCGACGGCGACAAGC
>paratb_5495
TCGGCCATTTCGCCAGCACGGCACGAGCGGTGGCGATCGAGAGCATGTGCGCGGCGCTGCGAACCGTAAT
GGACGTCGGCGAACGAATCGATTTCGCCGAACTCGCCGGACGGTTGGCCCTACCGCAACGGCTGGAACGG
TTGCTGCGCCGATGGCTCGACGCTCTTGAGGAAGCGGGCATGGTCGTGATGCACCGGGGA
>paratb_5496
CCCAGTATCGAATTACGCGGGGGACCTGAGCTTTCCGCCTGCTCGGCCCAGTGGCAGCACGTACGGGCGC
TGGGAGCGGCCGTCGACTACGGCGACGAACTGCTGGACTACGTCGGCCAGTGCGTCGAGAATCTGTCCGG
CCTACTCGCCGGAACCGTCGACCCACTCGCTTTGCTGTTCCCCGAGGGAACGTTGGACAC
>Contig16_5497
CGCTACCGCCGCCTACCGGGACAACCTGGTCAGCAGGTACACCAACGGGTTGGTGATCGCCGGGGTGGCC
GAACGTGCGCGGTGGGCCACCCCGACGCGGCCGCTGCGAGTACTCGAAGTCGGGGCGGGTGTCGGCGGCA
CCAGCGTCGGGCTCGTTGCGGCATTGGCCCATCACCACGTCCGGTATACCTTCACCGACG
>paratb_5498
TCTCCCACTTTTTCCTCGGCCAAGCCGCCAAAATGTTCGCCGAGCACGACTTCATCGACTACCGGCTCTT
CGACGTCAACCAACCGCCTGCCGCACAAGGGCTCCCGCCGGGATCCTTCGACGTGGTCGTGTGCGCCAAT
GTCTTGCACAACGCCGTCAACGTCGATGACACCCTGGCCATGTTTGAGCGGTTACTGGCG
>paratb_5499
```

Figure 6-24

```
CCGGGCGGCTCGCTGGTCTTCATCGACGCCACCGCCACCAATCACCCCTTGATGATCTCGATGGAGTTCA
AGGAGGGACTGCACGGGTTCACCGACGCGCGCGCGGGTACCAACTCAGCTTTCCTGTCCTATGCGCAGTG
GGGAGACGCGTTAGAGCGATCACCGTTCGGCGAGGTATGGAGCTTTCCGCCACCGGAGCA
>paratb_5501
AGTCGCTTCGCGCCGCGGCCCGGCGGTTCGGCCGCGGCGGAGACGGCGTGTCGGCCAGTCTGGATGCGAT
GCAGACGCGTATCGCCGAGGTCTGGGTCAGCGTCCTCGGGCTGCCGTCAACCGAAGCCCTGTCACCAAAC
TCGGATTTCTTTGCTTTAGGTGGAGATTCGCTGCTGTTGGCGCAAACGATCGGCCGCATC
>paratb_5502
CGTCGAGAGATCGACGAAGCCGCCGGCATCGCGTGGGACGACCTGCTGCGCGCAATGGTGTCTGATCCCA
CCCTGGCCGCAGCCGCGCAGGCGGTTCAGGGATGCGGTCCGACAGCGGATTCCGGGGATTACAGCGCTGA
ACTTGACTCGCCCTTGGTGTATCTTGGTGCGGGACAAGGTTTTAGGTCAGGGACCGAGAT
>paratb_5503
CGCGGTTTGCGTCCACGACGGAAGCGGTGGCCTGGCGCCGTACGAGCAGCTGGTGTCGGAGTTGCGGTCG
GCTGCTGACGGCGCGCCCGAGCTCTACGGCCTACGCAGGGTCGCCGGTGACGCGTACTCGCGTATCGCAC
CGCCGGAGCTGTTCACCACACTGGCGTCGCGCTACGGCGCCGCGATCACTGCTCTGGCAC
>paratb_5504
CCAGCAAGGTTCATCTGGTCGGCTACTGCATGGGTGGCCTGTTGGCGACAGAAATCGCCAAATGTCTCGA
GGAATCCGGCATTGTCGTCGCACCCGTGACCGTGGTCAGCTCCTACCGCGTGCCATTCGACATCGAAGAC
GACGACATCCTCGACTACTGCTTCGCCCAGATCATGGGTGTATCGCCCAGCGATCTAGGA
>paratb_5505
TTGCGGGTCGCGGATGACGCCATCCGCGCGGCATTCGCGGCCGTCCGGTCGCGCCATGCCGACCTCATAC
CGCCCGGCGCTTTGCGCGCGGTCGCCGCGCCGGAGCTCGCCAGCGCCCTCGATCAGAGCGCCGCTCCGGG
GGAGCAGCGATTGAAACTGCTTGCACAATCGGGCGTTCTGGGGGACTCGTGGACCGCCGA
>paratb_5506
GTCGCTGACCGAGCTGCGGGCGATCTTTGTGCATAGCCTGCGGTCGGTAGTCCAGGGGGCGGCGGACCCG
TTTTTGGGCGACGTCCACTTCCTCCGGCAGCGCGGCGATATCCATTTCCTGCCCACCCTCAAGGAGGACA
TGACCGAATTCTGGCGTGGCTACTGTCTTGGTGAATTGACCATCACAGAGATCGACGGGA
>paratb_5507
ACCATTTCGACTGTCTCACCGGCGAAAACGCACGCTCTGTAGCCGGCCTGCTCCTAGGGTCTTGGGTGGT
GCGCACGTGAGGAAGGTGCTGCTGTTAGGCAGTACCGGAGCGGTCGGATCCGGTTGCCTCGACGTCCTTT
CGCGGCGGGACGATCTCGCGATCGTCATTGCGGGACGCGACGAGGCACGGCTGCGCGCGG
>Contig16_5508
TCGCTTCTACGAAACGGTCAGGTGTCGAGGTTACGCGACTGGACATCGCCGACGTACCGGCCGTCACGGC
GACCGCAGCGCACTGCGACATTGTGGTCAACTGCGCGGGTCCGTCGTATCGGTTCAGTTCAGACGTCGCT
CGCGCCGCCGTCGGTGCCGGTGCGGCTTATGTCGACCCCGGTGGTGACCAGACGTTGCTT
>paratb_5509
GACAGCCTCGCCGCGATCGAAACGACCGCCCCGTTGTACTCCAAACAGGCGTACAGCCTGGCCTATCGG
GCCTGCTGCTGCGGGCTCTCGCGCTGCGTCACCCCGAACGGATCGAAAACATGCATGCGTGGTGCGGTGG
ATTGCAGCCCCTGACGGCGGCGGCGGTGCACGAATACCTCGCCAGCCTGGAAAGTCCGCA
>paratb_5510
TAGCTATCCTGCCAGTGCACTGCGCGGCGGCGCCGTCCGACGTGTCCGCAACGAAGAGTGCGTACCGGCC
CCGGCGCAGTATTTCCCCGACACCGCGTCAGTGCATCCACATCTGGACTCCGAAACCATCGCGGTGGCTG
CCCAGTTGGGTATCGGAAAGGTGTGGTGGGCCAACGTGTTAGACGGTGCACGCACCATAC
>paratb_5511
GAGCGATACATCTCTTGGCCGCCGAGGACAGACAAGGGTGCCGTGACAAGGACCTGCGGGAAGTGCTGGC
AGCTGTCAAGCTCGACCTGTTCGGCCGCGCCGCGTACTTCGCCATCGTGTGCGCTGCGCAAAGCGACTCC
GTGTCTACGACTTTGGCGGTGACATGCGAAAACAGCTATCGCGTATCTGGTGCTCTGGCT
>paratb_5512
```

Figure 6-25

```
GCCTTTGCCGCACAACGTGTTACGCGCATGACCGCCGGAGTGCACCCGTTCTGGACAGTGGATGACCCAT
GGGATGTGCTCGCGTTCCTGGCCGCGACCGTACCGTGACTTTGCGGTATCATTCGCGGGCGATGCCTCGC
CCGTCCCGCATAGCGCGCTGTCGGCGGCCGAGGAGGGTTCACTGTGACCACTCGGCCGCA
>paratb_5513
CCGTCCTCGGGCGATCGTGGTGGGTTCGACATTCGGCGCCGTGTACGCCGAAGCGCTGGCGGCGCCGGAA
TCGCCGGTGGAACTCGTCGGATTGTTGTCGACCGGGTCTCGGCAATCCGCCGATCTAGCCTCGCGCCTTG
CCATTCCGCTCTATACCGGCATGAACAGCCTCCCGCGCGTCGACATCGCGTTTGTGGTGG
>paratb_5514
TGCGGTCAGGAGTTGTCGGCGGTGAGGGAACACGAGTGTGCAAGGAGTTGCTCTCACGCGGCGTGCATGT
GGTCCAAGAGCAGCCCGTTCACGCTGACGAGATTATGTCCCTGCTCCACGTGGCCGCGGAAAATGCGGTT
CTCTACACGGTGAACGACTTCTACAGCCGGGTCGCGCCGATGCGCCAATTTATCTGTGCG
>paratb_5515
GCCAAGACTCTCGATAGCCTGGCGCGTATCAGGTACGTTCATGCACGGGCATCGCTGCACGTTGTCTACC
CCTTATTCACCATTCTGGCGAGCATCGTCGGCCCGCTGACCCCGGCCCGGATCGTCATGCCGGAACAGAC
CGGAGGCGCCTTCGTCGCCGGCCGGATTGTGCTCGCCGACGTCCCTGTCGACCTGCTGAT
>paratb_5516
CCAAAATGAGTTGTGCGCCAGCGAACCAGACAACTACGCACGGTTGTTGCACACCCTCACGGTAGGGTCC
GACGCCGGCGAACTCGTCCTCGACCACACCCACGGGCCAACACGGTGGCATCCGCGTCCGTACCCCGATA
GCTGGGCGTCGCAGTCCGGCTGTCCTATCTCCGAACGTGTCGGTATCGACTTTGACCCGA
>paratb_5517
CGACGGCGACGGTGCGCAACGAACTCTGGCCCGACGCGGTCCGGTTGGCCGCCTCCGAATTTCTCGGATC
GATCGGCCGCGTGCGCGCAGGGGTTACGCAACGATTCGTCCGGGCCACCCGGCTGTGGTCCGAATTTACG
TCGGCGATGGGGCCTGCCGCACCGATCAATCCGGTGACATCGGCAAGGCTTTCGGCCTCG
>paratb_5518
GAGCTGGTTGCCTTATGACCGTGCGTATCGGAGCACTGACCGAACCGACACCCGGCAACCGCACCGTCGT
CGTCTTCCCGCACGCGGGCGCCAGCCCGCGCTTCTACGCTTCCTGGTGCCGCCTACTGCCCGCTGGCGTC
GATCTCTACGGTGTCACCTATCCGGGCCGGGACATGCTGCTCGACGAGCCCGTACCCGAA
>paratb_5519
ACGCTTGCTGACTTGGCCTGCAACTGCGCAGTAGAGCTGAAGCCGATCATCTACTCGTCGAGTTCTGTTG
TGGTCTTTGGTCATTCGATGGGCAGTCTCGTCGCGTTTGAAACCATCCGAGAACTTGAACAGGATGGAGT
ATCGGTGACTGCTCTGGTCGCTTCAGGGGCGGACGCACCGCATCTGGAAACCGACCAGTC
>paratb_5520
GTGGCACCGTGCTGCGGACGAGGACCTGATCCAGCACCTGGCCGAACTCGACAGCCGCAGTCGCGACGTG
TTCGCCGTACCCGAATTGCGGCGGATGTTATTACCCACCGTCCGCGAGGACTTCCGCCTCGTCGAAAGTT
ATCGCGCCGAGCTGCACCCGCCGGTTTCCTGTCCCATCCATGTCATGACCGGGGATGCGG
>paratb_5524
ACGGAAAATGCTTGACCCGATATACCCTACGGGGGTAGTGTAATATGCATGAACGACAACCTGAATTGCA
CGTGTAGGTCCACCGGATGTACGTGCGGGGAATCTGGCTGCACCCAAGCGCATGGCTGCAAATGCGGTCA
CCCGAATTGCACGTGTAACGACTGATCGCCAACAGTTACCGCCTCGACTCTCGTTGAGGC
>paratb_5525
GGTAACTGTTTCGCGTGAGATGCCCACTCGGGCGGAATGCACAGCGATCCGTCTTAGTTCTGATGGCTGA
CTCGGGCCAGGTTCAGGTCGGCCCGCAATCGGGCCGGTAGATCTGCGCTTTCCCAGCCCCCGGCGGCGAC
CCACCGGCAGGCAACCCTCGCGTCGGCATCGGTCTCAATAGGTCCAACCCAAACCATCGC
>paratb_5526
GGCGCTGGGCGTCCGGTCAACCGTGCACGGCTGCAGGACCATGATCGGGCTGCGACTGGGATGCATCGTT
GCACAGGTAAATTCGCCGAGGAGGCACTGAGTCTGTACCAGTACGCCGTGCGGAGACCGGCGTACGAGCC
GACGCAGCAGCGTCATGATCAGGGGCTCCTGCTCCGCGGTACACCGCCTGCATACCGCGA
```

Figure 6-26

>paratb_5527
CGGTGAACGGTCGATATGTCCAGCATCGGTCCGACATGTCGCCGTCTCCTCCTTTTTCACTGTGACGCTT
TACAACCTGCGCTCATTCGCGGTAGGCCAACCAGGTGCGACCATCAAGACGTGTCTCCGATCCTGTCGTC
GGCGCCGTGCCCACGAATGATGTCTGGATGCTCGCCGGCAGAGCCATAGGAAACCGACTC
>paratb_5528
AAATGGACCAGCGCGCCAATCACCAAAGGGATCGGCATAGTTTGCCCACCGGCCGGGCTGAGAAAACTCT
TCGTCGGTCAGCAGTGCCCATCGTAGGATTCGGAGGATCTCACCGGGATCGGCGCCACAAGTGAGGATGG
TCATCGCGACATGTCGGTCTCCGTGCTGGTCGTCCCAGCGCGCCGCGGCCATGATACGTC
>paratb_5529
GATCGGCATCCGCGGCGGCCATCTCGGACGCGTCCATGGCTGCCAGCCAACGGCCGACGTTGCCCACGCG
CAGTTCCATTCCAGCCGATTCGATCCATACCACTGTGTCGGGCTGGCTGGCTAGCCATACTCGACCGCGA
GTTCTGACCACGCCCTCGAGCAGCACATCGATGGCGGTGTGCAATCGGGCGGGATGAAAT
>paratb_5530
GGCCGCGTTGCAGTGAAATCGAGAAGGGAAACGCCTGCCTCGGATACGAGCGGCGGCTGTCCGGTAAGGA
GCGATTCATGCGGGTCGAAGTCGGCGCCTCGGCGTGCGAGGGGATGCAGGTTGCGCAAGATTGATTCGAT
ACTCGTTATGTCGCAGGTGATTCGCGACCTCGGCGCCAGTCGCCGAAGCACGGCCTCGGT
>Contig16_5531
CCTGCGTTCGGGTTTGGACAACACCAGCACGTCGGCGAATTCGGCTTGGTCGACCACCGCTTGGGCGGCG
CTGCGATGGTCGTCCAGTTCGTCATCGCCCATGGCGTGGGCCAGCCAGCTATCCGTGTCGACACACGTCA
CCACAGAACTGATGTGCACATCGAGGGCCGCGGGTCCGTCAGCGTAGCCGGGGCCAACGC
>paratb_5532
ACACCGGGGTGTGATTGATCGCGTAGCAAATCAGCTCGAGTTCGGTCCGCTCGTCGAGTAGCACGACGAC
ACGGTCCACGTCCTGTCGACGATGGACACGCCGCAACAGGATGAGCAAGTCGTCGTGGATCGTACGCCCT
GGGTCTGCGTTGCCCAGCTCGAGGATCCAATCACTGTCCCACGGTGCGCCCGCGCGCAGC
>paratb_5533
ATACTCACCCGTCGTCGCACCACATGTCCGTCGAGGGTGTGGCTAATCACTGCGGTGCCCGGTGTTTCCC
TCAGGGCGGCGGCGACCCGGCCGGTGCAGCCTCGTCCGGTCAGGAGCACCACGGGAGTGTGCATACCCCT
CCTTATCGACAATCGTTTTCATCTAGCCGAGTTTCACGGTACAGTCCCAGCGGAATGTTG
>paratb_5535
TTGGACTGGTAGTAGGCCCGAGATTGCGGGTCGCAGCGGATCGCGGTCAGCGCGGACATGTACATCACTG
GGCGCAGGCGACGACTGTAACGCTGCGGTGTGTGCAGTCGTCCGGTGCGTTTACCCGAATCGCTAGGGAC
TGGGGCCAGGCCGGCCCAGGCGGCGAGCTGGTCGGCCGACCCGATTCTGGCGGGGTCGCC
>paratb_5538
TGCTGACGCAGCCGGTTGATGGTGCGGGTGCGGTCGGCGACCAGGTCGGTGCGATGGGCGGTCAGCATCC
GCAGTTCGGTGATCAGGTCATCGTCGGGCGCCAGGACCGGCAGATCGGCCCCACGCATCCGGGATTGATC
GGCGATCACCCGGGCGTCTTTGGCGTCAGTCTTGGCCTCACCGCCGCGATAGACCGCCGA
>paratb_5539
GGCCTGCCACACCGCCCGACCGCTCAGGTAACGCACCGGCGTATCGGCAGCAGCCAACGCTGTCAACAAC
AACGCCGCATATACCGTGGTCAGATCGACCGTCCAGGACACCTCCTCAGCCAGTTGGTCAATCTCGGCGA
CGAGTTCACGGATGGGTTGCTCGTCGTTGACGAGCTTGCGCGACAACACCACCGCACCGG
>paratb_5541
GTCCTCTCAAGCCGCACACTAGGCCGGCAAGACACATGCAGCCTCACCCGACCCACCCGGGTTGCAGCAC
AACGTAACAACACGAAGTAACTGCACCTACGAACTTAAGGAGGATCCATGGGCCGACTGGCCGGCAAGGT
TGCGCTCGTGACAGGTGGAGGTCGCGGCCAGGGCCGCAGCCATGCGGTGCACTTGGCCGA
>paratb_5542
TGAAGGCGCCGACCTCATCGTCGTGGACATCGGCGAGGACATTCCCAGCAATCAGTACGCACTGGCCACA
CGGGCTGACTTGGACGACACCGCGAAGCTCGTCGAGAAGGCCGGTCGCCGCGTTGTCGCCGCACAGGTGG
ATGTCCGCGACCGGGTCGGTCTGAAGGCGCTCCTCGATGAAGCGGTCACTCAACTCGGCG
>Contig16_5543

Figure 6-27

```
GCCTGCACGTCATTGTGGCTAATGCCGGAATCTGCCCGCTTGGCAACGACATTCCCGTCCAAGGCTTCGT
CGATGCCTTTGACGTCGACTTCATCGGTGTCGTCAACACCGTCCATAGCGGACTACCACACCTCAACGCC
GGTGCTTCGATCATTGTGACCGGATCAGTAGCCGGGCTGGTGCCGCAAGCTGGCGGCGTT
>Contig16_5544
AGCGGTCAGGGCGGGCTGCAGGGACCCGGCGGCGACGGTTATGGCCTGGCGAAGAAGGTGATTCGTGATT
ACACCCGGTCGCTGGCTCTGACATTGGGTCCACAGCAGATCAGAGTCAACGCGATACATCCGACAAACGT
CAACACCGAGATGCTGCACAACCCCGGCCATGTACCAAACCTTTCGTCCCGATCTAACCAA
>paratb_5545
TCCGAGTCGCGAAGACGCCGAAGTAACTTTTCCCTTCATGCAGGCCATGCCGATTCCCTACATCGATCCT
TGCGATGTGTCGCATGCCGTGGTGTATCTGGCAGCCGACGAATCGCGTTACGTCACCGGGCAGCAGCTCT
TTGTCGATGCCGGGGCTTCACTGAAGCTCGGCATGTAAGGGTTATGTCCTGGTTCGGCAT
>paratb_5546
GAGTGGAACACGACCGGCGTGGGCAATGCGGGCCTACCACGGCGATCTCGAGACTCGTCGATCCGTTGTC
CGAAGGTGATCGGGTGGCACGTATTCCAGTCGCCAAGATGGTGAAGAAGCTTTGGATCGTGCTGGTCATC
GTAGCCGTGATCGCGGTGGCGGGACTCTGTGTCTCGCGCCTACGTGCCGCCTTCGCCAAC
>paratb_5547
CGCGACGACCGGCCGATCAGCAGCGGTGCCGCTGACGACATCAAGCCGTTCAATCCCAAGCGGGTGGTCT
ACGAGGTCTACGGCCCGCCGAAGACGGTGGCCGACATCAATTATCTGGACATCAATGCCCAGCCTCAGAA
AGTCGCCAATGTGGCGCTGCCGTGGACGCTTTCGGTGATCACGACGCTTCCCTCGATGAG
>paratb_5548
CGTCAACGTTGTCGCGCAGGCAGACACCGATCAGATCGGCTGCCGGATCATCGTGAACGAAGTGGTGAAA
GACGAAAGGTCGGCTGACGGCGTGCGCGCTCAAACCTTTTGCATAGTGAAGTCGGCATGAGCATCGACCA
CTTCGGGCAGCCCCCCAAACCCCAGACGTTCGCCCGCGCGGTCCGTAGGTTTGCGGTGCC
>paratb_5550
TGGGCGACAATGCGCATCACTTCTACGATCAGATCGTCCACATGCTCGAGCAGGACCACAAGCATATCCA
GCATGTCCAGGACTTCTGGGGCGATCCGCTCACCGCAGCCGGATCGCAAAGCTCCGACGGCAAAGCCGCC
TACGTGCAGGTGTATCTCGCTGGCAATCAGGGTGAGAGCCTGGCTAACGAATCCGTCGCC
>Contig16_5551
GCGGTCCGCAAGACCGTGGGCAGTGTGCCCGCGCCGCCGGGAATCAAAGCCTATGTGACCGGCCCCGCGG
CACTGCTGGCCGATCAATCCTCGGCAGGCGAGAGGGGGTGCAGAAGGTCACGATGATCACCTTCGGGGT
GATCATCGTGATGCTGCTGTGGGTTTACCGCTCCATCGTCACCGTGCTCATTACCCTGAT
>paratb_5553
CCATGTTTCACGGGACGGCCCACGTTGTCTTGGGCTCGGGTCTGACCATCGCTGGGGCGATGTACTGCCT
CAGCTTCACCCGCCTGCCCTATTTCCAGACGCTCGGAGTGCCCTGTGCGGTCGGCATGCTCGTCGCCGTC
TTCGCCGCGCTGACTCTCGGACCGGCCGTCTTGACGGTGGGCAGCCGGTTCGGTCTGTTC
>paratb_5555
GCGGCACTTCCCCAACGCCCGGATGAATCCCGAGTTGCTGTTGGTCGAAACCGATCACGACATGCGCAAC
CCGGCGGGCATGCTGGTGCTGGACCGCATTGCTCGGGGCGTCTTCCACCTTCCCGGCGTGGCGCGCGTCC
AGGCGATCACCCGGCCGTTAGGGACTCCGATCGAGCACACCTCGATCCCATTCCAGATCA
>paratb_5556
GCATGCAGAACACGATTCAGGTGGAAAACCAGGAGTACATGAAGCAGCGGATGAAGGACATGCTGCAGCA
GGCCGACGCCATGCAGCAGACCATCGACACGATGCAGCGGATGTACAACATCACGGCCCAGCTGGTCGCC
ACCACACACCACATGACGGGCCTGACACACGAGATGACAGATATCACCAAGGAATTGCGT
>paratb_5558
GGCGCAGATGCCGCCGATGATCGCGCCCATGACGACGATGAAGACGATGATGCTGACCATGCACAGCTCG
ATGTCGTCGCTGTATGACCAGATGGACGTGATGAGCCAGAACTCGACCGCCATGGGACAGGCGTTCGATG
CGTCGAAGAACGACGACTCGTTCTACATCCCGCCGGAGGTCTTCGACAACCCCGATTTCA
>paratb_5559
```

Figure 6-28

```
AGCGGGGCCTGAAGATGTTCCTGTCGCCGGACGGGCACGCGGCCCGATTCATCATCTCCCATGAGGGGGA
CCCCGCTACCCCCGAAGGGATTTCGCACGTCGACCCGATCAAGAACGCGGCCAAGGAAGCCATCAAGGGG
ACGCCTCTGGAGGGTGCGAAGATCTGGCTAGCCGGAACGGCTGCGGTCTATAAGGACATG
>Contig16_5567
AAGGTGGCCCCGCCGGATACCACGACCGTGTCGTGGCTGCCGTTTTATCACGACTTGGGTTTAATTTTAG
GGATCTGTGCGCCGATTTTGGCCGGAGTCCGCAGTGTTTTTACTAGTCCGGTGGCCTTCTTACAGCGCCC
GGCGCGATGGATGCAGTTGCTGGCCAACAATAGTCGGGTCTTTTCGGCGGCGCCAAACTT
>Contig16_5568
CGCTTTCGACTTGGCGGCGAGAAAAACGACTGACGAGGACATGGCCGGGCTGGATTTAAGGGACGTGCTC
ATTATCCAAAGCGGCGCAGAGCGGGTGCAGCCCGCCTCGATGCGGCGATTCCAAGACCGGTTCGCGAAGT
TCAACCTCCGCGACACGGTGATACGGCCTTCCTATGGGCTCGCCGAAGCGACTGTTTACG
>paratb_5569
TCGCGACCCGCACACCGGCGCTACCGCCCCGAGTCGTCTACTTTCAGCCCGAAATCCTATCTTCCGGACA
CGCGAAGGGGTGCGAGAGCGGAAGCGGCACCGCGTTGGTCAGTTACGGTGTGCCACGGTCGCAGACGATC
CGCATCGTCGATCCCGAAACCAGCACTGAGTGCCCACCGGGAACGGTCGGCGAGATCTGG
>paratb_5570
GTGCATGGTGAGAACGTTTCGGCGGGCTATTGGCAGCGACCTCACGAGACTGAAAAGACCTTCGGCGCAA
GGCTTATTGGTCCGTCGGCCGGCACACCACAAGGGCCTTGGTTGAGGACCGGGGACTCGGGCTTCTTCTT
CGACGGCGAATTATTCATCATCGGGCGTATGAAAGATCTGTTGATTGTGTACGGACGCAA
>paratb_5571
CCATTCTCCCGACGACATCGAATCGACGGTACAAGCGATCGCACCCGGGCGGTGTGCGGCGGTAGCGGTT
CCGGCTGAGGGCACCGAAAAAGTTGTGGTAATCGTCGAATCCAAGAAACGCGGTGGCTCAGACGAGGAAG
TAATGAACAACCTCGCCGCCGTCAAACGCGAACTTACTTCGGCGATTTCGAATTCGCACG
>paratb_5572
GCCTCGCCGTGGCGGACGTCGTCCTGGTTGCGCCCGGCTCGATTCCCATCACCACCAGCGGCAAGGTCAG
GCGAGCGACGTGCGTCGAGCAGTACAAGCAGGACCAGTTCGCCCGTCTGGACGTGTAGGGTGCTCAAGAA
CCAGGCAGGTGCGCAATCGCTTTCATCTCAGCTGTTCTGCACGATGAAGTCAGCCAAACC
>paratb_5573
CATGATTGATCTGTGGCGGTCGTGATGCCTCGGGCGCGGATATATTCGCGGGTGGCGCATCCGGCGGTG
CCATTCCGGACAATCGGCTCGCGTTCACCGATCAGATGTCGTTTCTCTCGGTGCGCGCTACCGGACAGGG
GACGGTCGCTCAGTGTGTGTGGATTTATGAGCGGACCGTCGATTTCGAAGGCCTGCGACG
>paratb_5574
CTTCCACCGCAATCTGGATCTCGGGTTGTTGGGTCGACGAATAGAACGTTCTCCGCTGCCGTTCGGCCGT
GATCGGTGGGTTTCCTCTCCCCCTCCGTGGACATCGAAGTCGCTGAGGGCGCCCGTCCGCGCAGCGAGC
TCAGCGAGTGGGCTGACGAACGTGGACGACTACCTGTTAACGCCGAACGGGGTCCCGCTT
>paratb_5575
GGCATCTCGGCGTTGCGCACTTCACGGATGGCTCGACAGCGGTCAGCCTGGTTGCATCGCACTTGGTGGT
GGACGGACTCGGTTTCTGCCTGGCGATCGCGGACGCCGTCAACGGGACCGCCCGCGATCTGGGCTACCCG
CCGCCACGTTCACGCCACCGACTGCGTGCGGTGGTTCAGGATGCCTACCAAAGCGCGCGG
>paratb_5576
GGAACACATGAGGTTGCGCGAGCACTCTTCACGGCAGTGCAAGCGGGGAGTCGTCGACGCTCCGATGTTG
CGAGGGTGCGGCGGCGCGGCCCATGCCTATTCACAGAAGCAACCCGGACGACGGCGTGATGGCACCGGC
CATTACGATCTATATCGATCCGGATGAGTGGGATGCCCGAGCAAAATCACTTGGTGGAAC
>paratb_5577
GAGTAATTCACTCTTCGCGGGTGTCGCCGCGAAGCTCGCTGAGCACTCTGGATGCCGGTCTGCCGATGAC
GGCACCGTGGCGATATCGTTCCCGGTTAGCGACCGTACCGAGGATGACATGCGTGCTAACGCATTGTCGT
TTGTGATCGTCATAGTCGATCCAGCACAGGCAACAACGGATTTGCGCGGTATCCGAGGCG
>paratb_5578
```

Figure 6-29

```
CGATAAGCCAGGCGCTTCAGACCCTGCAGGAAAACCCAGAGGAACTCTTGCAGGTGCTTCCGCTGGCCCC
GCTGACGCCGAAACGGGTGATGAGAAAGTTGGCCCACGTGGCGTACGGCTACACCGACGTGGGGTGCTCG
GCCATTGGCGAACTCGATCCGGCGGTGGGACGACCCGATGGTACCGACGCAGACCATGTC
>paratb_5579
TTCATTCGTGGAGTACGGCAACGCTTTACGCGTCAAAACTTCGATCGCCCCCGCGGCATCTTCATGGTCT
CGGGGCGGATCCGCGGACGAATGTTCATCACCATCGTGGCCTATCAGCTCGAGGGCAGGGATTCGAAGCA
TCACCTGCATGAGCTGGTGGCGCAAACGCTTTCGGAGTTCGACCTGACGGGAACGATTGA
>paratb_5580
CTAATCCTTTTCGAGAATGTACATCCGGTATGAATTGGCCTGACCCCGATCGGTTGATCCATCGCTTATG
AGCGTCTTGTGGCCCAACGAGATGGGCAGGAAAGCTCAACACGGTCATGGCGACGAGGAAGCGGCACACT
CCTGAGCAGATTGTGCGTAAGCTGACGGCAGCTCGGCTGCGGGCTGCGGGTAATGAGACC
>paratb_5581
GCGGCGGTATGCCGCGAGTTGGGTGTGTCGGAGGTGACGTATCACTGCTGGCGTAATCAGTTCGGCGGAC
TCAAGGCCGAGGACGCCAAACGGCTCAAGGATTCGAACGCGAGAACGCCACCCTCAATGGGCTCTGGTTA
ATGCGACGTTAGAGAAGGACGCGCTGCGGGAGAGAGCACACCAGATGATCCAGACGTCGC
>paratb_5582
GTTGCGGACCTGCCTACGCCAGTACGCCAAAGATCATCCCCGCCGCAGATTCCGCTCCGCCTACCACGAT
GCGCGCGCCGAGGGCTGGGCCGTCAACCACAAGAAGCTCCAACGGCGTTGGCGCGATGAAGGCCTGCGTG
TGCCACAGCGACGACGCACGGCATATCAACAGCGCTACCCACGGTCGTCGCGGATGCGCC
>paratb_5583
CGACCAGGCGTGAGCGGTGGACTTCCAATTCGACGTCAGTATCGATGGCCGGCCAATCAAGATCGTCTCA
ATCGTCGACGAGCACACCCGCGAATGCCTCGCGGGAATGGTCGAGCGCAGCATCACCGGTGAGCATCTGA
TTGCCGAGCTGGACCAGCTGGCCGTTCAGCACGGCACCTATCCCGGGTGCTGCGGTGCAA
>paratb_5584
CAATGCCCCCTGAATTAGCGTGCAGCGCAATAGCTGGCTGGGCCAGCGGCCAAATTGGCCCGGGTAGCCA
TCAGCGACTGGAAACACGACTACAACCACCACCGCCGACACTCGGTCCTGGGCATTGGTGTGGCATGGCG
CGGGATCCGATAATTCTCGATCAGGCAACGCCGCCCGGACGCCAGCCGAGTTGCAACAAG
>paratb_5585
AGGCCTAGGTCGTCGCGGATGGCGCGGTGGTGGGTGATTTGGCCGTCGGTGATGGTGAAGATGTGAACTT
GTTTGTGTTCGATGTGTTTGCCGGTAGGTTGGATGCCGTTGAAAATACCGGTATGTTCGCCGGTCATCGT
GCTCACCGCGATGACCGTGTTGCCTTCGGCGAGCGTTTCTTGATGCTCGAAGCTCAGGTT
>paratb_5586
GGAGAAGGCGTTGCGCAACCATTGGCTGGTGGCCAGGAACCCTGCCGCGCCGTGTTGTTGGCGTTCGACC
TCCTCAGGGTCGTCATCGGCTTCTTGATTGACGAAGTCGGAAGCGATGATTTTCTCCGCCAGTTCGACGT
CGCCGTTTTCAATCAATCGAAAAGATTCCAGTGCAACGGTTTTGGTGTCAGACATCGGCT
>paratb_5587
TTGGCCTTCCTTGATATTGGTTGGGTTAACTTTGTGCGGAGTACAGCTTGCCGCGGCCAGGTCAGTAGTT
TGATCAGTTGGCTGAAGTCATAGCCCTGTTCTGTGGGCCGCATCTGGACGATGAGGACCCTGGCCCCTGC
GGCTACATATTCGTCGGCGGATTTGTCATCGAACCAGGGCACCGCTCGGGTGATGGCGGT
>paratb_5588
GCCGTCTCGGCCGTTGTGTTGCGCGAGATCGTCCAGCAGTTGACTTTTGATGCGGAACTGTTCGATCGGC
AGGAAGGTGTGCCAGATGTCAGCGTGGCGGGCGACTCTCGGGAGGGTTTTCTTTTCACCCGAGCTGCCGA
TCAGGATGGGTATTGGGTGCAGCGGTGGCGGTTTTAGTTGCGCGAGACGGTATTTGATGC
>paratb_5589
GCGCAAGGCTGGCGTCGAAGAGCGACATGCGGGATGCGACAGTACCGAATTCGTATCCGTAGGTGGCATA
GTCCTTTTCGTACCGGCCAGCGCCCAAACCCAAGATGAGTCGTCCGTTGCTGATGTGGTCGACGGTGCGG
GCCATGTCTGCCAGCAGGTCGGGGTTGCGGTAGCCGACTCCGGTAACCAGCAACCCGATC
>paratb_5590
```

Figure 6-30

TGGGCTCGGTTGATGATTTCACCCCAGGACGCAAGGGCGCTCCAACCCTCAAAGTGGTTCACCTCGGGCT
GATGTGGGGACAACACGGGGCCGGCATCGGTGGCCTTGTCAAAAACCGGTTCGTGAAAATGGTCGTATCC
AAAGATCAGGTCGGCCCCCATACATTCGGCTTGGATGACCGCGGCACGCCAGGTCCGGTA
>paratb_5591
GTTCGGGGTCCCGGCCGGCTGGATCTGAACACCAACGGAGGAGATCATTGCCCGCCACCCGGCTGTCGAT
CCCGCGAGGGTTGCAGTCGGTGGGTGATCCAGTCGAGGATGATTGACTGGGTATCTGCCGTGTAGCCCAT
GTGCCCGGTGGCAAAGAACCGCGCCGATTTGGGGGACCCGTGCTCGAGCAGCAGGTAGTA
>paratb_5592
GTCGCTGATCGGGAATACGGTGTCGTGTAGCCCGTTGATGAGCAGCGTCTCAGCGCAGGGCCGGTCCAGG
ATACCTTGGCGTACAAGGGACAGCTTCGGCGCGTAGTCCACCCATTGCTCGAAGGTGTCGCGCCCAAATG
CATAGGCGAGGGTCTCGGCCAGCTCGAAGGGGTACTCGCCTGATTGGGCCTGCTCGATCC
>paratb_5593
ACTCGGCGTCAAAGCCATGGTCGATGCAGCCGCCTTGGCTGACCACACAGGCGAGGGAGTTCCGGTGGGT
GTGGGCGATTTTGGCCGCCCAGTAGCCACCGGTACTACCACCCCAATAGCCCACACCCGCCGGGTCGAGT
TCGGGTCGCCCGGCGATCCACTCCAACACGGGGGTGAACATTCGCTCGGCGTCCTCCGAA
>paratb_5594
CCAGCCAGCGGAGCATCACCGACCCCGGGGATGTCGATCGCCAATGTTGCGACGTTCCGGGCGAGCACCT
GATCGGTGTGCATGTCTTCCTTGAAGGTGTCGATCCCGCCCGAGACGAGCAATACAGGCAGCCGGTCCGT
CGCCTTCGGGACACGCAGATGGGCGATGATGCGGTCACCCTCCCCGGGCCGCCCGGCGAA
>paratb_5595
CGGGATCTCGACACGCTCGATGGGGATGTCGAAGTACCGGGATGCGCGCAGCAACATTTCCTGCGACTTG
CGGTAGGCGCTCTTCTTACCGGCCGAATTCATCGTCGGGTAGCGGGCCATGCGGTAGTAGCCATAGGCGC
GCAAATAGTTTTCGTGTGCCACACTGGTGTCGCCAATCTGTTCGGCCTCTTCGGCTCGGG
>paratb_5596
CCTGATAGCGTGCGGCCACGGCACTGAACGCGGCCGCCCAGGCGTCGCGATCATAGGAGTTCAGGCCGCT
CAACACGCCCTGCACATCATCGGCGAGCGTGTACTGAAACGGATAAATTCCCGCCGTGGCCGAGACCGCC
ATAGCGGCCATAGCTCGGTCACCGGTCGCGTGTCGCTTCACACGGCCAAGTTATGACC
>paratb_5597
GCTCGCGGCTGCAGATATTGGAGAAAACGGACATCTCACGCGTGCCGTGGGCGAGCCGCACCGGGAAGTT
CTGTGGGAGCCGCTCCAGCCAGTGCCAGGCATTCGCTGATCAGGTGGGACTGATCGGCGTAACCCGCCTC
GATCGCTAGATCGGCCCACCGGATTCGGTGATCACCGGCATGGATCAAATCCAGCAGCCG
>paratb_5598
CTGGAACCGGAAAATCCGGCCAAGCCGCTTGGGGCCGAAGCCGACCGCGGCGTCGAACCGACGGCGAAGC
TGCCGCTCGCTCAACCCAACAGAGGAGGCGACATCCGAAACAGAGCGGGCCGGGTGGACACGCAGCATCT
CGATTGAGTGCGCCACTGGCTGATCGACCACGGGATCGATCTTGACCACATACCGCGCCA
>paratb_5599
GCACCGCCGCCAATAATGCGACCCGTTGCCGAAAAGCGTTGGCCTCCAGCACATCCTCAGCCAATCCGGA
CGCGGATGTCCCGAACACCGAGTCAACCCGGATCTGGGTATCTCTTAACTCGCTGACAGGATGGCCCAGC
ACCGCGGCGGCAGCACCCGGTCGTAACCGCAGACCGATCATCGCACCTTCGGTGCCCGCA
>paratb_5600
CATTGGTCGTAAAAGGTTGTGGCCGGACCAGAAACCATGACTGCGCCCTCGGCGGTGACGAACAGATCGA
CGCAACCGTCCGGCATCACCCGCAGCGCCCCACCCGCGGTATTCGAGCGCACCCAGCCACAGTCCACATA
CGGCGCGAGCGCACCCAAAGGTCGACACTCCAAATACCCGACCATCACGCTCACATTCAG
>Contig16_5601
CCAGGTCCTACGTCGCTCCGCAACAAATTGGGCCGCAATCCTTCGAAGCCGCCCGGTCAGCGCAGACTCC
CAGGCGGCAATACTCGTGAACCGTAAACTGCGGCGTAGAGGAAATGCCCGCCAGGGCGCAACACCCGCGC
CACTTCGGCGAGAAAGCGTGACAGGGAGGTTGTGCCCCGTGAAGTGGTGTAAAGCCGATC
>paratb_5609

Figure 6-31

```
TTGGCCGAGGATTCGATATTGAGCACCGCATCGAACGACTCGTCGGGGAAGGACAGATTTTGGGCGTCAC
CTCGCACAAAATCGAGTCCAGGCACGATGTGCCGTTTTCGGCAGAAGGCGATACCGGCCTGATTTAAGTC
GACCCCCGTGTACGAGGCGGGCCGCATGGTGCGCGTGAGATATGAGGCCCCGCCGCCGTT
>paratb_5610
GCCGCAGCCAACTTCCAGCACCCGCCTGCCGCTGAGATCCGCCTGAGCCGCCGTGCGGTGGTAGAGCTGG
ATGCAGTACCGATTGCGCTCGTCGGCGGCATCGAGCGGCAAGGACATCGGCGGGTCTTCCTCGTATCAAA
TTGAGGAAGACAACGTCATCGCGGCTGAGTCGACGACTGAGCAACGAGTAACCATACTTC
>paratb_5611
TGGTACTTCTGCTGATACCTCTGTTGAAACTTCTGACCGAGCTTGAAGAGGACTGGGTAACCTTTCGGCT
GCTTGGATGCTGAAGGCATTAGGCGCCACCCAGCCCGGCAGCCACCATCCAGACCGCCTCCGCAGCAACG
ACGACGGCCAGGAGCTGCCAGCGGCGGGGCAGCACCCAATCGTGTATTCGCTGCATGACC
>Contig16_5612
GCTTGGGTTTGCGCCGGTGACGCCGAGTAGCTGACGAGGGGGATCTCTATGACCAAAAGCATTACGACTG
TGAACATGACAGCGGCGCTGAACTGCACGCCGACGGAGTTGCCCGACGCCGCGATGGCCGCGAGTGCAAT
CGGATACTCGACCGCTGGAAATCCAGAGCCGAGGCCGAGTATAAACGCCACAGACAGGCC
>paratb_5613
GTCGCTGGTCAGTACATCCCTGATGCGGCCGCGAAGCCGCGCCAACGTGCTCGGCGTGTTCGGCCGCGGC
AGCCCGGCGCGACGATCGACGCTGGCACTCGTTACCCGTGTCGGCCGGACCGAAGAGCTGACGGCGACCA
ATGCCGTGATCGCGAGAATGACCAGACCGATTGCGATTTGAGTGTGTCTGGCATCAGGAG
>paratb_5614
TTGCGGACAGGGCGGACACGGATTGCATCAACGTCGGTGCGAAAGAGTGCACCACCGTCAGAACACCCAC
CCCTGCGGTGATCGCCGTTGCCATGGCGCCAAGCCAAAACGCGAGCAGGTTGAGCACGGGTCGTGACCGC
GAAATCAAGAGAAGAGCGATGCCCAGACGCACCGGGTTGGTCGCCGCGATTAGCGCCATC
>paratb_5615
GCGATAACGGTATCCATCGGCTATGTCGTCTCCCCGCGAGCGGCATTCTCCAGAAGATCGGCGGCCACCG
CTGCGCTATCGGAGGATTTCGTCATCCTTTTGGCTACTTCGCGGGCCCGAGTCATGTAGTGAGGCCTGAG
GATCGAGCGCAGGCACGTGGCCAGCGATTCCTCCGTTGTCTTCGAGAAACGTTGACTAGA
>paratb_5616
ACCGACTTTCATCTGCTTGACGGCAGCTCCCCAGAGCGGCTGCTCGTTCCTCATCCAAAGGACCAACGTG
GGGACTCCGGCTCGCATGCCCGCGGCGGTGGTACCGGCGCCGCCGTGGTGGACGACAGCGCGACAGGCGG
GAAAAATGGCCGCGTGGTTCATCGCCGCCACGATCTTGACGTGGCCGGAGCGCGGGACGT
>paratb_5617
GGGTTAAGTCATTGGTGCCTGCGCAAATCAACGCTCGCTCATCCAGTCGCGTGCAGGCCGCGCTGATCAT
TGCGACGGTGTCGGCTGGTGATTTGACCGGTAGGCTCCCGAAGCCGAAATAGACGGGCGGTGATCCGGCG
GCAATCCACGACAAGACTTCGGCATCGGCGTCCGTCGGTAACCCCAGCGTCAGCGCGCCG
>Contig16_5618
ACGAAGGGCCGTTGACCATCCCAGTGCGCCCATTCGGCTGCTAGCCCGGGAAAGAGAAAATCCTCGTATG
CCTGGATCTCCAGAGACTTACGCCCCACGATGCGGCGCGTCGAGGAACCGCTCGCCTTCGACAGACCCAA
TCGCCGGCGCTGGCTCTCCTCGGCCTTGTTCGTCACGCACCAGTACCCGCACCAGAAGGC
>Contig16_5619
CGAAACCGCTAAGCGGCTCAACGGCGACGGAACGTTCGGGAGAAGCCGGCCGTTGACCCGGGCCGGCAGA
CAATGCAACGTGGCGAGCGGGATGTCGCAGTATTCGGCGACATTGGCAGCAAGTCCCTGCTGCGCCACGG
CAGTCAACAATAGATCGGCCCCGTTCGCCAGTGATGTCAGCGTCTCCCCATCTCCAGCC
>paratb_5620
AGATTCGGCCGAAGTACTCCTTCGATGTGGACAGCAGTTTGATCGGATTCGTCTTCTTACCAAACAGCAC
GTCCCGCGTGTCCGGCCCATAGTCGATCGCGGTAACACCGGCCGACTCGACGAAGCCACGCAGGTCGGGC
GGGGCTGCAACACAAACTTCGTGTCCCCGACGCAACAGCTCTCGGGCGATTGCGGCATGG
>paratb_5621
```

Figure 6-32

```
GGCTCGACATCGCCGCGAGAGCCGTAGACGGCCAAAGCGAATTTCATCTGCGGGTCCTTGGCATCAGCCG
AAAGGCTGTGCCACTCGTTGCATGGGGTGCGACCAATTGGAACCGGCCCATTCGTTGCGTGCCTCACGTC
GAGAACCCAACTGCGGATGCATCGCAGCGTGGTTGAGGTGAGACTCCACCGGGTCGCCGC
>paratb_5622
CATCTACGACACGGGCGTACACCGATTTCATCACTGCCAGGTAGCGGGTCACGGATTGGCGGGCGATCGG
ATTGTTCGGGAACAACACGATCACTTGGGTTTCGCTCTCAAGCCGATTTACCCGGATGGCGACCTGAGAC
GGAATCCTGCCGTCGTGGTAGAGCCTGGCATTCGCACCGTCCAAGTGCGAATTGACGAGA
>paratb_5623
GCGGATAGGGGAGGCACGCCGGCGTCGAGGAAAAACAGCAAAGGAGCACCCCGCTGAGGCATCCGCAGCC
ACGGCGCCATCTCCACGACGCGCTCGGCGGGAACGTTCGCAAGGTCTTTGTTCGAATCGAAGGACGCCTG
TGCGGTGCGGACGATGTCGCTGAAGGAACCGGCGACAGAGACGGTGAGCGGCACAAAGCC
>paratb_5624
GACAAACCAACCCGTTGTCGCAAGTTCGTCCTGAGAGCGACGAATGTCGACGGGAATGACTCCGTAATAC
GTTTCGGTGCCGGTCAATTCGTGTTCTACGAGAGCGGCGCAGGCAAACACACCGCCACTGAATCGCGCGC
CCGCCGCCAGGCAAACGGATTCGAACCGGGCAGTCTGTCGCTCGTCGAGCAATTGCACGC
>paratb_5625
TCAACATGTCGCAGGGGACCGGCCCATCACCGAGCGGCAGAGGGAATGCCGGCAGGGTGCCGTTGTTGTC
TTCGAAGAATTCGACCCAGCCGCGCACTTCCGGGGACTCCAAGGTCAGTGCGTCCAACTCGCGATGTTGT
CGGACGCAGTAGTCGTCGTAGCTGCCTGCCGTCGCCAGCGTGAGCGGCGCTCTGCCCGCC
>paratb_5626
ACCAAAGCGCGGTACATCAAGTGGATCTCCGCGAATCCCACGCCGACAAACATCGCGTCGATGTGGAGAT
GATCAACGCACAAGCAGATCGTGAAGTGGTCCGCGCGCTGAATCACGATGAAGCGGAAAGAATCCCAGCA
CAGCGGATTCGGTGTATCCAGGACAAGGTCCCGTACTTCGTCCGAAGTCATCTCACCGTG
>paratb_5627
CTCGATCGGGGTGAACTTGATACTGGCGGGGTCGTCGATTGTCCGCCGGGCGATGCGCCCCCGTCCTCG
ACCTCGAACCAACTGTGGTAGGTGTCGTGACGGCGTAGGTGCGCGTTGATGACGTGCGTCATGACACGGA
TATCGCAACGGCCGGGTATGTCCCAGCCTGCAGTCAGCAGACGTGACATATCGATGCCGC
>paratb_5628
GAGCTGCATTTTCGCGGAAGCGACGGAGGTGCTGAGCCTGCTGATAGCTCGCGGGTACCGCGCTGTTCGG
CGCGTGTCGGGCCTTATCGAGCGACGCCGGCGACGCCTGCCAACTGACGACGGAACCCGCAGCGGGCAAC
CACTCGTGAATCGGTCCCACTTCTACTTTCCCTACGAGAACCACGATTCCTCCCCTACGC
>paratb_5629
AGCGGCGGCTGCGGCTATTGGCGGATGGTGCGATGTCATTCGGCCCGGACTTGTGATGTTGGTGCGGCCT
CTGCCAGCGTGTCGCAGAGGTGGGCGGCGAGACCTCGAACGGTCGTGATGGCGGTCGACTTGATCCGCAC
CCCTGCTTCGGCCTCGATCCGCGTACGTAGTTCGAGATTGCCCAGCGAGTCGAGGCCGTA
>paratb_5630
CTCCGAGAGTGGACGGTCGGGATCAACGGTGCGACGCAGGATCAAGCTCACCTGCTCGGAGACCAGACGC
CGGAGCCGGGTGGGCCACTGATCGTGGGTAATGTATTCAGCTCGGCAAGGAATCTGGTTGTGCCCGTTG
GGCTTTTCCCCGTGGATCGGAATGCTTCAGCGAACCGACTGCGCTCCGCAAACGCGCTCA
>paratb_5631
ACCATGCCGTATCGATCACGGGTGCGTAGCCGGTGTATGCGCGGTCGTGACACAGCAGCGCCTGGAACGC
GTAAGCGCCCTCGTCGGGAGTGATGGCGGTGCCTACGTCTTCCGCGAAGCCCGTTGCGCGTCCGAGCTCT
GACCAGGCACCCCACGCGATCGCGGTCGCGGGAAGGCCCTGGGCGCGCCGCCAGTGGGTG
>paratb_5633
GACCACCCCGGCGGCGTGGAGCACGCCGCGTACCGGCAGCCCGGTGGTCGTGGCGGCCGCCACCAACCGC
TCTGCCGTGCCCGGCTGGGTGATATCGGCGCACTCCACGACGACGTCCGATCCGATCGCCCGGACTAATT
CGATCATCTCCTGGACTCGCTGATTCGGCTCGGAGCGCGAGCTGAGCACGATGCGGCCAC
>paratb_5634
```

Figure 6-33

```
AACCCGCCGCGGCGAGTTTCTCGGCGAGGAACAGCCCGATGCCGCCCAGGCCGCCCGTGATGATGTAGGA
ACCGTCGGGCCGGAATACCCGACCGCTGTCCGGGTGCAGGACCGCGCTACTTTTCCCGCTACGGGCAACG
TCGAGGACAAGCTTGCCGGTGTGTTCGGCGGCGCTCATCACCCGGATGGCGGTGGCCGCA
>paratb_5635
TCGGTCAGCGGGTAATGCGTGCTTGCGGGCATCGGCAGTAGGCCGTCTGCGACGCGTTCGTACGCCGTGT
CCAGCAATTCCCGCACTCGCAACGGATGGTCGACCGACATCAGACCCAGGTCGACGCCGTAAAACGCCAG
GTTGCGACGGAACGGGAACAGCCCCAGCTTGGTGTCGCCGTAGATGTCGCGTTTGCCGAT
>paratb_5639
CGCGGTGACTGCAACCTCGATTTGCCCTGGGCCAGGCGGGATTCGTTCGCATGCAACGAGTTCCATTGTC
TGGAGATCGCCCGGGGCCCGGATGTGCAGGCGCATGCCATCGTGCTCGTGATCGACGACGGCTGTTCTCC
GTTCGTCCGGGCGTAACGGGCTCAGCCGCAACCGCGCCGTCAGCCACTCATCATTCCGCC
>paratb_5640
AGGCCGTTTCGTCTTCTTCCGACCCACTCACCAGCTGCCGCGCGATCAGGCTGGCGCCCGTGTGCATGTC
GGTGTCGATCTGGGTGGTACGAAATTGCGGATATTCGTTCCCGATCACCCGTAGCAGGCCGCGCAGGCCG
CCTTGCTCGAGATTGGCGCCGTCGCCCTCCAGCACCGTCTGAGCGTTCCTGGTGACGACG
>paratb_5641
TATAGTCGCGGTGGCTCGCCGGGTGCGGCCGCCAACTCGCGGACGATGTGCGCCACATGACGGACGTACT
CGCCGCCACGGGCGGCGCACTCGTCGTCCCGATCGCCATCCTTCGGGCCGGTGAGCAGGACCACGCCCGT
GAACCGGCCGACGCGCAGCTGATCCCGCAGCGTCTTGCCATTGGCAACAGGGTCGGCGCG
>paratb_5642
CGACGACCAGCGGATGCTCGTGCAATCCGCACCTAGCAGTTTTAACGAGTCGGTCAACTCGGTGGCCGCG
ACATCCGCCATCGCAGAGGTGCTGACCAGCAGCCATGTGCCAGCGTCGACGGGATCCACCTCGGTCAGCT
CTTGCCGATGCCATTCGACGGTCAACAGTCGCTCGTTCAGCGCGCGATCGCGGCTCGCTT
>paratb_5643
CCTCGGAGGCCCCAGTGCCCATTTGCAGTCCCTGGATGCTCAGCAGAACGGCTCCATGCTCGTTCAGCAC
GTCGAGATCGGCCTCGAACCCCGTCGCAGTGGTACTGGTTACCCGGGTGTAGCAGTAATGAGCGGTCCGG
GCGGACGCGTAGGCGCGGATGCGGCGCACACCCAGCGGCAGGAGCAAACTGCCGCCGCCG
>paratb_5644
GAATTCTGGATCTCGGACGCCGCCCCAACCGACTGGAAACACGCATCCAAGAGCGCGGGGTGAATCCGAT
AGGCACGCTGCTGCGAACGCATAGCCCCAGGCAACGCGACCTCGGCCAAGACTGTGTCCCCCGAGGTGTG
CGCCGCCGTCAGTCCGGTGAACGCGGGGCCGTATTGCACACCACGTTCGGCGAACCGGTT
>paratb_5645
CCGCAACTCGGCGCCGTCGACGCTGGATGAACGAGCCGCAAGTAGAGCGGGAACGTCGTACGCGGGCGGT
CGCTCGCCAGGCCCCGCTGCGGCCAGGATCGCGGTGGCCCGCCGAACCCGTTCGCCCTCTTCGAAGGTCT
CCACCACGAACTCGGCGGCGCTCCGCGAGGCCATGACTGCCAGCGCGAACACCGGGGTCT
>paratb_5646
CATCCTCGATCAGCAACATCTGGTCGAAGCGGAGGTCGCGTACTTCGGACGCGTCCCCAAGTGCGGTGTG
CGCCGCAGTCAGAGCTATCTCGCAGTAGGCCGCTGCTGGAAGAGCTGCCACTTCGTGTATCCGGTGATCG
GCCAGCCAGCGCAGCGTCGCGGTTCCGACCTCGGCCTGCCACGCGTGGCGCTCCGGCTCC
>paratb_5647
TCGGGCAGGCGCACATGGGAGCCCAACAGCGGATGCACGGCGACGGTTGGTCCAGCCTGCGGCTGGGTGT
CCCGGCTGTCGAGGCCGAGGAGCAGGTGACGGTGCGTCCATGCCGGCAGCGGTACATCCAGCAGGCGACC
GTCGGGGTACAACATCGAGAAATCCACGGCGGCACCGACGCTGTGCACCTCGGCCAGCAG
>Contig16_5648
ATCGCGCATCCCGTGCGGCAGTGCCTGTTCGCGCCGCATCGCGGCCAGAGCGGCGGCCGGCGTATCGAGG
CTGGCGGCGGTTTGCTCGATGGCGTAGGTCAGCAGTGGGTGTGGCGAGAGCTCGACGAACACGCGATGCC
CATCTTCCAGCGCCGCCTGCACCGCGGCGCCGAACCGCACGGTGTGACGCAGATTGTCCA
>paratb_5649
```

Figure 6-34

```
GCCAATAATCGGCATCGCAGAGCGGCTGCTCGCGTGGGTCGAACAGGCTGGCAGAATAGAACGGCACCTC
GGGCGCCGTGGGCTCGAGTTCGACCAGGGCGTCGGCGAGTTCGTCGAGGATCGGATCGACCTGCGGAGAG
TGCGAGGCGACGTCGACGGCGATCTCGCGGGCGAGCACGTCGCGCTCCTCCCACGCGGCG
>paratb_5650
ACCAGCTCCCGGACCGTCGATGTCACGCCGCCTATCACGGTGGACGTCGGTGAGGCCATCACCGAGACCA
CGACGTCGTCGATTCCTCGGGCCATCAGCTCCGAAAGCACTTGCTGTGCAGGCAATTCCACCGAGGCCAT
CGCGCCGGCGCCGGCGATGCGCGACATCAGCCGGGAACGGCGACAAATGACACGCACCCC
>paratb_5652
ATTCGCGCGCTATCAGCGGCTCGACTTCTGCCACGGTGGTTGCAAAGACCGGTTCGTTCGCCAGCAGCTC
AGCACCCATCTGCGTCCATTGCGAGCCCTGCCCGGAGAACACCCACACCGGGCCGCAGTCGTCACGTCCG
AACGCAGCCAGATAGGAAGTCCGGCTGTCGGCGACCTCATGCAGACCCGCGGCCAGCTCG
>paratb_5653
TCGACACTGCCGGCGATGACCGCGGTGCGCACGGGACGATGGGCACGCCGCCGCGCCAGCGTATAGGCGA
GATCCGACAGCTCGACAGAGGCCGCACGCTCTTTCACCCAGCCCGCCAGGCGCTTAGCCGTTTCCCGCAG
CCCCTCATCGGAGCTTGATGACACGGTGAACAACAGTGGACCCGCTGGTGTGGGTTTGAC
>Contig16_5654
GCCTCCGCTTGCATTGGGGGCTTGCTCAACGATGGCGTGGGCGTTGGTTCCCGACACGCCGTAGGACGAC
ACCGCCGCCCGCCGGGGCTGCTGGAGCTTGCGGGGCCATGGCGTGTTGTCCTGTGGCACAAAGAGGTTGG
TGTTGAGTTGGCCTATTTTATCGGGCAGGCGAGTAAAGTGCAGATTTTGCGGGACCACAC
>Contig16_5657
CGCGGCGTCGAAGGCGCGACAGCGACCGGTCGCGGACAACATTCCCTGCGCCGAACCTGCGGCGAGTTTC
CGGGGTTCCAGCAGTACCGTGGCACCGCCCGCCAGCGCGAGGTCGCTTTCACCGTGGTGCAGGCTGCGGC
ACGCCACATGCACCGAGACCAGCCCGGACGAGCATGCGGTATCGACCGTCAACGCCGGTC
>paratb_5658
CGTGCAGACCCAGCGTGTGCGCGATCCGCCCGGACGCCACAGCGAAACTGTTGCCCATGAACCCGTACGG
CTGATCCAGCGCGCCGGCATCGGCTGTCCGCAGTGTGTGGTCGTCGTGCATCAACCCGACGAACACACCG
GTCCTCGAGCCGGTCAAGGCGGCCGGATTAATGCCCGCATGTTCGAGGGCCTCCCACGAC
>paratb_5660
ACCGCGCAACAACGCCGCCCACAACGCGTCGGGGGAATCGATCGCTCCGGGCAGCCGACAGGCCATACCG
ATGACAGCAACCGGGGTCGCGCTTTCGTCCATCGTCGTTCCTCGTCTGAGCGGGTGCGTCACCTATCTGG
TGTCTCCCCGCTCCCGATCACCGGCTCGTCGGATGCAGTACTGGATGGCCGGGGGTGTCT
>paratb_5661
CCAGAGTCCTGATGCGCCTTCAACGCCATCCGATATGTTGAGTGCGGGTGGAGCTTTCCGCAGGTCAGCG
GCCTCGCAGAAGCTTACTGAAAATGATTGTTATTATCAACCAAGTGCGAGACTGGCGGTCTCAGTGCGGA
GATGGACCGCTTGCGGAGCTGTTTGCGGAGGCCCATGTCAGGGCATCGCTGCGCACGGAT
>paratb_5662
CCCACGACCAGTTGTTAACGAAAATCGTTTTCAGTAAACTTGCATGAAATCAGCCCCAATTTCGAAAACG
AGGAGCTTTCGTGATGGCTTTGCGGCTCCTGCTTGAAGGCCTTGCCACCGCGGCGTCGTACACGTTGGCG
GGCGGTCGGCGATGACGGCGCCGATCTGGATGGCTTCCCGCCAGAAGTGCACTCGGCGC
>Contig16_5663
TGCTGAGCAGCGGTCCGGGGCCGGGCTCCTTGCTGGCGGCGGCGGGGGCGTGGAACTCGTTGAGTGCCGA
ATACGCTTCGACGGCCGAGGAACTCAGCGCCGTCCTTGCGTCGGCCCAGGCCGGCGCGTGGGGGGGGCCG
AGCGCGGAATCGTACGTAGCCGCGCATGCCCCGTACCTGGCGTGGTTAACACAGGCAGT
>Contig16_5665
GGCCGCCACGATGTCCACCTATCAAGCAGTCTCCACCGCGGCCGTCGCCGCGACACCGCCAACCGATCCA
GCGCCACCGATCGTGAAATCCGCTGCGTTAAGCGATGATTCAGATGACTCGGGTGACGTCGATCATGACC
CCAAAATCGACAATTGGCTGGACGAACTCATTGCAAGGTTCCTGAAGCAACTGGGCATAA
>Contig16_5667
```

Figure 6-35

```
CTCGAGATTCTGACCACCGCGCCGCAGCTGTTGGCCCCCGCGCTCCTCCTCGCGGTTGCCCCCTTCGGCG
CCATCGGCGGATTCGCCGGGCTGGCTGGCCTGGCCGCCATACCCCACCCCGCGGTCGTCCCGGCGACGGT
CGCGGCACCGCCGCCGGCGCCCACGCCGAGCATCCCTCCGGCCATCGCCATGGCCCCGAC
>paratb_5669
AGGCACCCGAACCCGATAGCGCTGCGGCGGCCGCCGCAGCGTCGGCGCGCGAGGCTGCGCGAGCGCGACG
GCGCCAGCGGCAGCGGCAACGCGGATTTGGTGATGAGTATATGGATATGAACGTCGATGTCGATCCGGAT
TGGGGCGGGCCGCACCCTGGCCGCGAGTCGGTGGCGTCGGATCAGGGAGCCCGCAATGTC
>paratb_5679
GCTTCGGGTCGAGGGGCACGTCACGTCTGCACCGCGACAACCGAATTCGGCGCCGATTCCGACACTGCAG
GCTACCGTAGTGTCACGCATCGACGCCCCGCCCAACCCGTACGCGTACCCGCACTGAGGGCCCACGCATA
TGCGACTGGACGGTTACGTCAATTGACCCACCGGGAAGGAGGGCAAATGCCGGATGCTGG
>paratb_5681
CGCGGTGTCCTTGTAGTCCACGGTGCGCAACCCGAGGCTGTCGAGAAGATTCTTCTTACGCGCCCGGCCG
GCCAAAGGAGCCGGCCTGCGCGTCCGCGCAGGTTTCTTGGGCATTACCAGCTCGCCTTCCGCACGCCCGG
GAGCTGTCCGGCGTGTGCCAGTTCGCGGACCCGGACCCTCGACAACCCGAATTTGCGGAG
>paratb_5682
GTGGCCGCGTGGTCGCCCGTCGACGGCGTCGCGGTTGCGCACCCGCACCGCGCTGGCGTCCCGGGGCTGG
TGTGCCAGCTCGTTTTGCGCCGCCGTTCGTTGCTCGGGGGTGCTCCGCGGCGAGCGGATGATCTCTTTGA
GCTCAGCGCGGCGTTCGGCGTAGCGCGCGACGGTCGCACGCCGGCGGTCGTTTTTGACGA
>Contig16_5686
TGCCGGGGACGCTGGTCGTCGAGCACCGTATGGAGGGTCATGTGGTGCTTCGAACGACGGTGATGCTGCA
GCATGGCGTGTTGACGACCGCCGAAAGTGCGCTCGAATTGGCGCACGGATGCGTGTCGTGCACCATCCGT
AATGATCTGCTGGTCCTGTTGCGGCAACTGCATCGTCGAGCCGAGGTCGAACGGATCGTG
>paratb_5688
GCAAGTCGTTGTCGGACAGGCCGAGTTCGCCGACGTGCTCGTGCTCAACCGCGCCGACCCCTTCACGGCC
GCCGCGCTGCGCCGCCTGGCGCCGCGCGCGTATTCAAGTGGGTGCCAATGGCATCGGGGATACGCTGA
ACAATCTTTATCGCGACGCGCGGCAGGGGCGAAGCGACGATCCACACGATCCGCTGCTGT
>Contig16_5690
AGCTCGGCCGGCAAGTGGCTCGCTGCCCTCGCGCCGTCCGAGCTGGCCCATATCGATCCGGGACGACGTG
CCTTCGCCGAGCTGGAATGGGACGCCGACCATGGGGACCGGCACACCGCTATGACCATCCTGGTGTGCGG
TGCGAACGCCAGCGACATTCTTGACGCTCTCAACGGCGCACTTCTCACTGACCGCGAGTT
>paratb_5691
CGCCTCTCGCCCCTGGGTTTTCGACGACGATCCATTTGGGGACTGGCACGAAGACCCTTGTGGTGATCCC
GCGCAAGGGACAGAGGAGAATACGCCCGCCCATTACAGCACCGACGGAGACCACTGATGAAATCTGGCAT
TCACCCCGACTACCATCCCGTTGTCTTCCAGGACGCCACCACCGGCGCGACGTTTTTGAC
>paratb_5692
TCGGTCGACCATCACCAGTTCGCGCACCATCGAGTGGGAGACGCCGCACGGAGTGCGCACCTATCCCCTC
GTTGTCGTCGAGATCACTTCCGACTCACATCCGTTCTGGACGGGCAGCCGACGCATCGTCGACACTGCCG
GGCAGGTAGAGAAATTCCACCGCCGCTACGGCAGCCGTCGACAAACCAACCACCGTGACG
>paratb_5693
ACGCGGCTCACTCACCCTGACGAGCTCTAATCCTGTGCCGGTGAGTTCAGTAACGCGTCCCAGTGAACGA
CGGCCTCCCCCGCGGCAGGAGCGGCGTCGCCGGTGACCAGTCCGAGCAAGGCGCGGGATACCCCTCCCAG
TCCGATCCCGCTGGCGTGCACAACGCCAGTGATCACCCCCAGCGCCTGCTCTGCCGAGCA
>paratb_5694
GCGTCGGAGACCCATGACGACACTGATCGCCTGGTCGATTTCGCGTCGCGATCGGTGGTCGGCGGGCCGG
TAGTTGGGCGTGTGGATCATGGTGACTCCGAGGTAATCGAATTCGTTCGACGTTTAGTGGGCGTGAACGA
CGTCCCACGGTGGCAACGGGTCGGGGTAGCCGACCCACCGCTGAGGACCTTGGGCCAGTT
>paratb_5695
```

Figure 6-36

```
CGGTGTCGGTCAGCAGCGCCGCCTGCATGAGGTCGAGCACCCGGCTGTGGTCGAGGTTGACCCCGATGAA
CACGATCTCTTGGCCGGCGGGAAAGTCGGCGGTTGACCAGTACTGGGCGGGTTCTATCACCAGGTTGGGC
CCGGCTTGGGACCAGATGGCCGCAATGTCCGGTCGGCTGGCAATCCAGCAGAAGCCTTTG
>Contig16_5697
CGCTACCCGGCCGTGGTCGGTGGGGACGATCTTCGCCGCCGGATTAAGGCGCCGAAGTACTGCCGCCACC
GTTGCGTTGGTTTTCTCACTCACCAGATCGGTCTTGTTGAGCAGAATCACGTCGGCGAACTCCACTTGAT
CGACAAGTAGGTCGGCAATCGTGCGGACGTCGCCGTCCCCGGCGGCTAGGTGGCGGGCAG
>paratb_5700
CTTGCCTGCTCCCAGGAACCCGGATAGGACGGTGACGGGGAGGGGCGTAGAACTCTGTGGCGGCATAAGC
GTTAATGATAATCATTTTCATTAACGCTCGCAAAGCTCCTAACGCCGAGTCCTCACGGTTGTGTGTTTTG
GCAAAGCGGACATGTGCCGTAAAGGTCGACGTAGTGAGTGACGTCGGCGTAGTGATGTTG
>paratb_5701
GCGGCTTAGCCGGCGGGTGTGTTCTTCGATGTCGACGGGTGTAAAGGCGACGGCTCTGCCGCACTGCCGG
CACAGCAGGTAGTGACGATGGCCCGCCTCGGTGCGGAGGCGGTAGAGGATCTCGCCGTCCTCCGCGCGCT
GAGTCTCGGCGATCCGGTCGGCAGCCAGTGCGCGCAAGATGCGGTAAACACTGGTCAGGC
>paratb_5702
CGATCCTGAGCTGTTGGTTCTGGCGAATGTCCTGATAAAGCTGCTGGGCGCTTCGAAAGTTCTCTTGCGC
TCGCAGCACCTCTAAGACGGTCCGCTGCTTGACTGTCGCGCGTCGCCGTCGGGGCGCAGCGGGCGATGAC
ACCGGTGATACTCCTTTTCGAACTGGATCCGAGGTGTTTACTCGTCACTTCCGCGTTGTC
>paratb_5703
GCGGTGGGCTCGGTGGACGACATAAGCGCGGGAGGGGCGTTCGTTGCCTCGTCCACTGCTTTGGCGATGA
CTCGGTGCCGGTGATTGCTGGCCCAGACGGCCGACCAGATGCCGCAGGCGAGGACCACGATGGGGAAACT
CGGCGGCAGGTTGAACATGGCGGATGCGCCCAGTCCGAGAAGTACGGAGCTCAGACCGAT
>paratb_5704
TGCCGTGGAGACGAGCATCGCCATCGACGGACGGGGGTCAGCATGATCGCGGTCGCGGCTGGTGTGACG
ACTAAGGCGAACAGCAGAAGTGTTCCGACCGCTTGGACGGCCATGGTGACGGTGAGTCCCAGGAGTGCCA
TGAAGATCATGGCAAGGGCACGCACGGGCACGCCTTTCGCCTCGGCGACTACCGGATTGA
>paratb_5705
CCGAGGCAAACAGCAGTGGTCGGTAGATGATGCCGACGATTAACGCCAGCACGGCCAGCAGGATCGCGAA
ACCGGCTAGCTGGTCGCGGGATATCGCGAGCAGGTTGCCGAACAGTACGTTCGTCATGGTGCCGGAGCTC
TTGGTGGCCAAGGAATTGAAGAACAATCCCAGGCCTATGGCCAGGGCCAGCACCGTACCG
>paratb_5707
GGCCAGCGCGACGATTGTGCCGCCGATCAAGGCGTTGGTCATAAAGCCCGATGTCAGGATGGACCACCAG
TGTGGTTCGTACTGCAGGGCGAGAACGCGGACGGTCACAGTGCGCTTCTCATGTACAGCGCTCCGTCGCG
GGCCCGGTGAACATGGATGGGGGTGCCGTAGAGGCGCGTCAACAGCGTGTCGTCCATGAT
>paratb_5708
GTCGCCGACGGGCACATAGCGTGGCCGGCCGTCAAGCATGTAGATGACGCTGTCGAGGATCGGTAGCAGC
GGGTTGAGATCGTGAGCGACCACCAGGATGGTCACGGCGAGTTCGGCGTGCAGCCGGGCCAATAAGGCGA
CGATGTCACGCTGGCTACGAAGATCCAAGGAGGCCAGCGGTTCATCGAGGATCAGCAATT
>paratb_5709
GAGGTCGTGCCACCAGCGCAACGGCGATCGCGATGCGTTGGCGTTGCCCGCCGGACAGGGTGGAAAGCCG
CCGGCAGCCCAAGTCGGTCGCCTCGACAGCGGCCAAGGCCTCAGCGACTCTGGTCTGCTGGGATGTGGTG
CTCCGCCCGAATGCCCATCGCCGGCCGGTGAGTCCGAGCAGCACCGCATCGGCGGCGCGT
>paratb_5710
ATCGCCTCGCCTGAGCTGTCGGCGTAATGCTGCGGAATGTAGCCAATGTTGTCGTTGGCCTGACCGGGGC
GTCGGCCAAAGATCTCGAGTCGGCCGGTTGCCGAAGGGATCAGGCCAAGGACCATGTTCAGTAGGGTCGT
TTTGCCGGCCCCATTGGAGCCGATGACGGCGACAATGCCGCCGGCGGGAATATCGAACGT
>paratb_5711
```

Figure 6-37

```
GGCATGCGACCAGATCAGACGTCCGCCGCGCACGGCACTCACATCGGTGAAAGCCAAGGCGGAGGGAGGG
GCGGCGACGTCAGACAGCGACATGGAGCGCCTTGGCCAGTTGGACGAGCTGCCCGTACTGCCAGTCTTCA
AACGACGTCTCCCCGGGCGGTACGGTCTCGGTTATCTTGACGACGGGCACGCTTGACTGC
>paratb_5712
TCCGCGGCTGATCGGATTTCCTCGGGGATTGAGCCCTCGGTCTGCGTGTTGTAGATCAAGAGGTCGATAT
GCCGGCCGGCAAGGGCGGTGAGGAACGCGTCAACGTCTCCGGGTGAGGGTTCCGATTCGTTGGCCGATGC
CCGCCGGTACCCGGCAGGGGTCTTGTTGACCAGGCCCGCCGCTTGCGCCTGGTAGTCAAA
>Contig16_5713
GACCGTCTCTGTGGCCCCATAGGATTTACCCGCCGCCTCGGCCTTGATCTTGGCGATCAGGTTCACGTAT
AGCCTTGTCGCACTGGTGAATTGCGCTCTCCGCTGGCTGAAGTAGCCGGCGGCAGGCGGTTCCATTCTGC
TCAATTCTTGCGTTACCGCATCAGCAACGGCGGTCACCGCGGAGGGCAGGTACCACAGGT
>paratb_5714
GAGGGTTGGCTCCATCCGGTGTTGTCGTGACTGCCGCGGCGCTCACCAAGGGGGCACCGGAAGCGGAGCT
GCCGGCCAGCTTGGATGCCCACGAGTCGTACCCTGCACCGTTGACCACGATAAGTTTCGCGTTCATAAAG
TCAGCGGCGTCGGCCGGTGACGGCTCGTAATCGTGCGGGTCGACCGACGAGCTGGCGAGC
>paratb_5715
ACGGTCTTGACGTTCGCGCAGGCGCCGCCCAGCTCGGAGACAATGTCGCCCCACTGATCCACGCTGACCA
CGACAGCGAGTGGGGCGGTGGGACACGGCGGCGCGGCCGTTCTGCCAATGGCTGATGGCGAGGCGGCATT
ACGGGACCCCTCGGCTGTTTGGGTCGGGCTTGACGAGCAACTCGTTACGACTGTCAGCAC
>paratb_5716
CAGGACAGTAGCGATAGGGGCGCCGTGCCACCGCGAGAGCAACCCACCCACACCGCAAACGATAACCGTT
TTCATATCTAATGCGCGAGACTTTCCGGAAACGCGGTCCGCGTCGCGGTGCGCGCCGGCCCGGTTCCGCG
GGACCCCGGCTGGCCCGCCCGAGCGGCAACATGCGCCCACCGTCGCCATTCGCGTTGCGC
>paratb_5746
CCGTCGTGCACCGCGGCGCCACCGCCCCGCACCGCGAGCAGTATTCGGACCCCGAGAAGCCGATCCTGCG
CATCACCGGGGCGGACGGCGCGGGCGGGCGGACCCACTCCATCGAGCGTTGGCAGACCGGCGGCTGGCAG
CCGTACATCGACGACGCCGACCAACTGGGCGCCGACGAGGCCGCCCACCTGGCGCGCCAG
>Contig16_5767
CACGTTGCCGGCGGCGGTGGCGCTGGCCCCGAGCGTCGCCACCCCGGCCGGGGCCCCGGCCAGCACGGTC
GCCGCCGGCTCCGGCGCGTCGGCCGCCCCCGCGCCGGCCGCCGCGGCGGGAAACTTCGCCTATCTGGTCG
CCTTCGGCGGCGACCCGGACACCGGAGTGGGCCCCACCCTGAGCGGGCGCGGCGGGGCCA
>Contig16_5859
GTCGCCACCCCGGGGATCCAGCTGCCGGCGCCGCCGCCGAGCAACCCGCCGGCGGCGCAGCCGCCCGCGC
CGAGCACGCCCGCCCCCGCCCCGACCCCCACCGAGGTGGCCGCCCCGGCGCCGGAGCCCGTCCAGCAGGC
GGCGCCGCAGACCCCGGTCACCCCCGCACCCCCGGCGCCGGTCTACCGCGCCCCGGCCCG
>paratb_5860
GGCCCACACCGCAGTACCAGCCGCGGCCCGTCGAGCAGCCGGCGCCGCCGCCGGCCGCCGCGCCCGCCCC
GGCCGCCCCACCTCCGGTGCCCGCGCCGCCGCCGGCCGCCCCGCCGGTGCCCCACCAGCCACCGGTGACG
ATGTACCTGCACTTCCCGTTCGTCACGGTGCCGATCCCGATCACCCCGCCGGCGCCGCCG
>Contig16_5922
GGAGATGACCTGGAAGTCGTCTGGCGGCCGGATCCAGATGCGTAGCGACTGTAGTTGCGGCCCGATTCAG
GGCCACATGGCCATCTCGGTGTAGTTGCGCGGCGGCCGCGTCATGGCCGTTAGTGCTAGGCGGAAGACGA
CCAGGCACCCGGATTACTCTGCGTGGCTAGACGGGCGGGAGTTGAGTTCCTAAGGGGAGT
>paratb_5923
CAAGCTACTTCGGTGGGTTTTATGCTGGGGTGGACGGGCCGGTGAATTGGAGCGCTTGGCGACTCCTGTG
GTTCCCGGCCCGTCCTGCCTTTCTGGCGCTGGGAGTAGCGCTTGGAGGCGGCGTTGATGCGGGTCTTCTT
GTCGACGGCGTGGTGAGCGCGGACGATTCGGCGTCCTTCTTCGAAGGTGATGGGCCGTCC
>Contig16_5925
```

Figure 6-38

```
CACCGGCTTTGGTGAGCCCGTGGCGCTGTTCTGCTTGTCCGGACTGGCTGACCTTGGGGACGAGGCCGGA
GTAGGCGCGGATGGCGGCCAGGGAGTGGAACCGGTGCGGGTCGCCGATGCGGCCGGCGATGACCGCACAG
GTGACGGGCCCGAGGCCGGGTGCTGAGGCGATGATGCCGCGCGGGTCGGCCTCGGCGTAG
>paratb_5926
AGGTTGGCGGCGCGCTCGTCGAGGTCGTCGATCTGCTCGGTGAGCATCTGGGCTTGTTCGGCTTCGGTAG
CGATGTCGGCGGCCAGTTCGGCGAAGTCGATGCGGGCATTAGCGCCAGATCCCCACAGCTGCAGCGACTC
TTGGGCGGCGGTCAACAGCAGGGTGGCGTGTGGTTCGCGCCAGGCGCCGCGGGAGTGGCG
>paratb_5929
AGCGCAACCCATGCGTTGCGGGTGGGCTCCATCACCACCCGCACGGTGTCTTGCTCGCTGAGTCCGATTA
CTTTCCAGAGCTTTTCGAGGTCGGCGGTCAGTCCCCGGGTCCGACGGGCATGGCCCAGACATTCCGCAAG
CAGAAGTCCGCTAACGCGCGGCTCCAAGTTCCCGAACAGGGACACCGGTCGGCACCTGAG
>paratb_5933
GAGGTCGGCAAGGAACTGAGCTTGGACCAGCGCTACCGCGCGGCGACGGGTGTGTACGCCCGTCTGGGCT
CCTGCGTCAACGCCACGCATTACCTGGTGAAGTATCTGGTCGAAGAAGGACTGCTTGAACTTGATCCCGA
AGTGTTTACGCTGCCGGTGTTGGCCAAGACCAGTGTCGAGATCAAGGGAGCGGTCTACAG
>paratb_5934
CGCGGAATTGGGCGCTGAGATGCCCACCGATTTGTCGAACCTCGACCCCGAGGTATGGCGACCAATCCAC
AAAGACATTGATTTGCTAGCGAGCTCAGAACATGGGTCACCTGAAGACGGTTCGTCCCGCGAGCCAGAGG
AGTGAGCATGTCGGCGACCCCATGAGTTCAAAGTTCGGAGGCATCCCGTTTGAAGCGGCG
>paratb_5935
CCCGAACCGAGCTGGCCCTTTGGCCTGCCGACCGTAGCGGCCCATAGCAGCTACTGGGCCGTGTCATCGC
CGGAAGAGTCGATGTCACCACCCACCTTCACCCCCTGATCATCATGATGAAACCGACGACCCGGGCCCTG
CTTTGCCTGTTGGCAATCCTGCTCACGACAGGACTATTTACTGCGTGCTCATCGGGGTCG
>paratb_5936
TCGCCCATGGCCCAAAAACACACCGCGTCGGGCGCGCCGTCTGGTGCAACGCTAATTCCAGGAGGTCCGA
TGGAATCGACACCAGCCGCCCCGTCTCCGAAAATACCTGCGAGTCAAGGAGAAGCGCAGAAGACAGTGAT
CCACTACATCCAGCAGACCGTCGATGCCCTGCCCCCGGGAACCAACGCCGACGGAACCCG
>paratb_5937
CTATGCGGGCACTGGTTCGGGAATGGCGTACTGCGAGGACGAGCCGAAGGACGATAATTCGCCTGTTAAC
TACGCTTACTGGGGTGATCTGAACCTTCCCCCGGGCACTGACGTCAACGCCATGTACGGTCAGGTCGAAA
GCATTTGGAAAGGGTGGGGTTGGCAGGTCCTTGAGCGTCAGGGCTTCGAGAAGCCCAACC
>paratb_5938
GGTTCGGCTACGCTCCCGACGGTTACGTCGTGCAAATCAAAGCCGCGTACCCCCCGGCTCGCCGCCGAC
AATCATCGGGACATCGCCCTGCTTCCCAGGCAATCTCCGAAAGGAGGGGGCTCCCATTCCGACTGCGATA
AACCAGACCTCGCCCGCAAGATAAAACCAGTGGATGCCGGTGTCACCGCCAGCGACCCTC
>paratb_5939
GCTCAGCGGGGCATCATGTACTTCCACCGGACATCGCAGTCGGGAATTAGCACGGCGCTGGGTCGAATTC
ACTAGCGTCGCCTTCTACTCGTGCTGCGGATCGTCCACCCCATTACCTATTGGGTGAGGAATGGGGTGAA
TCCTAGCGTGTGACTTTGCGGCGCATCTCGGCCGCATAGCGCGCGGAAATGCGCAGCGGC
>paratb_5940
GGGATGTGACTGTAGTCGATCTTGCGCAGTTCGGCGTTGTTGGCCTCTTGCTCAGCCCAGATCTCCAGAA
CATGCACAGCAGGAACTGTGGCTGATTGCGCTTGGACACCGGAACAGGCACATGTCGTTGGCCACTGCTT
GTAGCGGGTCGCATACCCACATCGCGGGCAAGGGAAATGGAAGTGGGGGACGCTGTGTCC
>paratb_5941
CCTAACGCTCACAACCACATCTGCCTCCCACGATCTAGCTGTCCCCGCAGCAGTCGTTCCGGTCTCTGCG
CTACACGTACGCGAGCTTGTGCCTCGCTGCGCGCATCCGGCCTATCGACATCGCGGAGCTTATGGGGCAC
CGGGACGTCAAGACGACGCTGACTGTCTACGCGCACCTGATCAACACTGACGATCACACC
```

Figure 6-39

```
>paratb_5942
GGCAACATGGCCGCGCTCGGGTCGCTAGCCGCCCCGTTGCAGAAGCCCAACTACGGCAATGTGATCCCGC
TACACGGCTGAATCGGGCGGATTGCGGCCCCACACGGCGCGCCGATCAAGCCTCGTCTGCAGAGGAACGA
AGGGTCTTCGACGCCTGACGCCTGTAGAGGCGAACCAGCGCCATGATCCCAGTGAGGACA
>paratb_5943
ATGGTGAATAACGCTGCCGATGCGCCTGATTCGTACACGTCGGCAAGCTGGATGGTTTTGCCGCCGCGGA
CCGCGAAGCCGTCGGGCGGATGGATCAGGCTGGTGAAGATCTGGGTGGTGGTGGAAAGCCAGAACAGGCA
CGGCAGCAGCCAGTAAGTGCGGGTTCGGGTGACAGGGCTTCCGGGGAATCGCGGTTCGAC
>paratb_5944
GAGCGCGACGAGCTGAAAGATCAACCAGCCCGTCAGCAGCCAGCCGAGAAAGTTGCTCAGCGGGACTCCC
AGTGCGCCGGTCGGGTGGTCATAGGAGTACCAATCGTGCGCCGTCGCCCCGATGGGGTCATATACCAGGT
CATAACCCCCAAGGATCAATGTCGCCACGATGGGCGTCGTAAAGCGTTCGGCGCCACCGA
>paratb_5945
CAGCCACACCGGGAACGGGCCGCATGATCACCCGGGCCAGCGCCCAGGCCAGCCAGCCGAAGATGATCCA
GCTGGCGATGGCCACCGGGGGGACGCCCAGTGGTTTCGGGCCGGGCAGGTGATGGGTGTAGGAACCGAAC
GGGAAACCGGTCGCGACACCGATTGCCTCCAATGCGAACGCAACAATACCGGCGATGGCC
>paratb_5946
ACGAACGCGGCCATGCCTCGTGCGGAGTAGCCCAGCCAGGCATGGACGACGACAAACAAAATGAGAAATC
CCATTTGGGCGGCCCCGGCTTGCGCAGCCAGCGACGGGCGCACCGCCATGACCACCGCGGCGAGCAGCGT
GAGGACGAGCAAGACCCAACAGGATGCCCTGAGAACCTGCCACCGTGCATCCGTTTGGCT
>paratb_5947
AGGCGATCGCGTCAGCGTATCGGTTGCCACCGCTGTGTGGTCTTCACTGGTCATGTTTGCGCACCCTCAG
CCATGCTGGTCGGCGCGCTCGACGCACGCCGAGTTTTCTGGCTTACGTTATCGCCCGAGGGCGCGGATCT
CAGCTATTCCGGCGACATGAAATAAGGCCGATGCTCGTGGTATTTCACCCCCGAACTAAG
>paratb_5948
GGACCGTTAGGAGACGACGGCATTGGGTCAGCACCACAATTACGGCAACGTCGTACCGCTACACGGCTAA
TTGCTAGCGACCTCCACGCGAGGAACGTCTTGGCCAGGCCGACTTTTGCGGCAATCTGAGCATCGCGAAT
GCGCACACCCGTTACGGTTGGTCAGCATCGCCATCCCTTTGGTCGGGACATTTACGTAGG
>paratb_5949
AAGGTCGGGCTACGTGACTGAAGACGCAATCAGCATCGGTGGTGTGAACCTTGCTGATCCAGACACGTAT
CGCGCGGGTATGCCTTACGGAGCTTTCCGCAAGCTTCGTGAGCGTGCGCCGGTCGCGTGGCACCCGCAGA
AGGATGGCTCGGGGTTTTGGGCCTTGACGGGTTATGAGGAGATCCACGCCGTTTCCAGGG
>paratb_5950
ACAGCGCAACGTGGTCGTCCCAGATAAATGGGGCAATGTTCGATGCTCCGCCTCCCGGCGAAGTTCCCCC
GGTGATGATTTTCATGGATCCGCCTCAGCACACCGCGTTGCGTAAGCTGATCAACAAGGGCTTCACCCCG
CGCCAAGTCACGCGGCTGAACGAGCACATCGTTGAGATGGCGAAGCAAATCGTCGACGAC
>paratb_5951
GTGATCGAACGAGGCGAATGCGAATTCGCCGACGATGTCGCTGGCGCACTGCCGTCCTATGTGATCGCCG
AAATGCTCGGCATTCCGCTCGAAGATGGTCGGCGGCTCTACCAAATTACCGAGATCTTGCACACGGGCTC
CGTCGGTGACAGCGACGACGAGCGGCAACAAGCGATGGTCGAGATGTTTCAGTACGGCGT
>paratb_5952
AGAACTCGCCGTGCGCAAGCGCGCGGAGCCAGGTGACGATATCGCGACTTCCTTACTCCACGCCGAGGTT
GATGGTCAGAGCCTCAGCGATTTGGAATTTAACCTGTTCTTTATGTTGCTGATCGATGCCGGAGGTGATA
CGACCCGCAATCTTGTAGCAGCGGGAATTCTTGCTCTGCTTGAGCATCCCCAAGAACTGC
>paratb_5953
AGCGGCTTAAGGCAGACCCTTCACTCATGCCGACCGCGATCGAAGAAATGCTGCGCTACACGTCGCCGGT
GACGGCATTCCTGCGCACCGCGACCAAAGACACTGAGTTGCGCGGGGTACCCGTCAAGGCCGGCGAACGG
GTGGCAATGTTCTACCCGTCGGGCAACCGCGACGATAGCCACTTCGCCGACCCCGACCGT
>paratb_5954
```

Figure 6-40

```
CTCGATGTCGGCCGGGCGCCGAATCCTCATCTCGCCTTCGGCGGAGGCGGAACACACTTTTGTCTCGGCG
CCAACCTTGCACGCGTGGAAGCCTCGGCGATGGTTCCCGAGGTCCTGTCACGCATGAACGACCTTGAACT
CGCTGGGCCGGTCGAACGATTACGTTCAGACCTGATAAACGGCATTCGGTCTATGCCCGT
>paratb_5955
CCGCTTCACCCCTGGCAAACGTCTCGGCACCGCCTGACACCGCCGGCGTAAGGGCTGTCTCCTGGCGGTG
AGACGTGATTCGCGCGGCAAGGGACCGTTAAGGGATCGCCCCGGCCCGCGAGCGCTACGGCGTTTGCCGC
CCTGTTCGTCGTGGAGCCGATGACGGGAATCGAACCCGCGTTCTCAGCTTGGGAAGCTGA
>Contig16_5969
CACCGCCGCCGGTGCAGGCGTCGGCACCGCAGCCCAAGATCAGCGTGCCCGAGCCGGTGGCGGCGCCCAA
GCCGTTGAGCCTGCCGGTCGCCGCGCCGTTGCCGGCCGCCCCGCCGCCGGCTGCGCCGCCGCTTCCGGAG
GCGCCGCCGATCCCCGCGGCCCCGCCGGTGGTGCCGGTCCCGGTGGTGGTCCCGCCGGTC
>paratb_5973
CTGGGCGGGTTCGGCGGTGGCCACGCCCCGGCGCCCGGCGGCGGCTTGGGCGGGTTCGGCGGTGGCCACG
CTCCGGCGCCCGGCGGTGGCCTGGGCGGGTTCGGCGGGGGCCACGCCCCGGCGCCCGGCGGCGGCTTGGG
TGGCTCCGGCGGTGGTCACAGCGGCGGCGGCCTGGGCGGACTCGGCGGCGGGCACAAATA
>Contig16_5981
TCGCACCACCGCCCCCGGCCCCGCCGCCCATCGCCGTCCCCGTTCCCGTCCTTTCGCCGCCGGTGTTCGT
TCCGCCGCCGCGCGTGCCGCTCGCCCGCCCACCCGCGCCCGGTCACGGCCCCTTCGGCGGCCACGGCCCG
TTCGGTGGGGGCCACGGTCCCTTCGGCGGGCACGGTCCGTTCGGCGGCCACGGTCCCTTC
>Contig16_5995
CCACCCGACCCGCGCCGGCGGCCCCGGCCCCGGCCCCGGTTCAGGTGGCGCCCGTGCCCGTCCCGGAGGC
GCCCGCGCCGGCTCCGGCGGCCCCGCCACCCCCGCCGCCGGCGGTCGCGCCCATCCCGGTGCCGATCCCG
TTGCCGATCCCCGGCCTGGGTGGTCCCGGATTCGGCGGACCGCCCGGCCACGGCGGCGGT
>paratb_6028
ATTGCCAGCTCAGCGCTTGCCCGGTGGACGCGCCCCGCGGGCGATGCCCAGTCCCTTGACCGGTGGCTGC
GACGGTGCGTCGTCGCCATTGGTCTGCTTTGCCGGCTCCGCTTTCGGGGCCGGTTCGGCTTCGGCCTTGG
CGGCTTCAGCTTCGGCCTTGGGTGCCTCGGCCTTGGGTGCCGCCTTCTTCGCGCCGGGCC
>paratb_6053
TGCGCCGGCGGCTGTTCGGCGCTGCTGCCGGGCGAGGTCGAGCTCGGCGTGGTGGTGGTGGTTGTCGTCG
TCGGTGTCGTGGTCGTGGTGGTCGTGGTGGTCGTGCTGGTGGTCGATTTGGGCACATGGCTGACGCCCTG
TTGGCCGCCGATGAGCTCGATGACGCCGAAGACGATCAGGCCGATCAGGACGACGACGGA
>Contig16_6185
TGTCTTTTCCGCTCACCGAGAGGTAGCCGGCATGGCAGGGCAGCGACTTCGTGGTGCCGGCGCCACTGAC
CTGCAACGTCCCGGCTTCCGGCACGACCGGCGCCGGGCTGCCGCCGCCGAGGCCGGTGCGCGCGCCGGTC
GCCGCCAACCCGGCCGCGGCCAGACAGCAGACCGCTATCGCCAGCCAGCACACCGCCCCC
>Contig16_6200
GAACGTCGACTTGTTGCGGGGATTTCCCTCTTACCTTCTAGCGCTGGATGCAACAGCCTCTAGCTGAGGG
GTTGTTGATGAGGTCGTCGCGGTATGCCGTTGTGGGTCGTCGGTTCTGGGAATTGGTGCGGGCCGGAATG
TCTGCGGATGACGCTGGGGTGGCTGTCGGCGTGTCGATGGCCGCAGGGCGGCTCTGGTTT
>paratb_6201
GCTGATGCTGGCGGAGTGAGACCACGATTCGTCGACCAGTCCATCCCGCGACGGCGTCCTCGGTTGACGG
TGGAGGAACGCGAGGAGATCCAAGACGGTGTGGCTCGCAGCGAGTCCATCCGTGTGATCGCTCGCCGACT
GGGCCGGCATCCGTCGACGGTGATGCGTGAGATCGAGCGCAACGCGATCTGTCGTGGCCG
>paratb_6202
GTATCGGGCGCGGTATCGATTCGGGGTGCGCTGGCGTGGTGGTCACGATCCCCGGCCGCGATATCGCGCC
AGCTTGGCGCACACGCGTGCGCACGTTAAGGCGCGCCGTTCGCGGCCCGGCAAGCTGGCGACCAATCAGC
TGCTCCACGACGAGGTACAGACGCGGTTGAATGAGCAGCACAGCCCGCAGCAGATCGCTT
>Contig16_6203
```

Figure 6-41

```
GGCGGCTGCGGCGCGACTTTCCCGACGATGCGGAGATGTGGGTGTCTCAAGAGACGATCTATCAAGCGAT
TTACGTTCAGGGCAAAGGGAATTTGCGACGTGAGTTGCACACCTGCTTGCGTACCGGGCGGGCCCTGCGC
AAGCCTCGGCGTCGTCCTGGTGAGCGTCGCGGACACCTGCGCGACATGGTCAACATCAGC
>paratb_6204
GAGCGCCCCCTGAGGTCGCCGACCGCGCCGTGCCCGGACACTGGGAAGGCGATCTCATCCTGGGTAGCA
CCGCGTCGGGTTCGGCGATCGGCACGGTGGTCGAACGAACGACGCGGTTCGTGATGCTGCTACACCTGCC
CGACGGGCATGGCGCCGAGGCGGTGCAGGAGGCCATCGTCGCCAAGATGGCCGGACTGCC
>Contig16_6206
ATCTCGACTACGTGGCATCCAAACTCAACCGCAGGCCACGACAGACACTCGACTGGAAAACACCAGCCGA
AGCCCTCGATGAATTACTCTGCAAACCGTTCACACCACCGGCTGTTGCTTAGAGCGCTAGAAAGCGCCCC
TCGAAATCGCCCAACAAGTCGACGTTCGGCGCATTTAGTAATTTTGTTGTGACCTGGTCG
>paratb_6210
CACCGTGCGCCAGTTCAACGACCTGCTGCGGGTGCTGCCGCCGCTGCCGGAGGAGACTCCGCAGGAGGCG
CCGGCCGCGCCGCGCAACTCCTCGCCCAGCCGCCCGCTGGCCCCCGCCGGCCGCGCGGAGCTGCCGCCGC
GCCGCGCGCAGCAGGACGTGGCCGGGCTGCTCGGCCCGGACGTCCAGCCCGGCCGCCGCG
>Contig16_6230
CGCACCGACGGGCCGGCCCGGCAGCGGCACGCCGCGCGGGTGCGCCGGCTGGTCGCGGCCGTCGCCGAAC
ACATGGCGCCGGCGGGCGTGCTGGCCGGCGCCGGCGGCGGCGACGGCGGGCTGTTCGCCGGTGTCACGGC
CCGCTACCTGGCGCTGGTCGCCACCACGCTGCCGGGGTCTGTCGCCGAGGACGTCGCGGC
>Contig16_6396
TGTCTACCTGCCCGCGCAGGTCGAGCCGACGCTGCCGCTTCGCATCCGCGCGGCCTGGCTGTGGTCGGGG
CGGACGGCGGTCATCGCCGGCGCGGCCGCGGCGGCGGTGCACGGCGCCGCGTGGATCCCCGATGCTGTCC
CGATCGAGTTGATCCACCACAACACTCGTGCCCCCGACGGGGTGCTGATCCGGCGCGACG
>paratb_6400
TCGGTGTTGCGCTACGGCTTTCGGTGTTGCACCAGGGCGCGGATCGTCGGCGTGTCGCCGCCCTGTGTAC
ACACTCGACGCCCAGGATGCACACTCGGGCCGAGACGCCGAGACGCCGAGACGCCGAGACGCCGAGACGC
CGGGACGCCGAGGCGCCGAGGCGCCGGGACGACTCAGAACGTGCTGGTGGGTCGCACCTT
>Contig16_6633
CGCTCAACCACACCACCGGCAACGTCCGCCGCATCGCCGAGGTGATGGTCGCGCACGCCGAATCCGGTGT
GCACCAATGGCTCGACGCCACGCTGCTGGCCGGGGCGGCGCTGGCGGGCTGGGTGTGCTGGTGGCGGTG
CTGGGCGGCCTGGCCGGTGCGGCTAGCCGAAGGTGAACGAGAAGACCTGCAGCCCTGGGC
>paratb_6695
CCGAGGCGTTCGTGCCCGACTTCTCCGATGACGACGACGCCGCCGACACCGGCACCCAGTCGTGGGCGCC
GGACTTCGACGACGACGCCGAGGACGACGACGCCGAGGCGGCCGAGCCCGCGGCCGAGCGGGAGCCGGAG
CCGGAGCCCGAACCGGAGCCGGAGCCGGCCGGGTTCGCCGGCCCGGTGCCGCCGGTCGCC
>paratb_6773
GCTTCTTTTTCGCCGGCCCGTTGTCGGGGTTCGGCGCGGTGGCCAGCCGCTCGGTGGGCCCGGCGGGCGG
GGTGGGCGGCGGCGGGTAGCCGGGCTGCTGCATCTGGGGCCGCGGCGCGCCGAATCGTTCGGTCTGGCCG
GGGGGCGGGGAGCGGGCGCCGGCGGCGGTGGCGGCACCTGACCGGGCGCCTGACCTGGG
>paratb_6892
CGGTTCGGCGGCCGGGCGGGCTGGGCGCGGGCTGGGCGTTGCCGCCCCGCGGCGGGCTCCCCGTCGCCC
GTCGCCTGTCGCCCCGCGAGCGTGAAGTTAGTTTCACGCTCGGCGCCCAGCGTGAAGCTAACTTCACGC
TCGGCGCTTGGCTCACACCGCGATAGGCCCTCGGCTTGTGAGGAGGGTCGGCGCCTTCAG
>Contig16_6893
GTAGCGGTGATGATGTTGAAGCTAAACCAATCGGGCGGAATTCCCTGGCGCAGCGCACCGTCGAGCTCTT
CGAAACTGAGCCGCATCAGATGTGATGCTGCGACGGCGTCGTGCTCGGGCATCCAACCTCTGTCAATTGG
TTCACCGTCGACGGTAATGCTGACCCGCCCGGGATAATTCACCGGATCAGGCTTCGTAAG
>paratb_6894
```

Figure 6-42

```
AGTTATCCCCGGATGCAAGCCCTCTTGATACCAGCGATAGCTTGGTGAATCGGTATATCTCCCCGGCCAC
GCTTCTTGGCTGATTAGAAATAGCATGTACTTCTCGGCATCGTCGAATCGCCTGAACATCCATAAGTTCT
TTCGCGAACCGCGAGATTCCTGGTCGATGTAGTATCCGTCTTCACCGAGAACAAGAAAGT
>paratb_6895
AGGAAAGTTCGTAGTCGTCAAGGAAGCGAAGGGTTTCATTGTCGGTCATCGTCGGTGGCCGGGGCGCCCA
GTCTGGAGTATGACTCGAGTTGTCGACCTTGGCACCGCTGTGCGGCAAAGGCTTGCGCATTCTGCGCAGG
TAGGTTGCTTGCCATGAGTACCACGACTTCACGATCCGGTGTAATTCTGGAGGAAACTCC
>Contig16_6896
TTCAGATTAATAGGGAGATCGATCATCCTTCTTCCTGTATTCATTAAAGGAGTGCCAGTAGCAGGAGTCG
AGGTCGGGTGGCCACACCACGGCGCGGCGATGGTATTCGCCGCCGCGGCCGGCGCGCCGCGAGTGTAAGT
CAGGTTCACACTCGGCGCCCACCGTGAAACCAGCTTCACACTCGCCGCTGGTGGGGTGGC
>Contig16_6897
GTTGGATTGCCCAGTTCGTAGGGGACGACCCAGCCCGATCGCACCCGACGGATACAAGGAAGGTTGGCAA
GCTGTCGTTTGCGGTTGTGTGGCGCCTGGCACGGGGAGATTCTGGTGCCAAAAATGGTCTCTATGTAACG
GTGAATACCTAGAAGCAGCATTCTGGCAATAAGTAAAAGTGCAAGCCTTCCGTGACGGGT
>paratb_6899
TTACCTGCGATCATTTTGCTCATTTGGCGCTCCTTTAGTGATCCTCAGACGATCAACCTGCTCCTCGCGC
ACACCGGGGCTCGCGCGAAGAAAGTCCTGCTAAGTCTCTGTGTCCAAGCCCAGCGCTTTGCGATCCAGGA
CAATCCAATCATAGGCGTCATTGACTATCTGCACACCTTTGATTTCTGGCGATATTCGGA
>paratb_6900
TCATTTTCTTAATTTCGGACCACCGCATCCCCCCATATCTTATATCGGGGCGTACCCTACTGGTGTACGC
ACGTAATACAGAGCCTAAATGTTTCACGTGGAATGTAGGCATTATCGGCTGGCCGTCAGCGCTTTGTATT
TTGCTTAGTTCTAGAAATAGTTCTCTATCGCCTATCGTGGACCCGAGCGATGCCGGTAAT
>paratb_6901
TCTGATGCGTTCGATTTTACCGTGCTACTGATGAGCTCTTCGAGTGACTCCGTTGACCCTTCCTGTTCTC
GGCTCGCTGGACAGCCATTATGGCCCAACGAAGCTGGATCGATGTCGTTAAGGATATCGGGAATCTCACT
TTTTAGGATTGCAACGCACTGCGATTGCCGGTTCCATAACACTACCCAGTCGAGAGATGG
>paratb_6902
CATTTGACCGCTGCGGCAAGAGCATCTCTGAAGGTGCTGCCTGCAAACCGTTGATGCTCGGATAAGTGC
GGATGTGACTTTGAAGTAAACAGCATCATCGCATGAGTGCCGTCCGCGAGTCGCGCAAGAGGAGTGGATC
GCACCTCTCTGCCGTCGTGTTGTTCCTGACGATATGGGAAGAAGACTTCGGCGAAAGTGA
>paratb_6903
TTGCACGAAAAAGATGTTTGCGCGATAACGACGAACCGTCGGTAGCGGCGATCGCCACTAGCCGCTCGAT
GTCGTCCTCAGTCATTATGGATGCTCATTTCAATATAGTGTGAACGTATTATCAGTTTCGCCAAACATTC
CCTCGACATCGTATACCAGCCCTGTCGGGCACGTTCGTCGAATGTGCAGACCGCAAGGT
>paratb_6904
GAACGTCGCCCATTCCCTTACGTTTCAATTCGCTAATACGTGTGGGAACTATCACCGTTTGCGGGTTATC
GGGAGACGGCGCGGGGGCGGTGACGGTTTGGCACCCGGTCGAGTGCGACCGTGGCGGCTCTTATGGTCGC
CAACGCGGGATCTCAGCCGTGACGCTCTCGGGGATGTCCTCCAGGAGAGTGGTGGTCAGT
>paratb_6905
TCATCGAATGACAGCGCAAGGACTTCCATCCTGGGTTGGTCTTCGGGGAATGCGTATCCGTAGGAGCTGC
GGTCTTCTTCGAATGTGTAGCGTTTCAGATGTTCCTCGATAAAGCCATCCTGGGGAGTGGGGGATTCGGT
CTTCATGAAACTTATGGCTTGCCGATCCGCGGGTTCAACTAGTATGCGCGGGCTGGGGCC
>paratb_6910
TCCCACCATTTATTCAAAATTTCTTGCGCGGTCATTCCCGCATAAGGGCTATTCGCCCCGGCTGATTCGG
CAAGTTCTCGAGGGCAGCCGTGCTCTATGAGATCCTTGACGAGTTTCTCAGGTGATTCCGCGAGCGCAAG
TTGCGCCTGGTGCCAAGGCGGTAAATCCGATGGGGTGGGATCTCTGGCGGATGTCCGTC
>paratb_6911
```

Figure 6-43

```
GGCGGGTTCATCGGGAGGCGCGCCGTCGTGTGGCGGGTGCGATCCGGGCGGTCGATCGCCGTCGCCAGGC
GGGTGATGACCGCCAGGTTGATGCGGCCCGCTGCCATCGGCCAGGGGATGTCCGTCGCCGGGTCCATGGG
GACCGCCATCACCAGGATGGTATGGCCCATCTCCGCCGCCGGGCACGTGGGGAGCGCCAT
>paratb_6912
CATGCGGCGGCTCGACGGGATGAGCGCCCGGCTCCCCGCCATGAGGCACATCACCTAGACCGGAAGGTGT
TTCGGCAGGCGCGCCGCCGCCCATCGGGACCGAGGACGCCGATGGAACGGGCGCCGCCGCCGCGGCCGCG
GGTGCTGGAGCGGACGCAGGCGCCGCCGCAGCCGCGGGTACCGCCGCAGCGGGAGCCGGC
>Contig16_6987
GGTCCGCATGTTCCGGCGCGCCCACCGCGTGCCGCGCGGCAAAACGCGCAGTCGCGCTTGACTTCTGGCG
CGGCGGCGGCCGCCTCCGGTCCCGCCGCCGCACCGGGGCCCCGGCCGTCGTCGCCGCCGCTGGCGCGCCC
CGATGCCGGCGCTGATCGCGGCGGCGCGTGGGGATGCAATCTCGAAGGTTTCAACCCTGG
>paratb_7088
CGGCACGTCGACCGTGCCGCCGAAACGGACCGTCTGGACGGCGTCGAACCCGACGAAGGCGAGCACCAAA
AGCAGGTAGGGGACGTTGAGCGCCAACCGAAGCCGGGCCGCCCGGGCCGGGTCGAACCGGGCGCCGCCCG
CCCGCCAGGAACCGGCCACCGCGAGCGCGGCCAGCGCCAGCGCCGTCACCGCGACCAGGA
>Contig16_7089
CCGTGAACACGATCGGGTTGCTGTCCGGGATGCCGACGCCGAAGTAGAGGTTCCACGGCAGCAACACCGC
GGCGAGCAGCAGCGCCACCGCGGTCAGGTCGGCGGCGACGCGCCGGCCGGTGGTCGCCGGGCCGGGCGGC
GGCGTGGCGCCGGTGGCGTGCGACCGGATGATGCGGCGCGCCGCCGGTTGCCGGGGCTGG
>paratb_7113
CCGGCGTGGGTGGCGAATCGCTCCGGGCCGACGTCCAGCCGCTGCCGCACCCCGAGGTTCAGCCGCGGCA
GCAGGAACGCCGCCGCCACCAACGCCGCCCCGACCGCGGCCGCCACCGCGTCCCGCCGAGCGATTCTCAC
GGAGCAACAGCCTATTGTTCGCCGCCCCCGGCGAATCGGCGCACCAACGCCGCCCGGTCC
>paratb_7181
CCGGCCCGGTGCAGTTCGACATCCCGCTGCGTGAGCCGCTGGTGCCCGATCCCGAGCCGCACGGCGCCCC
GACCCCGGCCGGCCCGCCCCGGGCGGCCGGGCCCGTGTGACCTATACCCCGCCGGTCAGCTTCGACCAGC
CGCTGGACATCGATCTGTCACCGGACACCGTCGTCATCGCCGGCCACGGCGCCGGCACGC
>Contig16_7254
ACGCTGGTGGCCGGACCCCACGTGTCGTCGTTGGGTACCGTCATCGTCAACCTCCGAAAGTCGCCTGGAT
GCGGTGCAACCCGTTGTGGTCCTGATGCACCCGCGCAGAGCCCAAGGTATCGGGCCGCAATCCCGAATGG
GCCTTGTGGCGGACGGGGCCGGCGTCACCGTATTCGTTGCATGACCTCCAAACCCGAAGA
>Contig16_7363
ACCTGTTCGTCGCCGCGCAGCGGCGGTAGACCAGAAGGCCTAGCCTTTCGGCAGGGTGAAAGCCGAGCGC
GCCGCCACCGACGCGATGTGGCGGGTCAGCATGGCTTCGGGAACCAGTGCGGTGGCCCGGATTGCGGCAG
CGCTCAGCACCGCCGGGCGCAGGTTGACCACCCTGCCCAACAGCGCGGATTCTCCGACGA
>paratb_7364
TGCGCCGGACGCGGCGCCGGCGGAACGCGGCGAACCGGGCGAACGCGGTGGGCAGGTCGTCCGCCTGGTC
GACGCACGCGGCCAGCACCGCGGCGTCCTCGAGCCCCTGGCAACCGCCCTGACCCAGGTGCGGGCGCATC
GGATGAGCCGCGTCGCCGACCACCACGACGGGCCCGCGCGCCCAGGTCCGGGCGGGGGTG
>paratb_7365
CGGTCGTAAAGGTCGTTGCGCAGCACCTCGTCGCGGGCCGTCGCTGCCAGCATCCTCGGAATCGGTTCGG
GCCAATTGGCGAATCTTGCTTGCAGATAGGGCAATTCGCCGCCAGGCGAGAGCTGCCCTTCCGAAGCGCG
CTCGGTGGCGAACCAATACAGGCGATCCGCACCCATCGGCACATGGCCGGTTTCGACGCC
>Contig16_7366
GGGACCAAGTGTCTCGCCGGCCAACTCGGGGTCCATCGCAGGTCGCCACACCGCGCCATGCGGTGTAGCC
GACGTACCGGTCGGCGAGCGGGCCGTTGAGGTGGCGGGCACCACCGAGCGGGTCCCGTCGGCCCCGATC
ACCGCATCGGTTGTGCGGTCGTTGCCGTCTGACAGCCGGACCCGCACGCCGTCGGCCGCG
>Contig16_7367
```

Figure 6-44

```
CGCGTGAGTTTGATAGCGGAGAGCCCGTATTCGATGGTTTCGGGTGCCAGCGCGCCGGTCAGGATGTCGC
GCAGTGCCGAGCGTTGCACGATCACCAACGGTTCGCCGAGCGCCTTGATCAACCGCTCGGGGGCCGGCCG
ACGCAGCCACGAGCCGTCTCGCCAACGCAACGCGCCCGCCGTGATGCGGCCGCCGGCATC
>paratb_7562
CGGGCACCCGGTAGCGCGGGCTGCCGATGATCCTGCCGACCCGCACCGCGTTGTCGATGATCACCTCGCG
CGGCGAGTCGGGCGGCGGCCCCTTCAGCAGCGCCAGCAGCGCCCGCGGCGCCGGCGGCGGCAGCAGCGCG
GAATTGTTGCTGGAGAAGATGACCGCCAGGGTTTTGGTGCGCTGGCGGAACCGGGCGGCG
>paratb_7592
GGAAAAGCCGTCCCGCCAAGTGAATTCGATCGACCTGCACGGCTACCAGGTGGCCACGGTGCTGGCCCGC
CTGCACGCGCCGGCCGCCCCGGCCGGCGCCGCCGCGCTCGCGCCGCACGCCGAGGCCGCCCAGCCGCTCT
ACGCGCGCTACTGGCTGCACAACCGGGGCCCCGCGCCGCTCGGCGGGCTGCCCGCCGTCG
>Contig16_7731
GAGGGACAACTACCGCAAAATCCTAGTGCAGGCCGCGCCGCCGGCGCATTATTTCTCCGAGAGTCGATGC
CACCCCCGGCCCGGCCGGCCCGGCCCGGGTGGCGACGCCCGCGTACGCGCCGGCCGGTTCCCCGTCCCCC
GTGCAGCCGGCGGCTTCGTCGGCGCCGGCGCCGGCCGGCACGCCCGCGGCGGCCGCGCAG
>paratb_7762
GAAAAGTCTTACCGGCAAACAGGATTCATTGATGTGCAGCAGCCCGCCGATCAGCGCGGCCGACCGGCCC
ACCTCGTTGGTCTGCGGTGGGCGGTCCAGCGCCGCGCGCAGCGCGGCGGCGTGCTCGGCCGCGGCGGCCA
GGATCGGCGGCCACGCCGCCCCGGCGTCCCAGCTGCCGCCGGTGCTGGGATACCAGCGGC
>Contig16_7974
TCCCGGCTCGACCACGACGAAGTGGCCGCCATCGACGAGGCCGGCCCCGCCCCGCAGCTGTCCGCCGACC
TGTTGCCGTCCCTGCTGACCGCGGTGCGCCGGCGGCGCCGGCGCGGCCGGGTGGCGACCTGGGTGGCATC
GGCTGCCGCGGCGGCGGTGCTGGCCATCGGCGTGTTCGTCGGCCTCGAGGGGTGGTCGTC
>Contig16_8146
CGGCGAGCGTCAGCGCGACAAGGCAGAACGCGGCTCCGCGCACCGCGACGTCCCGGGCGCGCGAATCACG
GCGGGCGCCGGCGGCGGGGCCGCGATCGGCACCGGCGCGGCTCTGGGGGCGGGCGGCGGCGCGCCCGTC
TCCGCGCTGACCGCGGCGAGCGGGTCGACGGTGCCGTGCCCGACCAGGGGATCCCACCCG
>paratb_8196
TACCTGCGCCACCTGAGCAAGGCCAGCACGCTGCGCCTGGACGGGCTGACCGTGGTGGTCGACTGCGCGC
ACGGCGCGGCCTCCGCCGTGGCCCCGCGCGCCTACCGCGCGGCCGGCGCGCGGGTGATCGCGATCAACGC
CGACCCCAACGGGCTCAACATCAACGACAACTGCGGGTCGACGCATCTGGATTCGCTGCG
>Contig16_8208
GGGATGACGCTGACGAGACGGCCGCCGACGAACCCGCCGCGCCGGATCGCCCCGCGCCCGCCGGCGAGGC
CGAACCGAACGGCGAGCCCGCTCCGAGCGGCGAGGCCCCGCCCACCGGTGAGCCGGCCCAACCCGTCGCG
GCCACACCGCCGGCCGCGCCGCCACCGGGCGCGCCGCCACCGGGCGCGCCGCCGCCGGCC
>Contig16_8240
CGTCGAGCTGAACTTCACCGCGATCGGGCATTTCACCTCGATCCTGATCGGCCTGTGCTTCTACCCGATG
ACCCGCGCCAAGGGCGGGCGGCAGCTCAGCCCGGCGCGGCTGCGCGCCATGCTGCGCCGGCGCGTGGCGC
CGCCGGCCCGGCCCGACGTCGACTCCGGCCGGTAACGACGACTCCGGCCGGTAACCAAAG
>paratb_8291
AGCCGGCCGAGGAGGCCGACGACCACGGCCACGGACATCACCATCACTAGGTCTGCCGAGCAGACGCAAA
AGCCCCCGACACGCCCTGCGTGCGGGGCTTTTGCGTCTTCTCGTTCCCTACGGCGGACGTTTAGTCTCG
CGGCATGGATCGCATCTGGCAGTGGGTGTGGGATCGGCACGGCGCGAAGTATCCCTGGGT
>paratb_8292
CATCTGGGCATTCGGGTTCACATCGATGTTCGTGACCTATGCCCTTTGGTCGCTGGTCATCACTTGTTAC
GAGAGATCGAGTCACTATCTCGAAGCGGTCGTCGTCACCGGTGTGGGCGTTGTATTGCAGTCATTAGTGG
TGCTGCCTGTTCGGCGACGATTTCGCTTGATGCGGCCGGTGTCGGCCAGTGACCAGGTCG
>paratb_8293
```

Figure 6-45

ATCGATTCCAGGCGCTCAACGAAACGTACGTGTGGAGTCGGACAGCGCGCATCAGACAGTTGTGGTTTGT
ACCCATTTGGGCTGCAACGTTTTTCGCGATTGTCAGTGTGCTCGCCGGAGCTCATGGGATGCGGGTCGTC
GAGTACGTGATCGTGGGTGGCGCTATGGGAATCGTCACGACACTGATCAGTTTGCACACC
>paratb_8294
TTCATGGAGGGATCATTACGCCCGGTGAGAGCAGCGCTGGCGGGGGATTCGGGCATCGGCGACGCTTTAC
CGCGCTCCCGCCCGACCTTCGCCTGGTGGTTGGAAGTCTCGATGCTCAGCGCTCTGTGCAACTTCACAAC
CGCGGGCATGATGGTCGGAGCCCTGCTCGGCCGGGTCAGCGATTCCCCGCTGCTGCCCCT
>paratb_8295
CTTGATCGCCTGCGTGGCGACGGCGGCACTCGCGGCGCCGGTCACCGTGGGTGCCATTGTCTCACCGGCA
TTGCATCCGATCCGTGACCTCGCCGAGGGCACTGAACGCGTTGCGGCAGGCGATTACACCCGTCGCGTGC
CGGTGGTCCAGGACGACGATCTCGGCGCGCTGACGGCGTCCTTCAATCGGATGCAGGCGG
>paratb_8296
GATTGACTGAGCGACAACGGCTGCAGGCGGCTTTCGGCACTTACGTCGACCCGGCTCTGGCGGCCCGACT
GCTCGAGCAGGGCGATGACGTGTTCACCGGCGAGCGCCGCGAGGTCACCGTGATGTTCGTCGACGTCCGC
GATTTCACGCCGTTCGCCGAGGCCAATAGCGCCGAGGACACCGTCGCGCGTCTCAACGCT
>paratb_8297
CTGTTTGAGATCGTCGTGCCTGCGGTCGTCGACGGCGGCGGGCATGTGAACAAATTCCTGGGAGACGGCG
CACTGGCGGTGTTTGGTGCCCCGAATGATCTTGCGGATCATGCGGATGCGGCGGTGAGCGCAGCGCTGCT
GATTCATCGCCTCGTCGCTAAGCGTTTCGGCGGTGTGCTTCGAATCGGCATCGGGATCAA
>paratb_8298
CACCGGTGTGGTGATCGCCGGAACCATCGGCGGCGGCGGCAAACTTGAGTTCACCCTCATTGGTGACGCC
GTCAACGTTGCGGCCCGCGTCGAGCAACTCACCAAGACGACCGGTGACGCGATCCTTGTTACTCAGCAAA
CCGTAGACGCCTTGGTTTCTCGACCGCCCGGACTGAGCGACAGGGGTACTCACGCCCTGA
>paratb_8299
AGGGCAAGTCAGCCCCCACAGCGGTTTTCGGCCTCGACCCAGCCGTCACGCCTTCGCATCGCCTCGGCTG
AATGCCGAACGCTCGCCACCCAGTGGGATGGCATGGTTTACATTCAGCACTGTAGATCCTTGGATCTCGA
TCGATTGCGTATCGCTTCCCGGTCCATTCCACGGCGCTTTGCGCGCCGAGCAGATCGGGT
>paratb_8300
ATCTGACGAGCCGAAGGGGTGGTACTTCGCCGTGGTGTCCTCGTCGTCTTCGGTGGACGACAGCGGTCGC
GCGACAGTCCGACAGGTGACTCTAGCCGTGCTAGACGGGTGATCGTGTTGCATCGGAGTCGGTCTTGGCG
ACGTCCGCGAATACGGTTACCTGATCTGTGCCGCGATCGAGTTGAGGCCGATGTGCGACG
>paratb_8301
AGATCTGTTGTACTGCTTCGGTTCTCCGTCGATTCTGTATCGATGGCCCCGTCATTCGACTGCTTCTGAG
CGCCGAGGGCACCCGAGAATCACAAGCCGCAGCCGGTACCTGGACACCGTTCTCGAAGCCTTCGCCCTGG
GTCTCGGTCGTCGCGCTTTACAGGCTGAGGAGAACCCGTGACCCGTCCGGACGCTTGACG
>paratb_8302
GACACTTCCAGCTCACCCCCAGTCGCTTCCACGTACTTGCGGAGAGTGTCGACCCGGCTCGTGCCCAGAT
CGCCATGTTCCATCTGCGAGACGCGGTTCTGCCCGACGCCAATAGCCGCAGCGAGAGTCGTCTGCGTGTA
GCCGGCAGCCTCGCGCAGTTCGCGGAGACGGTACTGGGCAACCTCGCGGTCCATCTCCGC
>paratb_8303
CTTGATCGCGTCGATACGGGTCCGGTTGCCGGGACGGCGACGGCGCATGTCATCAAGATTGGTCATCGTT
TCTTTCCCTTCCTTGGTTTCCGATTGGTGGCTTTGGCTGCTGCCTTGTGTAAACGCTTTTGGTGAGCATC
GAAGAGCTCGTCGGCAATGGGAATGTGCTTGGCATACCACTTGGACCAATTGCCCGCCTT
>paratb_8304
GTCTCCAGCGATCAACATGATCGCCCGCGACCGGGTATCGAAGGCGAATAGCACGCGAATGTGGGCTCCA
GCTTTCGTGGGCGCGGACGGAGCTCCTTCATGTTCGGGTGCCTTGACCCTTCAAGGGTGTCCACAAACG
GCCGCCGGGTAATTGGACCGTGTTCCTCCAACTGCTCGAGCGCTGCTATCAAGTTGTCGT
>paratb_8305

Figure 6-46

ACTCCTCGTCATCGAGGGCATCCATCCAGGCTTCGATGAGAGTCAGGTCAACCTCCCATTTCCGCACTAC
CGCATGATATCAGCTAGGGGTGATGTCTCGAGTGTCCGGGTCCCCAACCGCCCATGGTCGGACGACTTGA
ACCGATCACCATCCCGGTGCGGATTGACCTGCGTTTCACACGGCGGCGCGACGCCGGTTT
>paratb_8306
TGAAGGAGTTGCATAAGTCGCGACGCGATTCCTCCACGCCTTGTCCGACGCTGCGGTTATGCTGACCCAG
CCTGTAGATAGGTCAGCTAAGTAGCAAGGGGACTTCATGACGCAGCCAACAGCGGGTTGGTATCCCGATC
CATCTAATCCGAGCCGCCAGCGGTACTTCGACGGCACAGCGTGGACCGAAAGTTATGCGC
>paratb_8307
CATTTCCCGCGCCGCCACCCGGCGTTGGCCAGCCCGTGAAGCCCAGCCGCCAGAAGAAGTCCGATAAGAA
GTGGATCCTAGGCGCCGGAGCCGTAGTGGTGGTCCTGATTGCCATCGCCAGCGGCGGCAACGACGGCGAC
AAGAAGACCGTCGCGGAGTCGAACACGGCAGCGTCGGTCCCCTCAAGGGCAAGCGCGCCG
>paratb_8308
ACGAAGCCAAAGCATGTAGGGCCTGCCGTCGCCCCCGCTGGGTCCCCGGTGCGAGACGGTAAGTTCGAGT
TTCAAGTGCTTGGTGTCGATCGCTCGGCCACTAAGGAAGGGGTCTTCAGTTTGCAGCAAGCCAAGGGCGA
GTTTTTCGTCGTGAAGCTCCGCGTGACGAACATCGGCGACAAGTCCCAAAGCTTCTCTGC
>paratb_8309
TTCCAACCAAAAACTGATCATCGACGGCAAGAAGTTTGACGCGACGACCTCGCTCAGCGACAACACCTGG
ATGGAAGACATCAACCCTGGCCTCGGTATGGATGGGAGCGTCTCGTTCGACATCCCGCCGGGCGCGGTGC
CGGAAGCGATAGAGTTCCATGACTCGATGTTCTCGGGCGGGGCTCGTGTAGCTCTGTAGC
>Contig16_8461
GGCAGGGCCGGCGATTTCCGCCGGAACGGCGGCGCGCCCGCGGGTCGGCCGGGAGCGCGCAGGCCCGTCG
TCTTTGGGACTATTAGTCTCTATGCTGGCAGGGCGGTCGCGGCCGGCCGCGCCGCGCGGGCGCGCGGGCA
TGCCACCATGAGGCATGACCGGGCCGCAAGGTAACGGAAATTCGAGCAGCAACAAGGCGG
>paratb_8619
GCCGAGCGCGCCGGTGACGCTGGACAGCATCTGCTGCAGCATCTGCATCTCTTGCGAGCCGTTGGCCTCG
TTGGCCGGGAACTTCGCGGCGGCGTCGGCGGCACGGGCCTTGCGGTCCGCGTCGGCGGCGGCGGCGTCGG
CGGCGTCCTTGGGGACGTTGGCGTTGCCGGCCCCGCCGACCATGCCCTGCCCGGCGTCGG
>paratb_8628
CCGCCCCACCCACTCCTGGCCCACCCGCCGACGGCGGCACGACGCCTGCGTCCGTGTGTGGTCGTCCGGG
GAAGCCGGCAGCCCCGACCCCTGGACTTCCGTTCGAGAGCGCTTGATCACTTCCGCTGGAGTGCGGCTCG
CTCGGCATACCACCACCGACTCCCGGTCCGGTAGAGGATTTGCCCTGGCCTAAATGGAGA
>paratb_8632
CATCGCAATATCCTTAGCGATCACATCATCGAGCGCAGCCTGATAATTAGCATCGCTGGCGACTGCACTG
TTGTTGTTTGCAGTGACCGTTCCATACGCTGCCGCCAATGCTTTCGCGGCATCGCGACGATCGGCATCAA
GTGCGAGGTTGTCAGCAGGCATGTTGAGCAGGAGGGCACCGTTAGTATCGGCGATCCGCG
>paratb_8633
CTAGCGCACGATCGTTGGCATTAGTGTCGGTCGCTACTGCCTGCGCCACTAACCTATAGGTGTCGCATAG
GTGCTTTTGCGCAGCTGCAGTTTCGCTGAGGGTGTATTTCGGCAATGTGGTCGCCGCGGGCAATCTTGTA
GCGGGGCGAATAAGAGCGATTGCCAGTGCGCCAGCGGCGACTGCGGCCGTCACGGCTAGG
>paratb_8634
GCAATCGCCAGCCATGGCCGCGGGCGTCGCGCCGGCTGCCAAGGATAGGACGGTGGCCGACTACCCACGG
GCGGATGGACGCTTGGCCCCTCACCAACGCCAGCAGGTAGGTCGCCTACCATGTGCCCTCCTACTAGTCA
GAACGCGCCTGACGTGCCATCACCGCTACCTCTCAATAGTGAGGCAGGCGGCGGGACGAC
>paratb_8635
AGCAATTCACCGTGCGGTACTGTGCCGTGCTAGCCCAACTCCCCACCCATATCCCCACCCTGCGCACTCT
GCCAGTCAAGCGTTCCTCGCAGCAGCGGGTGGCTCATATGCGCCCAAGGCGTATCTCCGAAAGGCTGGGA
CACCTGCCGTGCGGGTTTACCTATAAGGTTGCTCAGCTGCCTCCGCAGACCGTCTTCATT
>paratb_8636

Figure 6-47

```
GCAGCGTTCTTGTTATTGGCATTGTCCAGCGCAGATTGCCAGGCGGGATCATCGCTACCCGTCGCCACGC
TGGATGTTGCTGCCACATTGCTATACGACTCAGCCAGGGCAAGCGCAGCAGCGCGATCACCGGGGGCAAT
TGCCGGATTTGCGTTTACTGCTTCTTCCAGCATCACGGCTCCGTTTACCGTCGCCAGGTT
>Contig16_8667
GGCGCCAAATCGGAGATCCGGGTGGTCAGGATCCGCCCGGTACCCGGGCAGGGAGTGGTCCGTGTCTCGC
AGTGGATCGAACAACGCGATGTGACGAGTTCCCTCACTGGAAATCGGGACCTTGGTAACAATCGTGGGGC
CGATCAACATTTTGACCCCGAGGACACCAAAGTAACGACCTACATCGACTACGAAAACGG
>paratb_8668
GCTCGTGATCCTGCGTCAGAATCCCTCCGTCGAGGAGACTCCCACCGGGGCGCCGGGTACGGTCAAGGTC
GGCACGCCGAAAGGCAGCGTGACTCAGTTAGCTGACGGGTCGGTTCGGATCAAATACGACGCGGGCAATC
CCTTCGCGCCAAGCATTACCGCTGATACGAACGGCCCGTTTGCGGGCCACACCATCACTG
>paratb_8669
TAAACGGTGACCTAGCATTCACCCCGGGACCGGAAGGCGTCCACGTGAATGGCACGCGCACTGATTATCC
CTCCCTCGAGGCTTATCAGGACTTTCCAGGTGGCAGTACCCGCACGTTACTAATCGACCCAGCGCAGTCA
ACTAGCTCGGTGGGACCGATGTTCAACCTTCCGTTCCACCACGACGTCGGCCCATTGGGT
>paratb_8670
GGTAGAGCATTCGCGCCGTTTGACAGTGGGGGTTGGAACCTCAAATACGACGTGCCAGCGCCGCTGCCCG
CGACGGAGTTCGGCCCGGTTACCCGTGCCCCGTCGATTCCTCTGCTGCCAAGCGGAGTAGAGGTCCGGCC
TGATCGCTTACTGACAGGAAAGCTACTCCGATGCCTTCGTTCACCCGCGCAACACCACTC
>Contig16_8671
GACGCCGGCGCCTGGCGCACAGCAACCTGGTCGGCACCCCTTGTCGTCCAACTGATATTGGCAATGCTGC
TTGTCGCCATGTGGTTGCTGGGCAAGTGGCCGTTCGAAACGCATAGTGCGTACGCCGGTGAACGAACATG
GATGCTGACCTCGACCGTCATTACGACTTTGGTGGCGCTGTTAATCGGCGTCGCGTTCCT
>paratb_8672
GAGGTCCCCGTCACCACGTAATCGTGGTCTTGGGGTCAGCATTGCAAGCTGCTCGGTGGTCGTGCTCGCC
GGCGGAACGCTTTTCGCTTACATATTCCTGCGCTAAAGGCCACCGATGACAGACAAACGTTTTGTGGGCG
AACCAAGCGATCGATACGGGCCACTGACTTTCGCCATAGCTATAGTCCACGTCTTTGTGG
>paratb_8673
TCGATCTCATCACCTGGATCATCGTCGTGCCGATGTGGCCCTTCGTCGTCTTCGTTCTTCCGATAACGCT
GGCATACATCGCTGTCGGCGCCATTATTGCGAGGGCACCGGGCAGATGGGGGCAGGTAGGCCGCGGGATG
ATGATTGGCAGCCTGTCAGGACCAATCTCAATTCTGATTTTCATTCCCGCTTTTATTGTC
>Contig16_8744
CGGATAGGTGGTGTGGAGGATCCGCATCGCGCGCTCGGCCGCCGCGCCGATCGGGGTGTCGAATTCGTCC
GCTGTTTCACGTGAAACATTGGCCGGCGGCGAGGTCGACGCGGCGGCGGATGACGGCGGCGCCGTGGCCG
CGGTCGGCGGCGGCGCCGGGGATCCAACCGCCGACGCCCCCCGCGTGCCCGACGGGGCCC
>paratb_8860
CGGCTGCCGCCCGGGTGGTGGGGCTGGACGGAATGGCCGCCGGTGACGCCCGCCCGGGCGGCGGGGACTG
GCTCGGCCGCGGCGGCCGGCGACCGGCGCGCACCGCGGCGACGGCGTCGGCGAACGGCCCCCCGCTGCGG
TAGCGCATCGCCGGGTTCTTCACAGGGTGATCTCGATGAGCTCGCGCACGTTGGGTGGCA
>Contig16_8927
CGGAATTCAATCTGGATAACCCGCTGAACTACATGCCGCCCGAGTTGCGAGCGCTGTCCGAACAACATTT
GACCGGCAGCGGCGAAACCGTCCTCGGCCCATTCAAAAATCCGTCAGGGGACCGTCGTATATCGAGCCC
GCTCAGCAGCGAGGTGCGAGCTATTTCGATATAGGGGATGCATGGAACGCGTCAACCCCG
>paratb_8935
TTCACCACAGAGACTCACGCGATGGCCCTCTACATCAGTACCGACACGCCGCCACTATTTACACCACGCC
CCGGCACGTTCCCCCATAAAGCTGTCAACTTCAATCGATAGGGTTCTGGACAACACGTATACCGCCGCGG
AACTCCGCTATCTAAAGGCTCATGGCTACCAAGTCGTCGACGGCTATACCCTAGTTCCAC
>paratb_8936
```

Figure 6-48

```
CCAAGATCGGAGGTTAGCGCGGATGAAAGCGCTCCTTGAATTTATCGTTCAATACTGTGGCTTCCTCTAC
CTCAACCCCGGCTACAGAATCACGAACTCGGCCACCCGAGGCTTGGCCGACATCGACGCATCGATTACGT
TCACCGGCGAGGAGATCGGGTGGCAGATCATTAATGATCGCGGGCTCATCTACTTTGCTG
>paratb_8937
CGGCGCCGTCACAAGGTGTGTCCGACGATTCGTATGCACTTTCCCTTATTCGTCAATACCTAGAAGGCGG
CGAGGATGTCGGTGCTGGCCCCGCGATCGACGAGGCGAGCTGGTTGAGCGCAAACTTGAGCCGGATCGAG
CGGCTATTTACCGATGAATCGAACGCTGCGCGCGTCTGCGACGAACTTGCCGATCTACGA
>paratb_8938
CGCTCCAATTCATTCAAAAAATGGGGATGGCCCAAACCGGAGGAAACCGACTAGCGGCAAATCCTAGACC
AGTGGAGTCCGCGGCCGATAATGCAGAGCTTGCTACGGTGCCTTTTACGTACTTCGACTTCCTGTATTTA
GACGCTCGATATCGCCTCGCGGATTCGACGACATCCGGAAGTCCGACGAGCAAATCTTCA
>paratb_8939
TTGACTTTGACTGGCCCGGTTGTCAGTTGGGAGCTGATTAATGACAGGGGCCAGTTCGGATGATGAAACG
AATGCGGTATCGCCGGACGAGACCATTGCATGGATCCGAAGCAACTTGAGCCGCATCGAGCAATTCTTCA
CCGCGGCCAAGCGGAGCATTCGTGTGAGCAACTCATTGATCTCGCAAAGGCCCTTGCAAC
>Contig16_8940
AAAGTACTTCGGCTCATCACAGGAGTGAAGCTGCTGCCGAACGGCGACCAGGGGCTGGCGGTGAAAGAGC
GTTCATTATGCGGCTGTACCTAACCCGCCGCGCACCAGGCTGCCAATGCAGCCACTGCGGGACTTCCGGC
GTGACCGGATCTGTGAAGTCCTCGAGGTCGGATGCATCTCGAGCACACGTGGCGTTGCGC
>paratb_9022
TGGTTGGGCAGCGGCTGCGCGGGCAACCCGGCCGGGGCCGCCGGAGCGGTCTGGGCGAGCGGCACCAGCG
GAGCCGCCGCGGCGGGCGCCGGCGCGGTCGGGCGGCGGGGGCGACGGGTGCCGGAGCGACGGGAGCGAC
GGCCGGCGCCTGGGCGGGCAGCGCGACCGGGCGGCCGTGGGTGCCGGGGCGCTCGCGCC
>paratb_9126
GTCGGAGACCGTCATCCAACCCACCATCGAAGTGGCGCCCGGCATCACGATCCCGGTCGGCCCGCCGACG
ACGGTCACGCTGGCGCCTGCCCCGCCCGCGGGCGGCCCGCCGGGGGGACCCGAGCCGGGTGGCGGTGTAC
CGCCGGGGCCGGGCGGCGGTGTTCCGCCGGGTGGTCCCCAAGCACCGCCTCCGCCGCCGT
>paratb_9156
GCTGCCGATCCTGAAATCATCATGCGGATTGAAGCGGACGGCGTCGTCGCGGTCCCGTCGGGATCCGCCC
CGTACCGTTACCAATTGCGTTTACCTCCGGGTGCTGAGCAAGCACCGCGGCGGTGCGTGGTGTGTGGCAA
GTCGTTTATTCCCCAAACCAGCCAGGTGCGGACCTGTGGGCGTTCGTGCGGCGGTCGCGC
>paratb_9247
TGCGCACCATCCGGTTGCGCGCCGTCGTCGATCTGTGAGAATGCGGTGGTGCATTCGGACGGCGGCCGGG
CGGGATCGCGGCCAATCACGGCGCTGTGGGCGGTCCTTGCTTCGGGCGCCGTGCTGTGTTGCCCGGCGCC
GGCCCACGCGGACACCCAATTGTGCGACCCGTCGAGCGTCGATTCCACTCAGATGTGCCA
>Contig16_9248
CTACGAGACCCCGTCACCGGATGTCCGGATGGTGTTTCCCGCCAACTATCCCGACGAGCAGACGATGATC
GGCTATTTGACCAAGGTCGACAACGACTTTCGCAATGCCCGCTCAGCGGGTCAGACGTCGACGTCGCCGA
CGGCGCTGAAGGTTACCGGCACCCGGTACAGCTCCGGCTCGCAGGCGGCGGGCACCCAGT
>Contig16_9249
CGGTGGTGACCGAGATCTATCAGAACCTGGGCGCGGCGCACCCGATGGTTTGGTACAAGTCGTTCAACTA
CAACCTGGCCAGCCAGCAGCCCGTCACGTTCGACGCGTTGTTCCGGCCGGGAACACAACCGCTGCAGGAG
ATCTTGCCGATCGTGCAGAAGACGCTGGCCGACCGGTACCGGGCCACCGTCTCGATTCCG
>Contig16_9250
CCCGCCACCGGGCTCGACCCGGCGAACTACCAGAGTTTCGCCATCACCGACGACGCCATCGTGTTCTTCT
TCGACCAGAACGCGCTGCAGCCGGCCATGGAAGCCACTCGGGTCTCCGTCTTGCGCAGCGCGATCGCGCC
GTTGATCAGCCCCGGCATCGCATAGTGGCGCCGACGGACGGGCGCGTTGCGCGATCGGCC
>paratb_9272
```

Figure 6-49

TCCGAATAGCGGATTCGGAGAGATATCCCAGTACTGACATTGCCTGCGTCGGCGGACTCCGCCCTTCGTG
TACAACCTGCTAACGGTGGGGCGTGCGGTTATGGCCATCGATGTTCTTGTTGCACAACGGATTCAGAGCA
CCGTTCGGCGGCCGGGTTACCTGAAGGCGTGGATCCGCGACAGCTGAGCGTGGAGCGTGT
>paratb_9273
GTAGCGGCACCCGCGGTCCGAGGATCGGTCCGGGACGGCGTTCCTTGTGACCTCGGCGCTCGAGTCACGG
CGCCACCCCGAACTCGTCGCCGCCGACCACGGCCTGGTGGCCGGCCGCAGACGGTTCTTGTCGTGGGCGC
TCACCGATGCCCTCGACACCGGTGAGCTGTCCTCGAAACCGACCCTGCCACGATTGTGGA
>paratb_9274
GATGCTGTTGGCAGCGCTGCTGGGGATGGCATTGTCGGCCAGCCATATCGATTTCGACCTGGGTTCCCGC
GACTTCGCGGACACGTTCGGACAGCTGCTGTCCGCTCAGTCGTGGCGATCCGAGACGGTGAGCTCCGGCA
CGATTGTTGACCTTCCCTGTGTGTGACGACCGCGGCGGGATATTTATCATTTGTCTTGCC
>paratb_9275
GATAACCGATGTCGGGGCTGACCGTCGTCTGCATCATCACTGTGCCCACGATCGGCCCGGCTGTCCGGCG
GCGCCGCCAACTTGCCGATTCGATCTCGGCGCAGTGGAGATTCGTCTGGTCGTCGGCGGCAGCGCGGGCA
GCGGAGTTCGCCGTCGGCGAGTAGGTGCTCGGCGAGTTCGGCGGTGCGGGCAACGATCAC
>paratb_9276
CGTGCAGCCAGTCCATGACCCATCAGCCTTGCCTATCGCCCTCGGGCGGGTACAGGGGTCAGTTCGTGTT
GGACGACACCAGATTTGGATCAGCCGCCGTCACTGACGGTGCCCGGCCAGCTGGTCGCCTGGGGATACGG
GCCGGCGGCGCACCGTGCGCGACCGCGACAGCACCACGGTGACGGTGCGACCCCGCCGCA
>paratb_9277
CCCGATGCGATCGTGCTCATCAACGCATATCGTGATACCCGCAGCCCTGCAACCACGTCACGCCGACACC
ACCGCGGCGATCGGAACAGCATTGCTGCACAAGCCAAATGGAATTCGACACCCGGCGCATCGCGGTCGCC
GTCGATCGGCCCGTGTCCACAGTGCGGCGCTGGCTGCGCCGCCTACCAGCGGCACACCTG
>paratb_9278
GAACGCATCTACCAAGGCGGCACCCGACAGCCACTGGAACTGGATCCTGACGTTCGCTGCGCAACACCGC
AACCTGCTGCATCACGCGTTGTCGATCCTGTCGACAGCCGCCTACTGTGAACGCCACCGCTAGGGCATCG
ACGACCCGCCCTGGACCCTGATCGGGCCTACACCCGAGGTCGCCTGTTGTCGCCACCGGC
>Contig16_9279
CTGAGCCTCATCGCGGCCCCGCGAGCCATCGGGAGCGCCGTTCGGCACGCCCGCCGACGCCCGTCACCA
CGACGACCATCACGTCGCCGCGCCGACCAACCCGTCACTTTCAGACCAACTCCCGATATCACGTCCGCGC
CGACAGTGACGGCATCATCTGCATACTCAGCGACGGCCAACAGAGCGCAACGCCCGACGG
>paratb_9280
TAACAGCATCACTTCGTTTGGTGGAGTACGGGTCCGCGTGTCCGCGGTCAACAACGTGGTCACCGGGCTT
CCCGGTTCGCCGCGGCGATGTTGTCGAGGAGGTAATAGTCGCGTTCGGTGCTGCCAGGCGCCATCGGGTG
CGGCGGGGCCGCCATACCGGGCTGCAGTGGCGCCAGCAGCTGGTCCTTGCCGTAGATCAG
>paratb_9283
GGATCGGGCCGACTTCGAGTGCGCCGGGCCTGCTGCGCTGCCTGCCTCCGAGCTTGGCCGCGTCCACATG
AACCTGAGACCCAGACTAGGCCGTGTCATCAAACGGCGTTCCTCGAAACAGCCCTGCCGCATCACCTCGA
CGAGCGGGAACATCAATACACACCCGAATCCGAGAGGCTGGGACTGTCTAAATAGCGGTG
>paratb_9284
GATCCGACCTTCATTGTCTGGTGTGCGTCATCGAGGTGGTCAGGTTTGTGGGCGTCCATTCCGTCAGCAT
CGGGGGCGGGAAGCCGATCCGGGAGTGCGAGCTTGAAGATGGTGCGCACGGTCCCTAGGTATTGGCGTGC
GAGCGGACCGGTCGTGTACGGCAGGTCGAAGCGCGCGCATATGGACCGCACTTGTGGTGC
>paratb_9285
GATCTGCGCGTAGCGGTTGCTCGGGAGATCCGGAAAGAGGTGATGCTCAATCTGGTAGCAGAGGTTTCCG
CTGAGGAATGCCAACACCGGCCCGGCGCGGAAGTTCGCAGTGCCAAGCATTTGTCGCAGATACCATTCGG
ATTTGGACTCATCGTTCAGTGCGTCGGGCGCGAACTTCTGTGTGTCCTCGCCGAGGTGTC
>paratb_9286

Figure 6-50

```
CGCAGCAGATCACCACGTAAGCCCACACATTTCGCAGCAGGTTGGCGGCCGCGTTCGCGGTGAGCGTGCG
GCGCCATCGCCGAAGACTCAGCGCGGGAAAGATCAGATAGTCCTTGCCGGCCTGGCACGCCACTTTCTGC
ACCAAGGCGGTGGCGGTAGTTGTGGGCATAGCGCCACTGTGAGGAGACGCCGACCATGTC
>Contig16_9287
CCACTCCCAGGTGCTGGAGTGGATTTCCGGGTCGTTCATCCAATCCCATTGACCGTGGCAGATGTTGTGA
CCGAGCTCCATGTTCTCGATGCTCTTCGCGGTGGCCAGCGCGGCGGTTCCCAGTGCCCAGCCGGGCCCGC
TTCGGCTGGCGGCGATCACAAGCCGTGCCGCGAGGTCGAGGCCGCGCTGAAACGCGATGG
>paratb_9288
CCCGCTGAATGTATGTCCGATCATGTTCACCGCGCGAATTCTCGATGTCGCGACGGATTGCCTCAAGTGC
GACACCAAGCGCCTCGAGGTCCGCCTCCCGCAGGTGAGCGTATTCGGCTGCGTCTGTTATCGCCATCGTC
GTCTTGCCCAAGTCTGCAAATAGTTTGGGGGTCATACCTATTCGCACAGAACGACGGTGA
>paratb_9289
GTTTGGAAAGCTTGCTGCGTGTCATCGAGGTCACGTCCGTTCGTGGTCGCCTTGTTGAGGCTCGGTGGTG
TCCGCGGGAGCGGCGCCGGGGATCGTGAGGCGCACGGCCAGTCCGCTGAGCAGAATGTCGAGTCCGCGGT
CGAGTTCAGCCAGTGGGTCGTAGGAAGCCCAGACCGGTGCGAGTTCGCGTAGGTGCCCAA
>paratb_9290
ACTGGTCGATCGGAAGCCGGTGTAGACCCAGCCGCAAGACGTGGTCGGTTTCCTCCGGCCGCTCGACGAT
TTCCTGCAGTTCGGTAAGTACGTGCCCGTACAGGAACCCGAACAACGCCCGGTAGACGTGCAGCGCGTCC
TCCCCGGTGAACCCGGCCCCGATGAGCAGGGTCAGAACCTCTTCGAGATGCCGCAGGATT
>paratb_9291
CCCGGTGGGCGCATCCCAAGCGGTGTGGCCAGCGGCCGGGTGACCAACAACGGCACCACGTTGGGGTGCG
CACGTGCCAGATCTCGGAATTCGTGGCCGAGCTTGCGTAGTGCAGCGGCCCAGTCCGGCGTTGTGGTGTC
CAGCGAAAGCCGTTCGAAGACCATCTCGACGACGCCGTCGAGCACCGCGGCCTTGTTCGG
>paratb_9292
CACATGCCGATACAGTGCCATCGGGTCGCGCCCGACGGCCTCGCCGAGCCGCCGCATCGAGAGCCCGTCG
ACGCCGTCGCGGTCAATGATCTCCAGGGCGCTGGCCAGGACCGCCGCACGGGTGATCGGCCTGCTCTCAC
CGTCGGCCTCGTTGTTGCGGGATTCGGGCGCGGAACTTGCAAGGCCTGCTGGTGGTTGGG
>paratb_9293
TCATGGATGCTGCCGCCTTCCGGGCGTGTCTCCAGTGTTGATCTCCACCGTAGGCCTACACTGTAGACAC
CGCAATGCCGAGTCACCTTCACGCTGTTGACAGTAGTAGATCTATGCCGTAGATATACACCGTTGACAAG
CTCGACGATGTGGCGTGTACTGGACTTCTAAGCATCAGTAGAGGCGCCGCCATGATCGAC
>paratb_9294
ATCGTTGGACCGGTTGCCTTGCTCGCCGGTGGTCGTGGGGTTCACCGGGGTGCTGACCAACACGGGCTCG
CTGGCCTATCGGCCGCGAATGGCGCCGCATTCGGCGATGACATCACCGCGCCGACGCGCACCCCTCCGTC
CTCGGGGTCTTCGTTGGCGCATTTCGACGCTCGGCTTGAGCGTGCAGCCAGCCGGTGTAC
>paratb_9295
GGCGTTCCGCGGGACAGGGCGAGCCGCCCGCCACGATCTGGAGATGTCGCTGGCTCGCCCGGCAACCAGT
CTCGCCCATGTCTTCATCCCGCGTTCGCGGGTTATGAACACCGAGAACCCAAGGAGTCCGCAATGAGAGT
GGCTGCAAAGATTGCCCACAAGTTCGAAGCCGCCAAGGGCAGCGCGAAGAAGGTCTTCGG
>Contig16_9296
TCGCGCCACCGGCAACACCGGCATGCGGGCCGAGGGACGCGCCGGCCAGGTCAAAGGCAACGCCAAGCAG
GCAGGCGACAAGCTCAATGACGCTTTCAAACACTGATCCCGGGCACATCCGCCCCGATCATCTCCACGAG
ACTTAGGTAACTATCATGATCATCTTCGGAATTGTCCTTATTGTTTTGGGGCTGCTCCTC
>paratb_9297
CCGAGCCTTGCCCCCACATTCGCGTTCGCCCATGTTGTCCTGGTCATCGGGGTCATCCTGCTGGTCGTGG
GCCTGCTACTCATGCTGATGGGGCGCACCGGTCACGCCATCGGCGGCCGGCGTCACTACTACTGACCGTG
GTTCCGTGGCCGACGGCATCGAGTCGACGGCCACGATCGGCCCCGTGACCCGACAGTCGA
>paratb_9298
```

Figure 6-51

```
GCACTACCACTTCGAGACTGCACAGCCGCAGATGGCACCGACCAAACCGCCACGCTGCGTGCAGAACTCA
TGCCTCACCAACTCGCAAGGAGCCGATATGTCCACCAGCAGTGCCGTTTTCGTCGTACTCGTCGTGTTCG
CCACGACCGTGCCCATCGCAATCTTCGCATGGGTAGCGGGCAAAAAACACCGCAAAGTTC
>paratb_9299
GCCCTGCGGCGCCCGACAACACCCACCAATCCGTCAAACAGGGAGACCCACCGCGATTTCGACAGCGCGA
GGCGTGGGCTGACGAGGCCGCCGACCTCAGCACTGCGCGCGGTCAGAAGCCGACATCTGAGCGACCCCAG
CATGGGGCCTGCCTCAACGGGACGGCGTCCGCCACAACGCGTCGCCGAACCTCCCTGAGC
>paratb_9300
AGCTCGACGACCCAATGGGACCGAGCGGACACGATGGATACTCTCCGACATGCGCCCCATGAGCATGTGA
ATGCCGATCACAAGGAACGCCAAGACAATTGACATTATCCACGATGCCCCGGACGGTCGGCATAGAGGAA
GAGTTCCACCTTGTCGACCTCACCACCCGGCGGCTGGCACCGCGGGCACCAGAGCTGCTT
>paratb_9301
GGACTGCTGTCTGACGGTTATGTGGCCGAATTGCAGAGCTGTGTCGTGGAGACCAACGGCAGTGTGGTCA
GTACGCTTGCGGAACTGCGGGCCGATCTGACTGAGCGGCGTCGAGTCCTCGTCGATACCGCCGCTACGCT
CGGGTTGGGCGTGGTTGCCGCTGGGGCGGTTCCGTTGTCGGTGCCCAGCGAGATGCACGT
>paratb_9302
GACCCAGACTTCCCGTTATCAGCAGATACTTGCCGACTATCAGCTGTTGGCACGCGAACAACTGATCTGT
GGAACCCAGATACACGTGGGAATCGACGACCGTGATGAATGTCCTGGTGGCCGGTCGGGTAGCCGCCTAT
GTTCCCACTCTGCTTGCCTTGAGCGCGAGTTCGCCGTTCTGGTCCGACGGATCTGACACC
>paratb_9303
GGCTACAGCAGCGTCCGAACATTGGTATGGCAGCGATGGCCGACCACCGGATTAGCGCCTCCGGCCACGT
CAGCCGCGGAGTACGACACGTTGATCTCCAATCTCATTGCGACCGGAGTGATCACCGATGCGGGGATGTC
GTATTTCGACGTTCGCCCCGCCCTGCGAACTCCCACCTTGGAGCTGCGCGTGTGCGATAG
>paratb_9304
CTGTCCACGCGCCGACACCATTGTGCTCATCACGGCGCTATTCCGCGCGCTCGTCGAACGCGAGATCCAG
GGACTACGCACCGGAGTGCCTGCCGCCATAGTGGTGCCCCCGCTCGGCCGTGCCGCGCTGTGGCGAGCCG
CCCGGTCAGGACTGGAAGGTGACCTGGTGGACTTGATACATCCGGCGAGTCGCCCCGCCG
>paratb_9305
GCGATGTGGTTACCGACTTGGTCCAGATGCTCCGCCCACAGCTGGAGGCATCCGGGGATTGGCAGGCCGT
TGAGGGCCTGGCGCGCAAGGCTCTTACGCAGGGCAGCTCTGCGGCCAGGCAGCGTCGCGCCATGCGCACG
CGCAATGACCTGTTCGACGTCGTGGATCACCTCATCGCCGAGACCGCCGCCGTCGCGCCC
>paratb_9306
GGCGCCCACGGTACGTTGGCAACCCGTCGTAATGGATCTGACGGGGGCTGAGAGCCACCGTCGGCACGGC
GCAAACAAATCGCTAGACCGCGGCCTCCATTCGGAGCTGGACCGGCGTAGGATCAACACCATCGGTGGTA
TTTCGTACACACAGCCAGTTCGAGTGTGGCATCGCTGATTCGAAGTGATATGGCCGCATC
>paratb_9307
ACGCGGTCCAGATGGGAGCGTCGCCATGACGCCACAGCAGACACGCAGAAACGATGAGAACACCATCGTG
CCGGCGCGCACGCCGCGCCTCCGGTTAAAACCCAAAGCACCCCAAAGCGGCTATGTCGATGGCGCCTGGT
GGCCCCGCAGCGATGACCTCAGCGCAGAGTTGCCAGACCTGTTGGCAGTGCTCTCGGTGC
>paratb_9308
GCCTGGGCCGCATCGACCGAGTGCTATACCACCTGAACGCCTGGGCGGACGCGCCACGAAAGCTCGCCAC
CGGAGGACGGGCGGTACGCCTAGACGGGTACCGGCTTCAGCCGATCAACACCATCGAAGTTCTCGGGCTC
GAGGGTGACCGACTCACGCTATTGGTGATTCCGCCCGACACCGACGCGAACGACGCCCAC
>paratb_9309
CGCACCATGATGACCGCGGCACAACCTCGCAACGCCGCGACCGTCGACGGATTGCTCACGATCAGCCAGC
GAGACCGGGACAGCCGCACCCAGGCCTCCACCGCACAAGAACGCTGGGAATCAGAAGGCGGAACTACAGC
TTCCCCACGGCCGGCGCAGCTCCCCGGCTGACGCCGGAACCTCGCCCGCGGCCCCGCATC
```

>paratb_9310
CGAGGGAGGACATGCCGGGCACTTATGAGCGGTGACGAAACAGCCCGTGCCGCTTCCGCTTCTCGTCACC
GGCCACCTCAGTCCAGCCGCCCACCGGATAGGTCACGGGCTGCATTGTTCCAGCACGGACAACCTCCAAC
GACCCGTCGGCGTGCTTGACGTAGCGGTCACCGAAGCGCGCAAACTCATCAGTGAGCCCA
>paratb_9311
TCGTTGCGGGTTACTTGCACAGTCATGGTCAAATCCGATCCCTGGCGATATCGCCAGCATCCCATTCTTC
AGAAGCCTTCGCCGGGATGGGAATTCGGGAAAGCACTGCGTGGTTTGGAGATCCCTGAAGCCCAGCGCTG
CTGGGCAACGCCAGCCCGATCCAAGCTGATTCGGACGCGCGGTTGGATCCCCAGAAGCCG
>paratb_9312
ATCTACACACGTCTCGTCGCTGGGATGTGCGGCCCTCATCATCGTCGCATGCGCATCGGAGGCATCCGCG
CACACAGCCACGACCAGCAGATCGAGTCGACGGAATCCTGATCCTAGCAGGCTGACGGTTGAGATAGGTT
GGCGCTCATATCCATCCAACTTGACCGGACCGCCACCAGCGTCGAGTTTTCGCGGCGCAG
>paratb_9313
ACCGCCAGTCAGACAATCGATAGAGTACCCGTTCGATGCGGCCCAGGCGCACCGAGAGCACTGCCAACAG
GTCTGGCAGCTCTGCGCTGAGGTCATCGCTGCGGGGCCACCAGGCCCCATCAACATAACCGCTTTGGGGT
GCCGTGGGTTTCAACCGAAATCTCGGAGTACGGAACGGGCCCTGCTTCCGTTGCGGATTC
>paratb_9314
TCGACCGCTCGTAGCGTCATATGAACGCTCCCATCTATGGCCGAGCCAATCGACCTAGGAATCGATGCTC
CAAACCCCATGGGCAATCTGCACGACCGAACACCAACATGTTTAACGATACTCGCAGTCACACAAAATAG
CGATAGGCGAGGACGCATATGACGGATTGCGCGAAGGAACCACGCAGGGCGCCTTACAAA
>Contig16_9315
TAGCTGTTGGCGTCAGGCGGGCTTGACCCTTCGACTACCGCGACGCCGCCACCGTAGCCACCCCCCTCAA
CACCGCGTCGCGCTGGTGCCGGCCGCGGTGCACACCGACCGACCAGCCGACATCCACTTTGGCGCACGGC
AGCTCACCCATCAAAGGCCACACTACGCCGACGCCGCCCTGCCGACTCCTCGACAACGGC
>paratb_9316
CCACCCTGAGTGTGTCGCCGCAAGTGCCCAGGGAATTCAGATCACCCATCCACACAGGGAGAGTCCGATG
AAGACGGTGTCGGAGAACACCTTCCGTTAACACATCCAGAACAGCCGGCGGCGGATCACCGGTTCAGGAC
ACGGGCGCCGGACTGGCGTCGCCGCTGCCCGTCCCCTCAACGTCGGGATCGGTCACCCGG
>paratb_9317
GCATCAACACCGTAGGCCTCACGAAACTTCACTCCGAGAACGACCAGGCGCATCCACACCGCCGGCGGAT
CGGTCTCCTGGCCCTCGACCCGTTTGCCGAACGCGGCACCGGTGAGAGTGAACCGGACGCGATCCTCGCC
ATCGTCAACCCCAGCCACCAATGTGGCCAGGCCCCGCCTCAACCCGATACGTGGCCACAA
>paratb_9318
ATTCGCGCTCGCCGTCCCGAACAGCCGAACTCGATGAGCCATCAACCGCACCACACCCGACCAGTCCACC
GATCACCGCAGGCAGCGCTGTACTCCGCAGTTCCTCAACCGAGATCTTCGACCTTGACGTCCCCCGCAAA
TTGATGCAAATCATCGATCCGAGCACCTGCTCCGCAGTAATGGTGGCCTCTGGTGCCGCC
>paratb_9326
TAGTGGAAACTCGCAGAGCCTCAGGCGAAACGCCGATCGGCTTTACACCACTTCACGGGGCACAACCCGA
GCAAACAGCTCCGACTGCACGTTGAACACACTGTTCAGTTGTTGCTGCCGTCAGCCAACACCCCAAATCT
AGACGCCAAGCAAACTCCTGGACCCTACTCGTCGAACAATCCCGGCAGCCCAACGTGAAA
>paratb_9327
CAGTGCGACATCGCGCGCAGTGTCCTGTTCTCCAAGATGTATTGCGAAGCAGCGATTCCCAGTCATCGCC
GGTACTATCCCCGGGCCCAGCCAGGCGCAACCAGTCAACCAACGGTCCGGCCCACCGGGGCCGACTCTTC
TGGCACCGGCCCCGGTTGACTGACACGTTGTGCGACAGCGACCGCGACATTCAAGTGCGA
>paratb_9328
CGCCACAGAACCGCGCTGACTGCTTAACCCGAGGTCGCTTTTTTCTGTGACGCCTAACGGCGAACTTCGA
TTACGACCACTCATCCGCCGCTGCACCACGGGTTCCCGCCGACACCGGCCCCAAACCAATCCGTCGTGTC
GGTCGTGCTCATGCCCTACACAGGCGGGTCAGGGCCGGACGCTGCGGACAGCGCTCAGCA
>paratb_9329

Figure 6-53

```
TCGCACCGCGTCGGATTCCCCTGGCATGTCGACGAATCGCCTAGCGGATCTTCTCAGGAATTGAGTCCAG
CGCACGTAGCACCTGGACGGCGAGCTTGCCAGCACTATCGTCGTCGAATATCGCCGATAGTGCTGCACTA
TCGTCGTCGAATATCGCCGATGTGATCAGTGTTTGTTTGACGAGTTCAACGCGCCTTTCG
>paratb_9330
TAGGGCGTGCGAAACGTCGTGGGGCCGTTCATGATTTTCCCATTCCGTCAAGCGTGTTCACTCAACCGAG
ATGCCGCTCAACACCCTCCACAGTACCCTGCGCGCTCCTCGGAGCGGTGCGGCCAGAGACGACGATCCCG
AGGCTGCACTTCGTCGGGACTGTCGGAACAGAGCCATCCGCTTAGGAGGAGGTGGCTGAT
>paratb_9331
AATCGGCGCCTGCCTTGCGCAAGGGTTCCATTCCCGGGACGAGGCCCAGTCCGTGGCGGCCTTGACATC
GCGTCATCACGAGTTGCGGCGGGCGACCTCGGCGGCGTAGCGGGGGCGAGTGTTGCCGGCTTCTTCGCTC
CAGGTGACGGCGCGTTTGATGCTGAAGCCGAGGAGTTTGGCGAGCACGACAGCGGGCAGT
>paratb_9332
TCGCCGGCGAGGTCGATCAGCGCGGTGTTGCGGGCGATCCGGGGGGAGATGCCAATTCGTTTGAGCCGCA
GCCCCACTTGGTTGGCGGACAGGTGCCCACCGGAGCGTCCTCCGGGAAACAGCCATGGATTGGTGCCCAC
GGTGACCGCGGCGTATCCGCGGCGCTGCTGTACGAGATCGGCGAGCAGGCGGTCGACGGG
>paratb_9333
GCTGGGCACGGTGAGCGGGACGGCGCCGAGGGTGAGTTGGACCGCGTCGTCGGTGATGGTGACGTCGGCA
ACCTTGAGGGTGACCAGGCGGGCGGCGGGTTGGCTGTAGAGCAGCACGAGCAGCCCGGCGACCCGATCGC
GCGTCTCCAAGTCGGGGTGTTCGATCAGGTATTGGATCAGGCGCCATCGTTCGTCGTCGC
>paratb_9335
ATGGCGGCGGCCATGATCTGGGCGGCGAGGCCGTGGTTGCGTTTGAGTGGTCCTTTGTCGGCGCGGGCCC
GGAGTTTACGCAAATGATTCCATTCGGTGAATGCGCGGACGGCCGCGCGATCGTCGCGGTTGCTGATGGT
GGCCAGCCGGGCGGCGATGTACTGCTCGGTGCGGTGCAGATAGGGGTCGCGGTCTGGCAG
>paratb_9336
ACCCTCGGCGGTCACCAGGATGTTGCGAAGCCATTCCACGGATTTGCTGGCCGGGAGGTCATCGAGGTCG
TGGTGGCTGAGGGTGTCGCCGAGTTCGGCGAGCTGCGCGGGCAGTTCACTGTTCGATCGCATGCGTCTGA
CCCATCGCAGCACCGGCATGGCGTCACATTGCAGCAACGCCTCGACGATGCGGCTGGCGG
>paratb_9337
CGCCGCTCAATTCGCCGTTCTTGGCGAACAATTCGCGGAGCTCACCGGGACAGGCGCAGGCCGGGCACAG
CCCACGGTGGTACGTCCGTCCATGGGCGCCGCATTGCACACAGTCGGTGAAATAGGCGGGTTCACGTTGC
AGGCAGGCCGAGCACAGCGGCCCCGACCCCGGCAAGCCGCGCCGAGACCCCCAGCGTTTTG
>paratb_9338
CCGCACCGCGCGCACGGTTCCCGACTTCGTGCGCACGGGTTACACACCGGCTCACCGGCGTCAGTCCGGG
TGTGCACGGAGCGGATGTTGCCGCATACCGAACAGGGTTGGGGTGGGCGCTGTTTGGCCGAGCAGGTGCC
GCAGATCGGCTTTCCCGTCCGGGTGCGGGTGCATGGGCGAGTACGTCCGCACGAGCTGCA
>paratb_9339
GACCGCGGTGGGTGCCGGGTAGCAGCGCCGGCAGAGCTTCGCTTGGCCGTCATGGTGGTTGATGAAGTCC
ACACGACCGCACCGTGTACACGGCTCATGATTGACCGGATCATGCTCGAAACAACGGTGACAGAGGCGCT
CGCCGGCACCGTGATAATTGATAAGGTGACGCTGGCAACCGCAACGAGCGCAGGTGCCGC
>paratb_9340
GGCTGAAGTGGTGACCCCAGCAGGTATGGCAGCAGCGCAACCCGTCAATCTGGCTGCCGAGCTTCACGGT
GCGCAAACACAACGGGCACTGCGGAAGGCGCACATTGTCGGCACCGGCAGCGACAAGTAGTTCGGCGAGC
CGCACCGAGACCGCCGAGCGGTGGGCGATCTCACCGCGAAACACTCCGGGGGTGTCCTGC
>paratb_9341
AAGATCCAGTTAAGCTCGCGCTGCGCGACCGCCGTGCCGAACACCGACGCCACCCGGTCAATCTCGGTGG
CCGAAAGCCCGGTCCGCAGTTGCGCGATACCGTCACGAACCTTGGCGGCGTGATCGACGTCGGGTTCGGG
CTTGCACCTCCGACACAACAGGCCATCGCCGTGCCGCGGCCGGTAGATCAACTTGTCCAC
>paratb_9342
```

Figure 6-54

```
CGCGCCGCAGCCCGGGCATTCACCGACAGCCGGCTGCCAACCCTGCATCGAACAGGCTCGGCAGATGCGC
TTCTTGAGCTTGCGCGAGTAGGTTTCGGAATCGTTGCGGCCGCACTGGGCACACCGCGGCGCTCGAACAC
GCATGGCGCCGAGTTGGCGCAGACACAGGATCAGCTGCTCGATGTCGGCGGCGCAGTCGC
>paratb_9343
TGCCGCCGGGCCCGGTGAGCACGCTACCGTCGCGCCGCAGCGTTCTAGACAGCCTCTGCAACTGCGCGGC
CGACAGGCCCATCCCCTCGATCGCGGTGCGGACATCGTCGTGGCTCAGGTGCGGCTCGATCGCGCCCACT
GCAGTGACGATCACCGTCACGAACTCGCTGCGGTTTCCGCGCATCCGCCGGCCTAGGAAT
>paratb_9344
CCGCGTCGACGATCTTGGCCCGGACGGGGCGGTGGCCACCAAGTTCCCGCGTCCTGACCGGTTTGCTGCG
CTCCGGTGCGCCCGCGGCCTTCTTCGCCGAGGCAGCTGTGGCGGGCACGATCTCGATCAACTCGTCCATC
GCACACCTCAAAATGTCCACCAGTGCCACCAGGGTGGGCAGGCTCAACCGTTCCGGTTTC
>paratb_9345
TCGGTCACGAGCCGGTAGACCTGGCTGGCCGACAGCTGCACCCCGCGTTCGGCCAGCAGTGGCCGCAACG
CTGTCGTGTTGAACAGTCCGCGTTCGGCCATCAGCCTGCGCAGATGCCAGTGGTAATCGGCGGTCATTGG
TGTCCCTCTCCAAAGCTGGACACCCGCCCCAGCGCGTCGGTGAGCATCTTGTTCATGAAC
>paratb_9346
TCGCCGGTGACATGGGTATAGATGCCGGTGGTACTGGCGAACCGGTGACCGGAAATTTCCTGCAGGAACC
GTGGATCCACGCCGTCCTCGGTCATGTGGCTGATGAACGAATGCCGAAAACAGTGCGGGGTGAGCTTGCG
ATCCAAGCCCACCTCATCCCGGATGTCGTCGAAGGTGCCGGTCAACGTCCGCACCTTCAC
>paratb_9347
CTGCGAGCGCCGTTCGGTCAGCCACAGCGCCTGCTTCTGCCCAGGCTCATACAACGGTCGAATGTTGTTG
ACATAGTCCAACAGTGCCTCCGCCGCCCACGGCATCAACGTCGGCACCGTCCGCCGCTTGGGCGGCGACC
CTCGCGAGGCCTTCCCGTACCGGACATGCAGAAACCCACACTGCCCCAACTCGGGAGCGT
>paratb_9348
GCGGATTGCGATACATGTCGGCCAGATCGAGCCGACACAGCTCGCTGATCCGCAAACCCCAGCCGTACAT
CACCTTGAACATCGTCGTGTCCCGATAGGCGGCCAACGTGCCCTTACGCCGCGACCGGCGAGCCTTCTCG
ACCTGCGCGTCGGCGCAATCAAGGAAATCCTGAAGCTCCTTGCGGGTGAACGGCCGACGG
>paratb_9349
CCCGGATCACCCTCATAGTCGACAAGATGCGCCGAAGTGTTCCACTCGTGACAGATCTGCGTCGGATGAT
CGCCGAACCACAGTTCACACTGCGCCGGCCAGTCGTAGAAGGGCGAGGTGATGAAGCTACAGAACAGCCG
GACCGCGCCCTGCTTCTGACGGATCGTGGACTTCGCCCGAGACAGCGACCCCACCAGATG
>paratb_9350
CGCGCTCCACTCATCCATCATCCGAGCGGTCCACTCCCACGGATACGCCCCAGAAAACTCGATGAACTCA
CCGACGCACGAGGCCCGCACCTTCACCGTGTTCTCCGCACACAACCGCCCACCCAACTGCTGCTTGGCCC
ACCCCGACAACATCGCCCGCACCATGTCGTCCTCGGGATGAAGATGCCGCACACCCGGCG
>paratb_9351
CCAACTCCAGATGCGCCGAGCCAGGCGCCGGCGACTCCCGTTTCCTGCCCACCACCCCCCACCTTCCAAT
GCACTAAACATGCATCACATGCAATCTACGTCAGAAACGCCCAGTTCGGAAGCCCCCGCCCGCATTACAT
GACGTACACTCCGTGTGTCGAACACCGACATCCCATCCCGATCACATCATGCATCTGATG
>Contig16_9360
GTGGCGACCGGCCCTCCGCTGTACAACCCGAATCCCAGCCTGGCCGACCCCAACCCGCCCTTGCCGTGGT
GGCCATGGCAGATCGGTCCCGCGCCCCGGGTGCCGGGCACCGCCGACCCCGACGACGCGCCGCCGCCTCC
GCCGCCGAGCCCGGCCCCGCCGGGTCCGCCGCCGAGCCCGGCCCCGCCGGGTGCGGTCGC
>paratb_9604
CGCCGGTCGAGGTGCCGCCCCCGGTGGCGCCCCCGCCCCCGCCGCCGCCGGTGACCATCACCCAGGTTCT
TCCGCCGCCCCCGCCACCGCCGCCCCCGCCGCCGGAGGGCGGCGGCGCCACCGCCGCATCCAACGGGCCG
CCCGATCCGCAGACCGAGGACGAACCCGCGGTGCCGCCGCTTCCGCCGGGCGCGCCCGAC
>Contig16_9713
```

Figure 6-55

```
GGGGTCCTGCGGGTCTGCCATGCGGCCGCTCCTCGACCTTCCTCTGTCGTCGTTCCCTGGCTCACCGGGG
TCTTCGACCCATCATGCCAGGACGCCTTCCGCCGCCCGGGCCGCCGGTCATCGCCCGCGCCGGGCCGCCC
ACCAGGCGCCCCGGCGATCAGCGCCGCCGCGGTCGCCACGAACGGCCAGACCGGCACCG
>paratb_9737
ACAGTGACACCGCGGTTAGCCGCCAGAGGCAGTAGCGATGCCTATCCATACCCCCTGGGGCGGTGTGGAT
AAACCTGTGGAAACTGTGGATAGTGTGCGGCGGTCGGCGGCGTTGCCCGGCCGGGCGGCGATCGTCGGCG
GCGCTAGTCTGGTCCGGTGATCCAGGTGTGCTCTCAATGCGGCACCCGCTGGAATGTGCG
>paratb_9760
GCTGGCCGCCGCCCGCTGGGGGTTGGACACCCTGGCCGACGGCGTGGTCGACGAACCCAACGCCCGCACC
CGCTTCGTCCTGGTCGGGCCGCCCGCGCCGCCGCCGGCCCGCACCGGCGCCGACCGGACCTCGGTGGTGC
TGCGCATCGACAACGCGCCGGGCGCCCTGCTGGCCGCGCTCGCGGAGTTCGGCATCCGCG
>Contig16_9769
GGCGGGGCCTCCGGCGCGGGCGGGGGAGGCGGAGGGGCGCCGCGGGCGGCGGAACCGGCGCGGGCGGGG
CCTCGGGTGCCGGGTTGGCCGGGGGCGGGGCGCCGTTGTCGACCGGCGGCGGCGGGGCCTGCGGGGGCTG
GGTCACCACCGGCTGCTGGCCGGGCAGGTGCTGGTTGTTCCGCGGCATCTCCGGGGCGGC
>Contig16_9826
GCGAGGCGGGCGGTTTCGATGACGCTGCCGCGGCTCATCGCCTGCGACGTCGACGGCACCCTGTTCGACG
ACGACGACGAGCGGATCACCCCTCGCACCCGGGCCGCGGTCCGCGCCGCGGTGGCCGGCGGCGCGCGGTT
CGTGGTGGCCACCGGCCGCCCGCCGCGGTGGATCCGCCCGGTGGTCGACGCGCTGGGCTT
>paratb_9830
CGGCGTGGGCCGGGTGCTGGAACGCTGGTGGCTTTAGCGCCGCGACGATGCGCGCCGCGTGGCGGCGCGA
GGAGGAGCGGGGCAGTCGGCTTTAGCGGGGCGGTCGGCTTTAGCGCCGGGCAGCGGCCTTAGCGCTTCGC
TACGTCGCCGCCGGGTGGGTCGGCAGCGAGAAGTGTTCGGCCGGAACCGTTGGGCCGCTT
>Contig16_9928
GCCCGAGGAGATCGCCAAGGAACAGGCCCAGCTGCTCAGCGGGGCGACGCCGGCCTCGGTCGCCGCGCCC
GCCCCCGACCCGCAGGCCGAGCCCGAGACCCAGCCGGCCCCGCCGCCGCCGTCGGACACCCCGATTCCGC
CGCCGCCGACGGACCCGTCGGGTCCCTCCGCCAACGGCGGGCAGCCCAAGCCGAGCCTGG
>Contig16_9960
CGTTGAGACGTTACGCGCCCACCGGCACCCGGGTGCGGATTGATCAGCCGCCCATGGGCCACCAGCGATC
CGTGTTGCTTGAGCCGCTGGGTGCGGACGTTGACCTCGTAGCCGAGCACCCCGTCGAGCTGGCCGAGTTG
CTCGCGCAGGTAGCGGTACAGGTCGTCGGAATCTCGGCAGATGGCCACGGCCATCAGGTT
>paratb_9961
TTTGGATCCGCTTGTGGCGCCGGCGAAAGCAATCTGCGGATGGGCCGCGATACGTTCGCCGACCGTGTGC
ACGTCGCGAGGCGCAACCGTGAGCCACAGCATGGCGCTGAGGCGATGGCCGAGCCGTTCGGGTAGTACGT
CGACGTCGTAGACCAGGGCGCCGCAGGCCTCCAGCGCCGCGATCCGCCTGCTCACCCGCG
>paratb_9962
CCACCGACCAACCGGTGCGCGCGGCCAGTTGGGACTGCGGAGTGCGGCCGTCGTCGGCGAGCGCCGCGAG
CAGCGGGCGGTCTTCGGCGGTGGGCCGGGACCGGTGAGTTCCCGACTCCGGCTGGGCCCGCGCGGCCACG
ATCCGCTGCGCTTGCCGGTCCGAGAGCGCGCTGCCGTAGCCCGTCCAGGGCGCGTTCACC
>paratb_9963
GGGTCGCCGAACGAATGCAGCATCAGATCGATGCTGATGTCGGTGACCGCGGCGGTGCGCGGTAGGAGCT
GCGTCAGCAGGTCCTCGCGGGTGTCGCCCAGCGGCGCACGGATGACGCAGACCAGGTCGGTCCACCCCGC
CAGCACATTGGCGTGGGACACGTCGGGGCGTCGCACCAGCGCGTCGGCCAGCCGCGATAT
>Contig16_9964
GCGGTCCGGCGCCGCACGGATGCGGCACACCCAGTCCGCGTCGCCATCGGCCCACCGGTTCTCCAGCCCG
ACGGACGCGCACCACCCCGTCGCGGCGCAGCCGGTGATACCGCCGGGCGACCGTCTGCTCGGTGGCGCCCA
CCACGCTGGCGATCCGGCGAAACGAGACCCGGGGAGCTAACTGCAGGGCGTGCAGAATCT
>paratb_9965
```

Figure 6-56

```
GTGCGTCTAACTCGTCGGTCATCAGGAAAAGTATCCGCGTGGACAGGTCCAAGTGAGGATTTCAGGCCAA
TTTGGTCGCGGCGAGCGCAATTTCAACGCCTCCGCTGTCAGCCTGGAAGCTCGGCCTAAGGAGCGCTCAC
ATGCACATCGAAATCGGACTGCCCAGCCATATCGCCCACGTGCGGGGGCGGCTGACCGTC
>paratb_9966
GAGTGGGCCCGCCGGGCCGAACACCGCGGCTTTGCCGGCCTGGCCGCGATCGACCGGCTGGTGTACCCGA
GCCTCGACGCGATGACCGCGCTCGCGGTGGCCGCGGGCGCGACCACCGGCATCGGGTTGACGTTCAACGT
GCTGCTCGCTCCGCTGTACCCCGCGGTGCTGCTGGCCAAGCAGGTCATCACCCTCGCGGA
>Contig16_9967
GGCGTCCGGCGGCCGGCTGCGCCTGGGGCTGGGCGTCGGGAGCCGCTGCGACGACTACACCGCCGTCGGC
GTCGACTATCGGCGGCGCGGGCGCATTCTCGACGAGACGGCGGCGCTGCTGCGTGCCGCGTGTGAGGCCG
AGGTGGTGACCGGCGACCAGCCGCTGTGCCCGGCGCCGGTGCGGATCCCGATCCTGTTCG
>paratb_9968
GTGGACGGGCGGACGCGACGATCCGCCGCGCCGTGACCGTCGGTGACGGCTGGACCGCCGGGGCGCTGCG
CGATTACGCCAACCAGTCGGTGTTCGCCGAGCGGGTCCGGGCGGCATGGGCGGCGCGGGGCCGCTCCGGA
CGGCCGTGGCTGCAGGCCAGCGTCAACTTCGCCTTCGGCGATGACGAGGCCGTCGCCGCT
>Contig16_9969
GGCCGCAGACACCTGCAGAGCTACTACGGCTTCAAGCCCGACTACGCCGCCCTCAACGTCGCCGACATGC
TCACCACGCCGCAGGAGGCGGCGCAGACCGTGCGCGCCTACGCCGACCTGGGCTTCGACCGCCTCGTGTT
TCACCCCTGCGTCCCCGACACCGGACAGGTCGACCGGCTGGCCAACGCGGTGCTCGGTTA
>Contig16_10259
ATGCCGGTGGCTTCGCCACCGCCCGGGACGGCAACAAGATGACCGCCGTCGGTGATTTCGCAACTTCGTA
AAACCTAACGGCGCCATTCCTTTTGGGCAGTCACACGTGGGGCAGCCATTTTGAGCCGTGTGGTGAGAGT
ATGAAGGCTCGGTCTTGGGCGTCTTTGCATGCGGTCGTGCCTGAGTTATCGACACCGCAG
>paratb_10260
ACCACGCCTTCGACTGTAATGGTGTGAAACGGTGCGAGAGTTCGGATTTGGTGGTTTTGGATGGCGCTAT
TGACATAGGGAGTTGATGTAGCGGGCTGGATTCCTGTGTCGGTACCGACATACGTGTACGGATTTTTGTT
CTCGGGCCCGATCCCCGGCAGGTTGTTGCCCGTACAGCCTGCCGCCGGTGGATTGCCGAA
>paratb_10261
GCCGCATGTTATGCCATCGGGCGTAACGAAATGCATCTCTTTGAGCGGCAGGTGGCCAGGGTTGGGAAGG
GCGATGGCATAGTCGGAAGCGTCGACCGGCGCATAGCCGCTCATGTCTGAAAAGCCGGGCGAATCGGCCC
GAGCGATACAGCCGGACGCAAGAGCACTGACAACCGCGGTGGCGGCAACGAGGTATTCCG
>Contig16_10262
TCGCATCCTGGTCCTATCGGTGGGCAGGCCGGCGGTCCGGTTCACCTCTTGCGTGAGAGGGTCGGACCGC
ATTGCTCTGCGCTGCAAGAGAAGCGGAGCCCCTCGTGTCTAGAAAGCAAAGCTGCCCGACGGCTTGAGCA
CGAACCCGTGGTGACCTTGGGTGGTGTCCAAGCATGCGACGAGGTGGTCGCTTCCCACCG
>paratb_10263
CGCATGTGGCGTTGAAGGCACTCACTTTCTGCCCCACGTCTAAAAGCTTTCCGTGCGAGAACTGCCCGCC
ACACGGGTGGCCCGTCTTGTTCAGCGCGTAGGCGGGTCCCATGCCTGCCGCCGCTGCTCTGCCCACGACG
CACGAACCGCTGTCCATCCCGGGGAACTCGCCATTGCATGTTATGGCTTGCTCTGCCCAC
>paratb_10264
GCTGGTATGACTTCACCCGCCTCAAAGAAACACGAAATGTTGTAAGGAGTCGAAAAGTAAGCGAAGGGCG
GCCCTTTCTCGGGTGGTTCGATGTAGCTCTCGACTGGTACTGGTGCGAATGTCCCGAGATCGGGAAACCC
GGGCGGTTGCGCGGCGGCGTGTTGCGGCGGTGATGTACAGGACATGGACACCAAAGCTGA
>Contig16_10265
GATTAGCGCTAGCCATCGCGTGGCCACATTGGCGACGTTGCACATGTCTCCTCGATCAGGGCGTAACGGT
AAATGTTCGTCGCAGAGGTTTGCGGATTGTGTCCGGCCTTCTGCGCCTCCACCAGCGAGGCGGCGACGCG
TGTAGGTCGGCGGGGTCGTAGGGCAACAAGATGACTGCAGTCGGCGATTTCGCGGCTGCG
>Contig16_10266
```

Figure 6-57

```
TAACTAGGCGGCGCCAAGATTTTTCGGCAATCATACGTGGGGCAGCCATTTTGAGCCGCGGGGTGACAGG
ATGAATCCTCGGCCTTGGGCGTCCTTGCATGCGGTCGTGCCTAGGTTGTCGACCCCGCAGATCACACCGT
CGACGGTGATGGAATGCATTGGGGGCAAGGTTGGGAGTGGATGTCCATAGACCTGACTGT
>paratb_10268
CCAATTGTGTAGTCGGACACCGTGACCGGCGCATAGGCGCTCAAATCTGGAAAACTGGGCGAACCGGCAT
GTGCTGCGCAAGCGCTGATCGCAGCTGCGACACATGCGGCAGTCACACGTGGGGCAGCCATTTCGAGCCG
TGCGGTGACAGGATGAAGCCTCGGTCTTGGGGGTCTTTGCACGCAGTGGTGCCGGAGTTA
>Contig16_10269
TCGACTCCGCAGATCACACCATTGACAGCGATGGAATGCATTGGGGGAAGAGTTTTGATGGGCTGGCCGG
CGATTGACCGGAATGGCTCCCCCTCATTCGTCTGCTTAAGCCCGGTCGTCGTTCCGATCCAGTTAACCCC
GGTGATTCCGGCATCAGGTTTTGATGGCGCGGGGGGTATCGCAGGGAGGTTGTTCCCACT
>Contig16_10270
GCACTGTGCCTGATCGGGCGTGAAATTGCAGACTACGCCGTCGGGAGTGAGGAAGTAAACCGTTGGTAAG
GGCGGCCGTCCCGGGTTAGGAGCATCGAGTGTGTAATCGCTGGGACTGACGGCGGTGTAGCTATTCAGGT
CGGGAAATCTAGGTGTATCTGCATGGGCACTGCAAGCGCTGATCGCTGCGACACATGCGG
>Contig16_10271
CAGTCACACGTGGGGCAGCCATTTTGAGCCGTGGGGTGACAGGATGAAGCCTCGGTCTTGGGGGTCTTTG
CATGCGGTGGTGCCGGAGTTGTCCACTCCGCAGATCACGCCGTCGACGGTGATGGAATGCATTGGGGCA
GCGTCTTTAGCTCTTGGCCGTTCGTGTCAAGCGGTGACCCTGTGGGTTGCGGGCCCGAGC
>paratb_10275
CGTTGAATCCTGACAGCACGGGTTGCCCACCAATCTCTCGGAAGCTCAATTCACCGAATCGGGTGCCGGG
AGCCGTCACAGTCGCGGTGGCAAGATCCCCCGCCTTACCCCAGCCGGTTCCGTTCCAGGGTTGCCAGCGA
TCGCGCTGGGTGACTTCGCTTGGATCAACTCGGTACATCGTTACTCCTTGGCTGCGGTCG
>paratb_10276
AACGAGTCGGCGGCAATGTAGACATAGCCGTCTTTGCCCTGGTAGCCGCTAATCTGCGTCGGCCCCGCCC
CAGGGGCGCGCCACGACCCATCGATCGGCTTCCAACCTTGACCAGGATCATTGGTCACCTTCACAAGCCA
TGAACCGCCCGTCGGGTTCAGCTGGTCGGTGCCTGCGACCATCATGTAGGTGGTGCCGTC
>paratb_10277
ATTCATCCGAATGCTGCCCGCAGGGAGCGTGTCTTTCCCCGCTGCCTGCGGTGGCGGTGGAAACAAGACG
TTTTGGCCGTCTGCTCCGGTTAGCGGTGCGCCGAAATGGGGATGACCTTCCTCGTCGAAGGTAACTGGGA
CCGCAACCGATGGATAATGCGTGCCGTCGTATGCCTTATTACCCGAGAATGAATCCCCGA
>paratb_10278
AGATCGCGTAGTACTTGCCGGGCTGGCCCGGCACCTCAACGACCTCCCCCAGGTCCGCCGCTCCGATTCC
GGGAATGCCTGGGTTCGCGCCCGTGCCGGCGACAGGACCGAGGTTCCGCACTACACCGCGCAACGGACTT
TCCATCCAGCCGTCGACGGCTGCGGGCGGTTGATAACCGTCGGTGTGCAGATTGCCCATC
>Contig16_10279
GATTTACGCAGCGTCTCCGAGTAGGCGTTCCGGATTGAATTCATCTCCTTGACGGCATCGCGCACGTCGT
CCACGGCGTCGGCGTGTGCGTCCTTGATCAGTCGCTCCAGCTTGGCCCGCTCCGCCGCGGGCAGGTTGAG
CTTCAAATCCTCTTTGGCCGCGCCGATGAGTCTGTCGAGGAACATCAGCTCCCGTTCCAG
>Contig16_10515
GGGCTTGGCCGCCGCACGCGGCGACCACGAAGGCGCCGCGGCGGCCCTGGACCTGTTGAGCGACACCGGC
GGCGAATTCCCCGAGCTCGCCGCCGAACACGCGCAGCTGTGCGCTCGCGCGGGCGCTGTGCGCCACCG
CGCTGTGCGACGACGACCTGCACGTGCAATCGGTTCCGTTGTGGGACAAGATACTTGAGC
>Contig16_10572
TTCATCGGTGTGCTGGCGCGCCGCCCGCTAGGAGCCTGCTGAATTAGGGGATTTTTGGGGCGGGGCGTC
TCGAACCGTCTAGCGGCGTGTTGTAGTCAGACCCTGTGGGTCGACAGAAAAGAGATCGCCCCGCCGTTGT
TGAGCGTGGCAGCGGTCGGCGGCTGAGGCAAGGCCTTGGTGTGAGGGCGTGTTAGGCGAT
>paratb_10573
```

Figure 6-58

```
GGCCCAGGTGGTGTCGGTGCGGGTCAGGCCCATGGTGAGCAGCCGACGTAGGTTCAGTGCTGCGGCGCGG
TGGTGCAGCCAATGGTTGTTTTTGGCGGTTCCTCGGTAGCGGACCTTGCGGTTGCCGCGAGTGAGCCAGG
CCATTGAGCGTTCCACCATGGGCCGGTGTTGGCGGTATTCGGCTTGCCAATCGGGGTCGC
>paratb_10574
GGGCCGCGACGCGAGCAGCGCGCAATAATTGCTCGTGGATATGAAGGGTGAGTTTGCGTCCGCGCGTGGC
GGTCGTGCACCGGGACGCCAACGGGCATGAGCGACAGTATCTTTCGAAGGTGACTCCGCCACTGGGACGG
ATCGGCATTCCGTGTCCAGCCGGGCAGGTCACGATGCGGGCGTCGAAATCGATGAGGAAA
>paratb_10576
TGGTCAACGCGCAATCGGTGATGATTCCGGTGTCGGGCTCGACGGCAAGGTGGGCTTTGAAGCCGTCCTG
GCGGCGGTGCACCGTCTTGTGAGCGTGCCGCGTGTCGGCATCGACGGTGGAGATCACGCGATCCCCACTG
ACCTGCTGCGCGATGCGCCAGTGCCCGTCGGTGCCATCAGAGCCCTCGACCGGTTCAACG
>paratb_10578
CACCGCTGCAGCGCCAGGGACTTCGCGGCGCACTCGTCGGATCGCGGCGATCAACTGCGTCACGGTGTCC
TGCGTGGCCACCGCATCGTCGAGCACCGTGGAATCCAAGGCCCGCCGTGTCTTGCCCGCCAACACCCCGG
TCTCGGCCACCACCGTCTTGACCGCCTCAAAGATCCGGTTGGGCCGATCCGAAGCCGCCA
>paratb_10579
ACCGACGCCGCCAATACGTCAACGTCGTCGAATGAAACGCGCCCGCCGTGATCGGCAACCCGCACGCTGC
TTTCCAGCGCAGATCGAAAGTCACCGCATCCACGGTCTCGTTATCCGAAAAACCGTGCAGGGCCTGCAAG
GTGATCACCGAGGCCATCACCTCAGCCGGCACGCTGGGCCGGCCCCGCTGCGACGGGAAC
>paratb_10580
AAGTCCGCGAACATCTCCTCGGGAAACAACTGGCTGCGGTGCGCCGCCAGGAACGCAAACATGCTGTCGG
CCTTCAGAAGATGCCCGGCAACCGACTCCGCATCCAACAACTCACGCTGATCATCAGAGCGACCCTGCAC
CCAACAATCATCCCCAAAACCCCAGGACAACTCGTCCCGCCACGCGGAATTAATTCAGCA
>Contig16_10608
GGGGACATGGATGAAACCGCGGCCCGAATCGTGCATACCCCCCACGCTCGACGCGAGACCGCGAGACCGC
GAGACCGCGAGGCAGCGAGGCAGCGAGACCGCGAGACCGCGAGACAGCGAGACAGCGAGACCGCGAGACC
GCGACGAAACTAGACCGCGACCACCAGCCGTGACAGCCCGCGCAGCGTCACGTTGGTCTT
>Contig16_10715
CGGCGCGCAGCGCGGCGGCGTAGCGCTCGGGCAGACTCACTGCGGCGCTGGGCAATTCGACGCCGGGCGC
GCCGCCGCCGCCGACCGCCGCGACGCAATCCAGCGCCACCGCGTCGGCGTCCGCAGGCAGCGCGGCGGCC
AGGGACTGCGCCCGGGCCCGCAGCCGCCCGACGTCGGCGTCCAACGCGGCGGCCACCGGC
>paratb_10719
ACCGCCCGGGCGAGCGCGGCCAGCGCGCCCCGGCCGCGGCGGGCCCGGCGCCCGGTGGCCAGGTCGAACT
CCACGTCGGTGGCGCCGCCCGCGGCGACGACCGCGTCCAGCGCCGCCCGGCCCAGGTTGGTGTGCACCAC
CACGCCCGTGGCGTTGATCACCGGCCGCAGGCTCGACGCGGTGGCGGGCAGCGTGGCGAG
>Contig16_10815
AGGCAATCACGTGCAGTGTTTGACGGCGACGAATGTCAATGCTGTTTGCTCAGCATTACGGTGAGATCCA
CTATATCGCCCCGTGTTACGGGGATGTTCGCACCCGGCACCGGCCCGTCCGGCAATCCGCTTCCGCGGGC
GGCGTCGACTGGTAGCGTCCGGCGCACCGGCCCGACCTGGGAGCGACGATGGTGGCAACC
>paratb_10816
GAACACGAGTGGAGCAAACCCGCGGCCCTGGCCATTCCCAGGGAGGGCTACTTCGAGCTCGAACGCGGTC
GTTACGGGCCGCTGTATCCCCGCACCCCGGCCTGCTACGGCTTTTCCATCATCGCCAAGGTCAAGGAGGG
CCGCGAGGAAGCCGTCCGCGCCTACGGCAAACAGATCGAAGAGGCCATCAAGGCCGATCC
>paratb_10817
GCACGTGCTTGCCGCGCTGCGGCTGCACTACCTGCGCTGGTTGCTCTTCGACGTCGGATCGGGACTGCAC
TTCCAGTACCAGGGCATCTTCGACACGGACTTCGACAAGTACACCGAGGACGCGGTGCAGCTGTTCAGTC
AGACCGGGATCACCACCGTCTTCACGAACCTCGAGGGGTTTCCCGAAGACTGGCGGGAGA
>paratb_10818
```

Figure 6-59

```
ACCCGGACGCCTTCGTCAAGTTCGTGCGTGAGCACCAGTGCCCGAGCTTTCTGGAGTACGGGGAGTATCC
CTACGTCACCGCCGACGAGATCAAAAAGGCGTTACGGCTCAAGGCCGCCTTCCAGACCATGCTGGATCAG
ATGCAATGACGTCGGTCAGAGTCTGAGATGCTCGAGCTCGACGACATCCAGCACATCCTG
>paratb_10819
CTGACCCGAACCCCGGCGCTGACCGGACGCTACGAGTTTCTCTCGTTCGACGATGCAACCGCCGGGCGGG
CGTGGCTGTCCGCCCTCGTCGATGTCGTGCAGTCCGCGGCGTCGGTACGCGACACCATGGACAGCGCCAA
GCGATGGGTCACGCTGGGTTTCACCTGGAACGGCTTGCGGGCGCTCGGGGTTCCCGGGGA
>paratb_10820
CGCCCTTGCCAGCTTTCCGGAAGAGTTCCGCCAGGGCATGGCCGCCCGGGCGGACATTCTCGGGGACACC
GGACGCAATCATCCCGACAACTGGGTGGGCGGATTGGCCGGCGCGGACCTGCACGCGATCGCGATTCTGT
TCGCGCGAGACGACGCCGAACATGCCCGCGCCACCAACGCCCACGACGACCTGCTGAAAA
>paratb_10821
GGTGCCAAGGTGTGCGCAGGTTGTCACACCTCGACCTGAACGCAACGCCTCCGTTCAACTACGCCCACGA
CCACTTCGGCTTCCGGGATCGCTTGTCGCAGCCGGTGATCGAAGGATCCGGCGAGGAACCCACCCCCGGC
TCGGGCGCGCCGCTCAAGGCCGGGGAATTCATCCTCGGCTATCCCGATGAAGTCGGCCCG
>paratb_10822
GTGGCCAATCAGCCCGAGCCGGAGGTGCTGTCGCGCAACGGAACATATGCGGCGTACCGCCGGCTGCGCG
AACACGTGGCCGTCTTCCGCGACTACCTCCGTTCCGTGGCCGGCGCGGATCGGCAGGAGGAGTTGTTGGC
GGCAAAACTCATGGGCCGCTGGCGTAGCGGTGCCCCGTTGGTGCTCGCCCCCGACGAAGA
>paratb_10823
CGATCCCGAGTTGGGCGCAGATCCGCTGCGCAACAACGACTTCAACTACAAGGAGATGGACCCCTTCGGC
TACGCATGCCCGCTGGGCGCCCACGCCAGACGGCTCAACCCGCGAGACACCGCGCACAACATGAACCGGC
GCCGGATGATTCGTCGTGGGCGACCTATGGTCCGGCGCTTCCCGAAGGCGCTCCCGACG
>paratb_10824
ACGGCGAGGATCGTGGCATCGCCGCGTTCATTATCTGCGCCAGCCTGATCCGGCAGTTCGAATTCGCGCA
GAACGTCTGGATAAACGACCGCACTTTCCACGAACTCGGCAACGAGCACGACCCGATCTGTGGAACCCAG
GACGGCACACTGGATTTCACCATACCGAAGCGACCGATTCGCCGGGTGCTCAAGGGACTG
>paratb_10826
CAGCGCGACATTCAGACCCTGGACAACCGCTTCTCCACCATGACCGAAGTGCGCAGGGCGGCCTGGCCCC
GATACGAGGGGCCCGACTGGGACGACGCCCACTTTCTGCAGGGCATCGCCGGCACCTTGGAGCTTTTCCA
CCGCTCGACGCTTGCGTTCCAGGAGCTGGCCGGCGAAGCAACCGGTCAGCAGGTGGCGGT
>paratb_10828
GCACCGACGACATGGCCCAGCGGCAGGTCGAATACCTGCACCACGGGGATCCGCTCGTGCCGCGGCAACA
ACGGTTTTCCGCCTACACCCGCTCGCTGATGAAGGGGCTCGACGTTCCCGTCCGCAACAGGTGGGGCCTG
CATCCGGCCCGGGTGGCCGCGACCGGTCAGATGGCACCGCTGACCTGCTTTCGCGACCTG
>paratb_11048
CTGCTGCGGTTCTGGATCGGCGACCAGTTAGTCAAGACCGCTGCGCGCACCAACCATGCAGAGGTAAGAA
ACAAACGGGCCTTCCGCACCCGCGAACAGGCCTAACCACTAACCCAGAGTGTCAAGGATCAACCGACATA
GAAATGTCACCCATCAACCGACTCTGAACAGGGGCTCCGTTTGTCTGGCGCCGAGCGTCA
>paratb_11166
CCCGGCGGGCGGGGCGCTATGACACGCGACGACGACGATGACGCCGGCGCAGCCGGGGTTGAGGAGCGGC
GCCAATGACACGCGACGACGACGATGACGCCGGCGCAGCCGCGGTTGAGGAGCGGCGCCAATGACACGCG
TTGTCTTATCCATCGGCTCCAATCTGGGGGACCGGCTGGCGCGGCTGCAGTCCGTCGTCG
>Contig16_11303
ACCGACTTCCCGACGTTGGCGCGCGGGTGCTGGCCGAACTCGGCGTGCCGCTGCCGCCGGCCGTGCCGG
GGTGATCGGCGCCGCGGGCGCGCGCGGCGCGCCACATGATGCTCGGCCGCAACAGCCGGGTCGCGGGGTC
GACGAGCGAGGTGACCCTGATGAACTGGTTCAGCGCGACCGTGTCGGTTTCGGCCGCGGT
>Contig16_11321
```

Figure 6-60

```
CGCCGGCGGCCAGCTGCGCGAGGCCGTCGCCACCGCGCAGGCGGCGGCGCGGCTCGCCCGCGACCGCGGC
CAGCCCACCCACGAACTGGCCTGCATCCAAGCCGCGGCGCAATGGGGGGACGCCGCGGGGCGGCGCGCG
CCCGCGCGCTGGCCGACGCGCTGTCGCTGCCGCTGGCCGACGCCATCGCCTGCCACGCCG
>Contig16_11322
AGGCGCTGCGGGCCGGCAACGGCGAGGCCCTGCTGACGGTCGCGGCGGCCTACCGGGCGATCGGCGACGC
GGCCGCCGCCGCCGACGCGGCCGCGCAGGCCTCCGCCGCGTTCGTCGAGGGGCAGCAGCACCAGCGCGGG
CGGTATGCGGCGGCCCTGGCCGGTGAGCTGGCCGAGGAATGCGGCGGCCTGTGCACGCCG
>Contig16_11540
ACCGGCCCGCCGACATCATTGCCCGGGTACGCGAGGCGCGCGCCCGCCGAACGTGAAACTAGTTTCACGC
TCGGCGGCAAAACGGCGAGAAGGCCCCGCAGCTACGCCGGGACCAGCTCGACGCCGGAGAGCACGACGGC
GTTGTCGCGCGAAGGCGCGACAACGCTGGCCAGAAATCGCCCACCCTCTTTCCAGATGCC
>Contig16_11660
CCACCATGGACGCGCGGCCGGCGGGTGCCGACCCGCTGCTGGCGCCGGAGGTGGTCGAGGTACTGCGCTC
GGGGGAGCCGACGGTGATCCTGGTGGGCGGCGACGCTACCCGCCGCGCCGGGCTGGCCGCGGCCGCCCGG
ATCGCCGCGGCCACCGGCGCCCGGGTGCTGTGCGAAACCTTCCCCACCCGGCTGGAGCGC
>Contig16_11824
GCAGGGCGCGCTCGTCGGCGACGAGGTCGTCGCCGAGCTGGGCCGGGTCGGAGGCCAGCCGCGGCTGCGC
GCCACCGGGCGTATCCGCGTCGGCGGGCAGCATTCGCGACGCCGGCGCCGAGGGCGCGGCGGTCCGCGTC
GCGGTTGGGCGCGGCGCGGCCGACGGGTGCGACGGCGAACAGCCGGCGAGCGCGACCAGG
>Contig16_11827
GCCGGCCTACTCGCGGCGTTGCCGCTGTCGCTGATCGCCGTCGCAGCCGCTGCGGTGATGATTTTCTTTG
TCCACCAACGCGATTCGACGGCACCGGCGACCGAACCCGCGCCGTCGGCCGCGCCGCCCAAAGCGGCGGC
GCCCAAACCGCCCGCGCCGCGGATCGAGATGGCCGACATGGCGTTCATCGCCGCGCTGAA
>paratb_11840
GAAGGCGACCGATGCTGCGAGCCCCTGTTCAGAGTCGGTTGATGGGTGACATTTCTATGTCGGTTGATCC
TTGACACTCTGGGTTAGTGGTTAGGCCTGTTCGCGGGTGCGGAAGGCCCGTTTGTTTCTTACCTCTGCAT
GGTTGGTGCGCGCAGCGGTCTTGACTAACTGGTCGCCGATCCAGAACCGCAGCAGCTCAC
>paratb_11841
CGTCGACGTGGACATCGCAGCGGGCCCCGGCGTAGTGGGCTCCCACGCAGACCTGCTGCCAGGCCACACT
GACCACCCCGTTGGTCGTTACCCGGCGGCTGACCCAGTCCTGGCCGTCTCGGTCGATGCTGGCGGGTACG
TCGTCGCCAGGGCTCACCGGCGAGGCGGTGGCGGTGAACCGTTCGGCTGGGGTGGTCATG
>paratb_11844
CTTTGGCGCTGGTGCCATCGGCCAGCGGGAAACCCCCCACCACATCCATCTGCCACAGCTCCATCGGGGC
GCCGCGTTCCCAACGTTTCCACTTGCGCGAACGCCGATCCCGCAAAGCCGGATCGATCATGCCCGCCCGC
ACCAAGGCCCGATACACCGCCGACTCCGACGGCACCGGACCCACCCGACGCTTAGCCAGC
>paratb_11896
ACACCGTGGTCGGGTCGGCGTCGGGGCCCATCGCCGAGGTGATCCGGCGGTGGATCTCCACCCCGATCCG
GTCGCGCGCCGCGCGCACCGCGGGATCGGCGCCGCCGCTGAGCAATGCCGTCGTGCAGGCCGCGCTCACC
TCCGGCTCGTCGGCGACCACCAGGGCCAGGTGCCGCAGCACCTGTTCGACCCGGGTCGGC
>Contig16_12183
TGCCGATGGGTGTGTTCGGTGCCGTCGGTGTGTTCGGTGCCGTCGGTGTGCGCGTGGGCGTGCTCGTG
CTCGACGTGGTCGTGCTCGTGCGTGGTGTGCGCGTGCGCGTGCGTCACGCCGCCGTGCTGATGTTCGTGC
GTGTGCGGCGCGTCGTGGGTGTGCTGTTCGCTCATCATGTTCTCCGTTGCGTGAAATACC
>Contig16_12399
GCCCCCGAGGTGTTCGACCAGCGCGACGACGACGGCGTCGTCGTCCTGCTCAACCCCCATCCCACGGCCG
AGCAGGCGCAAGGCGCGCGGCGCGCGGCGGCGGCTTGCCCCGCCCTGGCCATCCGCGTTGAAGAATGACG
ACACGGCGAGGAACAACACCATGTCAGACACCCTGACGAGCACCGCGACCGAGCAGACCG
>Contig16_12436
```

Figure 6-61

```
TCGGCAGCGCGCCGGCCATACACCCGGCGGGCTGACCGGCGATGGCCATCGATCCCTCGGACATCCTGCT
CACCGACCGGGTCGCGGTGGTGACCGGGGCGGGGCGGGCATCGGCCGCGGCATCGCCGCCGGGCTGGCC
GCATTCGGCGCGCGGGTGGCGATCTGGGAGCGCGACGCGCAAACCTGCACGCGGGCAGCC
>paratb_12635
ATGCTCGTCGGCTTCGGAGGTTTCTGCAGCGGCCTTCGCCGCCTGAGCCTGCGCTTCCCGCCGGAGCCGG
GCGGCACGGGCGCGGGCGCGCGCCGCCGCGGCCAGCGCTTCGGCTTCGGCCGCTTCGGCCTCGGCCTCCT
CGAGCAACGCCTTCACGTCCTCGTCGGAGGTGGCCGAATCGTGCGGCGGCTTCTTCGCAT
>paratb_13011
TGGTTTGGCGGTGTGCCCAGGCTTTGTGTTCGTCGTAGTGGGTTCGGTGTCGTAGGCAGCCGTGGAGGAT
GCCTACGAGGCGGTTACCGAGGGCGCGTAGCGCTTGGTGGTGGAGGTCGCCGGCAGCGCGACGCCGGTCG
TAGAACAGGCGGGCGCCGGGGCTGGTGTTCAGGGCGCAGAAGGCCCATTGGTCGATCGCG
>paratb_13013
CGGGTGTGTCTCAAAATGTGTTGCCAGTTCGGCCTCAAGGTCGGTGATCTGGCGGTTCAGTTCAGCGATG
ATGCCGACCGTGGCGCGGGTGGTTGCGCCGAACGCGGCGGTGACCGCGGCAGGGGCGGCGAGCTGCTCAG
CGCGTAAAGCGGTTTGAATGTCCTGGGCGACGGTGTCGAGGTTGCGTTGTCGCCCAGCGG
>paratb_13015
GCCAGCACTTTGACCGCCTCGGTATCAGCGGAGTCACCGGCGACGCGGCGGTGATTGTGGCGATCGGTGC
GCACCAGATCCGCCAAGAGCTTGGCGTCCCCGGCATCGGATTTGGCCCCCGACACATGGTGGCGGTCGCG
GTAGCGGGCGGCCGCCATCGGGTTGATCGCATACACCTGGTAATCGGCCGCGGTGAGCGC
>paratb_13016
CTCGACCCACAAACCACGGTCGGTTTCGATTCCAATCACGACCTGGTCGGGCTCTTCGGCATGGCGGGCC
AAAAGCTGATGGAACTCGCCGATGCCGGCAAGTCCCTCCGGTAACCGACGCGAGGCCAGCCGGGCCCCGG
ATTCATCCATCAGGTGGACGTCGTGATGATCCTCCGCCCAATCGTCGCCGACAAATATCA
>paratb_13017
CGTAGCGCCTCCTCGGTGGTCATCGAACATGTTCGAGCCCAAGGGCACCCGGCGACAAGCTAATGGATCA
GTGCTCAACGGCACGACACCCCATCAGTGCTACAGGAACCCTCACCAACCGGCCGGGGCGTGATCTAGCC
TTAGAAGTCGGCCATCGCTTCAGCTGGCAACGACGCTCACCGACCGGCGGCTCGGTAAAC
>Contig16_13129
CTCTACATCAGTACCGACACGCCGCCACTATTTACACCACGCCCCGGCACGTTCCCCCCTGGGTTAGTGG
TTAGGCCTGTTCGCGGGTGCGGAAGGCCCGTTTGTTTCTTACCTCTGCATGGTTGGTGCGCGCAGCGGTC
TTGACTAACTGGTCGCCGATCCAGAACCGCAGCAGCTCACCGTCGACGTGGACATCGCAG
>paratb_13130
CGGGCCCCGGCGTAGTGGGCTCCCACGCAGACCTGCTGCCAGGCCACACTGACCACCCCGTTGGTCGTTA
CCCGGCGGCTGACCCAGTCCTGGCCGTCTCGGTCGATGCTGGCGGGTACGTCGTCGCCAGGGCTCACCGG
CGAGGCGGTGGCGGTGAACCGTTCGGCTGGGGTGGTCATGTTCAGCGATTGATGCGGACG
>paratb_13137
GGCAACGATGAAAACCACCGTTTGCGCGCGCGATCGAATCGTACCGCGGGCACACATTTACGTCATCGAT
CCTTCGACCCTCGGCGGCGCGAAATGACGCCGGGAGGTCCGCACCGAGGCGGCCGAGGGGAGCCGGACGA
CCGGGGAGCAAATCGCGATGCGCTGAGTCATTTCTTCGCCGGTCCCACCGATGACGATCG
>paratb_13138
TGCACGGCTTCGGGCCGACTTGCTCGCTCGGGCTGGGCAGGTCCGCGCGACTGGCTGGGAGCCCTACCAC
GGGCTCTGGTCTACCGGGGAAGTGATCGGTGTGGCGTTGCTGCTGGGAGATCATGCTGAACTCGCCGCTC
TCGGCGAGACCGTGCAGTCAGCATTGGAGCGCTGGGCGTTCGACCTCTGGGGCCTGGATG
>paratb_13139
GAGGTCAGGCCGACGTTGACGACGGCTGCGAAGAAACCCGTGAGTGGTTCCTGGATGCGGCATACGAGTT
CGGCGGCCAGGAAGCGGTGCGCGAACGATCCGAGGAACCGGCGGCCAAGACATCCCCATGTCGGAGTTG
CTCGCCGCAGAGTCTGGCCATGACGTTGACTTTGATCCCGAACGGCTCGGCGAGCTCGCC
>paratb_13140
```

Figure 6-62

AGCGACGATGCGCTGCGTGAACAATTGAGTCGCGCAGCAGAGTCACCGACCGTCCGAAGGGCGCGACCTC
GCCGTTCGTCGTATTCAGATCCCAGGGACGGTGCCAAATGAGTCCGGTGGCCGACGGTTGGTCAGTCGAT
GTCCAGGGGACAACCGTTGTTGTGACTTTCCCGCCCAGCGACGAGATGGGACGGCGTTCA
>paratb_13141
CTTACCGTGGATGAGGCACGTGTGCTGTGCGAACAGCTCGGTTTTGCGCACCTACTCGCGGGACGTAATA
GGGCAACAGGGGACCCGGACGTTGATGACGTCGATGCGGATAGAGCCGCTGGCAGTCGGCTGATTGATGA
TGCCTTGCATCTCGAACCTGTTGACGTCTCCGATGAACATCTACGGAAGTTGGTGGATTA
>paratb_13142
CTTTCGAGCGCGCCGCCAAGCAGCCCAAGTCGCCGGCGCCGACGATGCAGCGGAAGATCAGGCTTGGGTC
GACGACATCTCGCAGTTCAACGACGACGATTTCGACGCCCATCAAGATTTGCCTGCAGGTGGTTTCCCGA
TCGCTGATCAAGAGCCGAGCGAGAAGCGTGGTGACCGCGTAGAAGACCAGGCTGCACCGG
>paratb_13143
CGGATGAGGACGGTATCGCCAATGCGTGGCTCGATGAGTGGGAGGAGAAGTGACGCAGGCTGGTGACCGA
CGGGTGTTGGTAAAACCTTTAGTAACGGGCCACGTAGTAAAGGTTGGCGGCGACAAAGTTAATTACCGCA
CGTCGTTCGAACGCTCAGGAGGCGACGCGGAGGGCCAGAGCGTCGCTCTTGGTGATGAAT
>paratb_13144
ATCCGAAGCGGTGTGGGGGCGGTCGAGATGAACGGTGACAGGAATCTTCCTGAAGGCTGGAAGGTCTATA
TCCGCGGTGGGTCCGTGGAAGTGAAAGCGCCGGCGTCGGGCGGGACTTCTACCGGTTATCTACTGACATC
AGTTGAGGCCCGGCGTCTCGGTACAGAGATTCTTCGGGCGTTCGGCCAGTGTGACGGTGA
>paratb_13147
TGCCGGCCTGGCGGCCCGTAGCGCCGGAGGCGCGGAGGGCCAGAGGGCCGGCGGCGCGAGCGTAGCGAGC
GCTCTTGGTAGTACTCAGAGTTATTGCTTCACCACATCAGCGACCAGCGGAGGCGGGGTTTCGGCGGTTG
ATCCGGGGGAGCGGCGCCGGATTCGTTGGGGCGCAAGGGCGATGCTGTGGCAGGCGTCTT
>paratb_13148
CGTTGAAGGCGGTGCGCTGCTGTGGCCGGGTGTTGCATAACGATGCGGTTGGCGATCCTGATGACGGTCA
GGGCGTGGTGATTAAGCGTCGGGAGGTTGATGGACGGATGGTGGCGAGTCTGCATGGTCTGATGACTTGC
GGTTCGGTGTGGGCATGCCCGCGTTGCTCGGCAGTCATAGCGAATACCAGGGCCGCCGAA
>paratb_13149
ATCGGTGCGACAGTGAGAGAGTGTTATCGTCGTGGTGGTCGCGTGTATCTGTTGACGTTGACGATGCGGC
ATAGCCGGAGAGATGGTCTTGCTGACCTCTGGGATTCGCTTTCCACGGCCTGGCGTTCGGTGTTCGGAAC
TCGTAATTGGACGGGGCAGAAAGAACGGATGGTGCAGCGCAGGCGTGGCTTGGCCCTTCT
>paratb_13150
CCCGGAGATCATGGGTGATGCCGAGCGTTTCGACATAGCTGGCGTCACCCGGGTTGTGGAAGCGACTTAC
GGCAAGCCGGAACTTGGTGGGCATGGCTGGCACCTTCATATCCATGCCCTCGTGTTCTCAGTGACCAGCT
TGTCGAGCGGTCTGATTGAGGGCATTGAGCGGACTCTGGGCCGCGGAGTTAATCATGATT
>paratb_13151
GGTTGGCGCGCAACGTCTTTGCTGCTCGAATACATCAGCGCTGGTCGCAGGGATTGGCCAAGGCTGGCTG
TCAGATGCCGGGGTCGGTCGCCGTTGATGTCCGAGAGATTGACGACGAGGGCGCTGAATACGTTGGCCGA
TACCTGTCCAAGGCTACATATGATGTCGCGGCACGCATAGGTCTTGAGGTGGGAGCTGGC
>paratb_13152
GTTTCAACGAAAGACGCTCGGGCAGAACGTAATCAGACTCCGTTCGAAGTGCTTGCGAATCTCGCTGAGT
CGGTGGATGCTCGCGGGTTCGGAATTCGGACCCCGCGTCATTGGGCTGTTCTCCCTGCAGGAAACGGAGA
TTGGGCTGTAATCGACAGTGATACAGGCGAAGTCGCGAGCATCACGGCGCCTGGACAGTG
>paratb_13153
GAAGGTATGGCATGAGTGGGAGCAAGCGTCGTGTGGTCGTCGTCAGATTACTTGGTCTCGTCGACGGTCA
AACCCTGAATCGGGCCGCGAGATGCTGTGGAATGACTTGTTGGATAGTCGTGGACGGTCAGCAGAAGCAT
CGGACGAAGAAATTGCGGTCGATGAGGTCGATGCCGAGTCGGTCGGCGTTATTAGTCGAC
>paratb_13154

Figure 6-63

AGGTTTGGTACCAGGTGTTTGCCTGGCGTCCAGGGTTGATTGTGGATCTTCTGGAGGCGGCCGAGCGGTG
TGGTGTGGCGGCTGTTGGTGTGTTATCGCAATCTGCTGGTTGTGACGTCGCCGGGTGGCCACCAGGCGGG
TAGCACCAACATTTACGCGGCAGAAATGTGTTCCAACCTTGACCCCCTACGGATTGTCGG
>paratb_13155
TGGCTCGTGCGAGCCTATGTATCGATAACTTTGAGGAGGATGGGATGTCGTATGTTGTGCGCCGAATTAC
TCTGGACGAGTTATCTGCTCCTCGCCCAACGAAGCGGATATCGGTTGGTTGGGCCGATGGGCTACTTAAC
GGCGGTATGCCCGCACGGAAGTTCGCGATGATCTACGACAACCTGGTGTCGGAAAGTCC
>paratb_13156
ACGCTAACCGTCGAGTTCGCTTGTGCCGCTGCTAAAATGGTTACTACGGTTTACGCGGCTTCACCGGATG
AGCATGACCCGCCCGACGTGCGTAGTCCTGGCGATATTGTGCGGCTGGCCCACCGAATCGATGCCCCGCT
CGCGGGGGTGTATGTGGTGACCGTGGATACGATTGACGACGCCATCGCGGCGGCAACCGA
>paratb_13157
GGTGGGTGCGCGGATGTTGGTCGTAGATTCTGTGAATGCGTGTGCGGATTTCGATGCTCGGCGGATGAAG
GCGGGCATGCGGAAGTTGCGGGCGTGGTGTAGGGATAACGACGCCGCAGCGATGGGTGTGGGTATGTACG
ACACAGCGGGTCGGCGGGCCGGGGCTACAGCGTTGCCTATGGCGCTGACGCAATCCTGG
>paratb_13158
ACCTTGACGTTGAACAAACTCCAGAGCGTGACAAGCTCGCTGAGTTACTTGTAGATGAGGAGATCCCAAC
CGAGGACTTGTCGCTGCGACGGCTGACCCTCTGGAAATGCCGATTTGGCCCAGTAGGTCAGCAGGTGTTG
CGGATGACCGGCGGTGGGCTCGTACCGCACGAACGGCCAATTGACTCGGGGCTCCGCCGC
>paratb_13159
CTCGTTGACCAATCGGAAGAGCACAACGCTATCGCGGAGGTCAAGGACGATGATCCGCCAACGCGGTAGT
AATCCGGGTGGTATTCATCGGCCCTGCGTAGGTAGGTTAGGTCCATAGTCGGCACAATTGCTGGTAACCG
GGAGTTTCGCTGAGTTCTCGATAGGCGGCTGAGTTATAGCGCCATGCCGTGAATGCTGGG
>paratb_13160
TGGGTATGTAGCTGAAGTAGCCATTTTCTAAGGGCCGCGGTGTCCGTATGCGATGTGAAGTAGTGCAGCG
CATCGCTGTAGTGGCTGGGAATGGCAGGGGTGCCACCGTGCGCAGCGCGCCGAGCGCCGGCTCGATGCTC
ACGAAGGCATTCTTGGACAAACGGCCACACCATTGCGGGCACGGGGTGTTCTTGCCCCTG
>paratb_13161
CTGCCAGATAGCAACGCTTGCCTCGGCCTCTTTGCGGTGTGTCAGCTCCCATAAGGCGACGGCGTATTGT
TCGATGAGTTCGTCGCAGAGATCGCCTATCTGGGTTCGTAGCTGTGAATTTAGTTTGGGGCTCATGTATT
GGACCGCGGATATCAGTAGGTCAGTTGTACTGGATTCGCATATTAGTGCGTGAGCTGACA
>paratb_13162
GGCGCCAATGAACTCGCTGCAGCTGGACAAGCGTTTTGTCGGATATGGGGGTGGTGAGAGCCGCTGTCAA
CTGATTGGTGCTGTGATGTTTTACGACCCCGCGGTGCCCGGACGGCGGTTCTCCGCGCCGCTCCGCCCGC
CATTGCCGGCCGGTAATGCAAGGTATCTCTCCCTGAAGCTGCGCGATAGCAACGCGGTCA
>paratb_13167
TCGGTGAAGGTAGGTCCAATCGGCACTGCCTCCGGTCGTACGAGCAAATACCGCCACCCAAACGTATCCT
TTGCGGTACAAAGCGGAATGGTCAGGGTATTCCCCCGTGTCCTCGAACACCCGCATCACGCCGGCGATGT
CTGGCCGCCAGTACCACCCCGCTCTCATAGTCGAGGTTCTAGCATTTAGCACCGACAAAT
>paratb_13168
ACCCGAAGAGGATCAAGTGGCAACCTGGCCGCATTGGCGGTCTTGGGTTGGCCGGTGCTTATGAGTAATC
GCGCGCGCCGAGGCTGTGCGGGTGGGGGCACCGGTGCCGCGAGGGCTATACCCTTTGTGGGCTCAACCTG
CAACGGGTAAGGTGGTGGAATGAGTGAGATGATCCGCACTGACAGCCGCGGTCGCGTCAC
>paratb_13169
GCTGGCTGGCCACCCGGACTCGGCCTATCTGCTCCGCGAGGAACCGGGCGGGGTGCTGGTGCTGGAACCG
GCCGTGGTCATGTCGGCGGCCCAGGCGAGCTATCTGGCGCTCCCGGTTGCCGACCGTGCGCGTATCGAGG
AGTTCGTCGACGACCCGTCCACTGCTGTGAAACGCACGTATAAGCGGCGCCGGTAAGTGG
>paratb_13170

Figure 6-64

```
GCATCGAGTACGCACCCGAAGCTGCTGCGCAGCTCGATGCACTGGAGCAATCTGCCGACGATCAGACCTG
GGACGCGATCTGCGACGTGCTCGAACTGATCGACCAGACCCCGGACAGTGCCCAGGCCCGGCGCGAAGAA
ATCACGGGATCGAACGGCTCGAAGATGTGGAAGGTGCCCGTGCGGTCCTTATCCGTCGAC
>paratb_13171
GATCTCGCCGTGTTGTGGAGCCGCGGCTCGGCTGGTGACTATGTGGTGTTCGTCGGCGTGATGCCGATCG
CGAGGTAGGGGCGCACCCAACCGACCAGTGACGTAGTGCGCTGGACACGGCGCAAGCCGAGGTCACAGAC
GCTGACATTCGCGATCGAAGCCAGGTGCCGGGAGTGCCACTACAAGGCGACGGAGCGTGC
>paratb_13172
AAAGGTCACTACATATCCGGCCGAACGCGTCGCTGATCAGCTTCGGCCAACGCCGCCTGCAGTGCCGTCA
AAATTCGGCGGGTTGTGGATCCTCGCTGTGGTTTCGGCGTCCAACTCGTCGACACCGGCGATTAGCCCTT
CAGCAAAGTGCTCCCGGAGCGCGGCGGTCTGCCAATCGTCGTCGACAGCGCCGTGCATCC
>paratb_13175
TGTTGATCAGCGTCGAGGTACGGGAAGTGCGAGAGCAAGATGTAGTGCCCGGCTAACTTGCGGCGCGCTG
ACTGCTGAACAGAAGCAAATGTCTGTAGGTACGCCGGGAGCAATTTATGCGCATCGACGTGCATCGGATG
GACACCATCGTGATTGCCCGCCACCAAGTGCTTGGTCCCCGGGCGGTCCGCAAGCCATGC
>paratb_13176
GAGCGCACGCAGCTGACTGGACCGTCCGCCGCCCGAGATGTCACCGAGAACCCACACGACATCGTTGTCG
CCTACGAGTCGGTCCCATCGTTCAGCGATCTCGGCGTCGTGGTCGGTCGTCTCGGCAAACCCGCGGAGAT
TGGCTACGAGCCGATGACCGATGTGGAGGTCTGAGGTATACCAAGTTTCGGTTCTGAGCG
>paratb_13177
TCATTTTCAGGTCTACGAGATCACGTGGGTCAGCCGACGTGATTCACGGTGAATCACCGCGTATGCCTCG
TGGGTCGGTGGCTGTCCAGTAAGGATCGGTCCAAGCGCGGCGTTCTGGAGACAGTGCGAGCGTTGTCCGA
CCTGGTGCAAGTTGGAGGATGGCAAAGCTCTCGTCGATTGACTGCCGAAGTGCTTCCGTT
>paratb_13178
GCGTCAGCGTAGTCAGCGAGCCGGCCGAGTAGCGCCTTGCAGTCGGTCACCCATTCGTCTTTCAACCGAT
GGGTCTGGGTTCGGCCGAGACGGGCGGCGCGCTTGTAGATTGTTCGTGGCGTTCGATTTGTACCGCCGGA
GGAGTGGATATCGGTGACTCCGCAACCGGCTAGAGCCAGCGCGGAGTCCATCACTTCGGT
>paratb_13179
GGCGCGGGTAAGCATGCGGCCACGGGATTCTGTCAGAGCAAGGAGCTTGCCAAAGTTGGCTCGCAGAACT
TCGATCACTGAATCATGTTCCGACACAAGTTTTATCAAGGACCTAGAGCCCAAGACCGAAGACGATGCCG
CGCGTACGATTCGATCGTTGAGTTGTGCAAGGCGTTCGCACTCAACCTTTTGAGTTCCAC
>paratb_13180
AAAGTGCGCCGATTGCACTCCGGTTGGCGTCGAGGTCGGCTCGGAGAGAACGCAATTGAAGCGTGGCCTT
TTCCGCGAACCTGGCCGCGGGCGACATCGCCAACACGGCGAGGGCGTCTTGGCGGATGTCGTCTCTGGGG
TCGTAGTAAGCGCGCACCGCGTCGCGGCGGATCTGCGGTAGATAGAGCTTCGCCTTTGTG
>paratb_13181
AGCGCGGTTCCCGTCAGCGCGGACACATGTAGAAGATCGCTGACTGTTGCGCCGGCCTGGAACGCTTTGG
CGACGATATCGGGCGGCAGCGCAGGCAGCACCTGGGATATGCGGACTTCCAGATGATCTGTCATAGGGTG
AGTGTAGGTCGCAGCGCCGACACGGCCAACAGATTTAGTCCTCTACCTGGGGCTTTGAAT
>paratb_13182
ACGTAGGCACGCCGCTGGCACGCTGTCCGCTCATCGATAACTATGGGTACATGAGCACGTTCGACCGTAC
CGGGTGCGCCATCATATTTGGGTGTCAGTTCAGCGGAGGTCATCAGTGCACCTATCAGGAAACTGGTGTG
GCCGCAGCGGACGTACGCCGATTGGTGCTCCCAGTTGGCCTCGGGTTTCTTCGAGGTGGT
>paratb_13183
CGATGATGTCTCTCGATCGACCTTGGGATTGCGAAATTCCCGACTTCCACCTTCCGCTGCTCTCCCGTGT
ACGAGTTTCGATGACCCGAGCCCGGTTCGAGCTCCGTACGAGGGTCAGTATTCCGCTCTGGCAAGTGCTC
CTTGTGGTGATCGTCGTTGCCCTTGTCCTCGGCCTGCTTATTGGGCTGGTGACCGTCGAC
```

Figure 6-65

>paratb_13184
CAGGTGTACGGCTGAGGCGTTGGGACGAGATATGGCGGCGAAGCAACAAGAGATTCGACTTGTCCATGAG
CGCTACGGTGTGGTGGGCGCGGTGGGGGGAGGCTGGCGATGCGCTTCGTAAACGGCAAACCGATCTGGAG
TCCGGTAACCGAGGAGCTGCGGAGCGCGGAGTTACCTCTTCGATTGTGGCTGTCTGCGAA
>paratb_13188
TCGCCGTGACGGCACTCCGCGGTACAGCCTAGACTCGCGGACTCTTTATCAAATTGTGACGTACGGGCTA
CTGGGGCAGAACGCATTCGGGCTGAATGAGGTAGCGATCTTCGATGCCCGCTATTCTCATCTTCAACGAT
GGTCGATATCGGAGCTCCTCTGCTCACTTGCGGGCGAGAGAGTGTACGTCGCTGAGCTGT
>paratb_13189
CGATGGAACTGGATACGTTTCTACGTGACCCGTGCGGGTCACGGGTACCCAACCTTGCGCGTGAGGCAGC
TATGAGGATCAGCGCCGAAGGTGAACTGCCTGCGTCTCGGCGCCGTCGTGATCGGTTTACGAGGAAGCCA
CCGGCGAAGACACCACCATCACCGTCGAAGGCAAATCTGTGGCGCGCCTGAGGCCCCGTC
>paratb_13190
AGCCTCCACGCCGCCGGTGGATCCGCCGCGACGAGTTGCTCAGCCGACTCGAAGGTGCCCAAGCCGACAC
CGGTCTGCGCCACGACCTTAATGCGCTCGCCGGCGACACCACGGACGACCTCGGGCCCATCAAATAATTC
GCATTTGTGAGGACATTCGGTCGGTCGCGGAAACCTGCCACCGCAAGGTTTATGTTCGGT
>paratb_13191
CGACTGTTGATCGCTAAGCCTGTGGTCTGTTTAGCTGCATAGCAACATGTTTCGCCAATCGGGCGCTTAC
GACTATCGACGGTTCGATGTATCCGACATTCGAATTCCCGTTCTTACGTGCGGTTTTGAACGAGCCGAAG
AGAAGCTATGCCACCGGTTCCTACTCGGTGATGATTGTTGCATGACCGAAGTTGCGCGCC
>paratb_13192
GTGAGACTCTCATCTCCCATGGGGATCTCTACGATCCGAAACCCGTTAACGAGATCCAACCCACCGGATT
TGCGCCGTGGGATCTCGCCCTGGGAGGGCATCGTTCGTGTGGGAGGCCCTCGATCACTGGACATGGCTTT
GATGACTGTCGCGGCCCATCCGAATACCCACAACGATGTTCTCATCGTGGGTGCAGGTAG
>paratb_13193
ATCGCGGCATGTGTTGGCGCGCTTTGCTTTGCGTGCGGGACTCGTGGATCCGAAGCTGTTGGTGACGAAT
GATTGCGAGGCGGTGACGCAATCGGTAAGGGTCAACAGCTGGCGCTATGTGGTCATCGACTGCGCAGAAC
TGATGTCTGCGTCGCATGACTCCATGGCCAAGTTGGACCAGGCTTGTTGCGACAGTGGCA
>paratb_13194
CAACGCTATTCGCTTGTGATGGACCTGCTGAATCTCGTGCGTACTCGGTCGACAGACTGACGTGGAGCTG
CGCGGTCCAATCGCTGCGTCTCGTCGAGGAGATGCCGAGCCACGCAAATGGAGTCTTCGAGTTGCGCGTG
GTGGACAACGTGCCGGCTCCCGACATCGTATCGAACTCGGTTGTAAGGGTGCTCATACCG
>paratb_13195
GCGAATGGCCGTATTGGACTGGCTGATTCGGGCGACGACGAGGAGGGGCCACTGATCCTTGAACTACGCC
AGTAGTGGCAATCAAAAGCACTGTTACGAAAGAACGAATTGAGGAAATCAAATGGCTGACATCGCGAGAC
TGACGCTGAACGTGGATCCAGCATCTGTCCTTCTCTTGGGTACCGGTGGCACTTCCCGGA
>paratb_13196
CAAGGGCGGCATACGAGAATGGAGTGAAGACCGAAGCTAACGTCCAGCGTGGCGGTGTGGATGTTCACCG
GTTGACCGGAGTCGCCGTATCGGTGAGCGGAACTGGGCTCGACGGAGCGGTCGTGGAGACGTCGACCCCA
CTTGAGAATGTTCCTGCCGGCGCGATTTTCCGCGCAGAAGGAGCTGCCGAAGTATCGGTA
>paratb_13197
CGCGCCGAGGGCCGGCAAGGATTCGGTGGGGGTAGTCCGCGAGGTGTGCTTGCCGTGACGGTATTCGTCG
AGCGGCTGGTTCCAATCGGAAACGCGAATGATGTAGTGCGCTCATCGCCTCAGAGGCGCCCGGCGGCGGG
TGAGTAACCGTGCGCGGCCAGTATGGATATACATCGCCGGCGTTGACCGCGGTGAGATGC
>paratb_13198
CTCTCCGATGCTCGATGGACAAGAAGCATGTTGGAGCTCGTTGGGTTGAGTCGAGCGCTTCCGACGAAGC
GTTCAGCTTGGTCGTTGCTGGCTGAGGGCGCCGTGAGGAATCGTGTGCCGACGCGGATGACATACCTAAA
GTCGTATGTGCCGACGTTGATCTCGGTGGCTCCGGCACCGTACGGAGCGAATGCGCGATT
>paratb_13202

Figure 6-66

```
GGTGACGAAGGAGAGGAAAGCTATCGGGGCCGAGATCCATGCCTCGGTTAACTACTTGGTGAGGAAAGGG
CGATCGGCGGGAGTCGTATCGATCTTGTCGACGCAAAAGCCGACGGCCGATTCGTTGCCCACGGACATCA
GAGATAACGCGTCGTTGAGAGTGTGCTTCGGTGTCCAATCTACATATGCGGCAACGGCAG
>paratb_13203
TCCTTGGAGACGGGTGGCGAAGTGACACGGATGTGTCGCCGCTCGGGATGTCGTCGGGCGTCGGAGTCTC
ATTTATCGGCGGCCACTTTCGGCGGTTCCGGGCTCCCTTCGTTCGAGAGCGCGTAATTGCGACCCATTCG
TGGCGTTGGTCATCCCTGAATCGTGACCCATGGGAACTCCTTCGACCGGAATTGGCAGAT
>paratb_13204
GGTCATGTTCGCGATTCCTAGGGAAAGCGGTCTATTCCGCCGTATATCTGTCGGTCCGACATCCTCAGCG
GCGCGCTTGCGGATTGGCGGTCATAACTGTTGCAACGGCACTCGGGCACAAGCCGCCGGCTGGCGGCGCG
TGAGCACAGGGATACGTGAGAGGGGTCGATGGTGACGGTCGAGGACTTGGGTCGCCGTGC
>paratb_13205
TGGGCGACAGCCTCTACTCCTGAACATCGAGGAACTGGCGGATCGACTGACGGTAAGCGTCGGCTGCATT
CGGTCCTGGCGGTTGAAGGGGGAGGGTCCGCCAGCGATCCGGGTCGGGACGGCGCTTCGTTGGGACGCTG
TCGAAGTGGATGCATGGCTGGACGCACGACGGGAATCACGATTGGAAGCAGGATGATCGA
>paratb_13206
GCCACGTGTCGGACCGCACGGTACCCGCGTGTATCGGGCTCGTGTCTACTACCGCGGTCGCTACGTCGCA
TCTCGGACGTTTTCCCGCAAACGCGATGCACAGGAGTGGGAACGTAAGCAGGTCGAGACACTGAAGACCG
GCGCGTGGGCCGATCCCAAGGCAGGTGAACGTCCGGTCCGCGAATGGTGTGAGATGTGGC
>paratb_13207
TGTCGGCTCAACCCGTCAGAGCACCGGCGACGGAGCGGAAGATCCGCGGCGTTATCGGAAAGCAGATCGC
CGGCACATTCGGCCGGCGCCCTCTGGTCTCTGTCCGCCCGTCCGAGGTCCAGGCGTGGGCCGCTGAGATT
TCTCGAAAGCAGTCGGCGGCGACGGCCCGCCACTCGCTGGGGGTACTGCGCCGAGTCTTT
>paratb_13208
GAACATGCGGTCCGCGATGGGGCCATCCACCGCAACCCGGCCGCAGGCATCCGCTTGCCGAAGGTGCAAG
GCAACGATCCGCGCCCGCTCACTCACGACGAACTGTGGCGACTGGCTGACCACATGAACCAATTGCGTGA
CCGACTCTTGATCGTCGTAGCCGGATACTGCGGTCTACGCTGGGGCGAACTTGCTGCGCT
>paratb_13212
ACGGGACGAAACGGAGTATCTTCTGAGCTCGCCTGAGAATGCACGTCGACTCCTGGAAGCCCTGGGCCGA
GACAAAGCAATCCATCCGGCACCATCGGATACCACAGAAGCACCGACCACACACCGACCAGAGAGGAGTG
ACGAGCAGTAGGGCAAGCGCCCGGAAACCCTCGCTGACCTGCAAAAATGGTGAGTGCCCC
>paratb_13490
CCGCCGACGCCGCCTCGGTGAAGCCCGGCGCCTTTCGGTCGAGAGCGGACTGCAGCACGGTCATGTCCAC
CACCGACGATGCAGAGCGAAGCGATGAGGAGGAGGAGGTGAAATCATGATTGGAATCCCAGCAGTTTGGC
GGACAATGCGATCAGGATTTCGGTGGTGCCGCCGCCGATGCCCAGGATCCTCATGTCCCG
>paratb_13522
AGGAGGGCTCCGGCATCATCCTGTCGACCGACGGGCTGATCCTGACCAACAACCACGTCGTCGCGGCCGC
GGCGGGACCGCCCAAGGGTCCCGCGGCGCCCCGGTGGTCCCGCTGCCGCCCGGCGGCCCGGGCGGTGGT
CCCGGCGCCGGCACCCCGAAGACGACGGTCACCTTCTCCGACGGCCGCACCGCGCCGTTC
>paratb_13563
GCGCGACTCGTTCGCATCGAGTAGGTCAGGGGTTCGAATCCCCTTAGCTCCACAGAGTTTGAGCAGCTAG
AGGGTAGTTCCGGAGATAGCCGAGGGCGGCTTCCGACCTCTGGGTCCGCAGTCGGCACGCAGCAGATCGA
ATTGCCGCATCTGATTGTCGGCCACGGGACCTAAGTCCAAATGGACGGGTTGCGTGGGCA
>Contig16_13564
GCAAAATGAAGAGGGCTGTGTATTGCGTAATTCGTAGGCCGGGCGTCGCCTGCGAAAGTGGGCGGCATGC
CTGCGCAAGCATGGGTAACGCTGATCGTCGGCGGCGTCGCCACGATTGGCGTCCTTGTCACATGGCAGCA
AAAGAGCCGCGCCGACCGGCGCAGCGAGTGGTGGCGACGCACCATGTGGGCGTTTGAGCG
>paratb_13616
```

Figure 6-67

```
GCCGTCGTCTTGGGCACGGCATGCTCCCAGGTGCGCTGGCACGAGCCGCCTATCACCAGCAGGTCCCCGT
GCGCCTGCGGCAGCCGCAGCGACGGGCCGCCGCCGCGGCGCCGCAGCGCGAACGCGCGGGTGGCGCCCAG
GCTGACGATCGCCACCATGGTGTCCTCGGAACTGCTGCGGCCGATGGTGTCGCCATGCCA
>paratb_13718
GGGCGGACACCTGGGCCGCTGGTACATGGCCCACGTCGAAGGACGGGTCGCGCGGGTGCAATTCAGCACC
GACCGGGTGATCCACGGATATGAACGCGACGGCGACGGCGTGTATGTGCGGCGCCGCTTCACCTTCGACC
CGGGCCTGCTGCGCGAAGCCGGAATGTCCAATGCCGCAATATGGTTGGTGAATCCCCCGA
>paratb_13719
TCAGCGACCCGAGTCATGGCAGCGGCATCCTGTCCGGGGTGTATCTGACGCTGATCTCCCCGCTCGGCCG
GTTCTTGCTGGCGGCAGCGATCCGCGAGGCGCACACCAAGACGGACGGCCCGCCGCGGATACTGGCGCAT
CTGCGCAACATTGCGGCGGATCTGCCCGGCTCGATCGGGTTCGCGGTCGCGTTCTGCTAC
>paratb_13720
GCCCGGTTCGTCCGGCGGGGCAGGAAGGCGCCGGGCTTCTTCGTGCGCAGCGCCGACAACCGGTACCTGC
TGCAGTACCACGGCGAGCATCTTCCGCACTGGGAGAGCCGGGTCGAACTGTCGGACGAACGAGATAGCTT
GGGCATGAAGCGGATTCGCACCCGCATGCATTTCTCCGACGCCGACTACGCCAGCGTGCG
>paratb_13721
CACGGCGATCGGTGTAATCGACGAACACCTGCGCCGCCACGGGGCGGGACGGGTGGAGTGGTTGACCGAC
GACGTCGAGGCCTCGGTGCGCGGCTACATGCGGCGGCGGGCCGGTTTCCACCAGGCCGGAACCACCCGGA
TGTCGGCGTCGCCGAAAGACGGTGTGGTGGATCCCCAGCTGCAGGTGCACGGGGTGCGTG
>paratb_13723
CCCCGCTGGACGCGCCGAACACGATCGACTGGATCTGCGGCTGGCGGCAGACGTACTCGATGGCCGCACG
CGGCTCGATCGCGCCGGACGCCAGCACGGACATCGCGATCAGCCGGCAGCGGCGCTCGCGGATCGTCTTC
TCGTACAGCTCGATTCCGCCGCACATCCGGAAGCCGATCTTGTTGAAATTGGCGCACACG
>paratb_13724
ATCGGGTTTTCGATCCCTTGCCCGTCGAGGGCGTCGAGCAGCCGCGGCAGGTTCATCGTGATGAAGCCCG
GCTCGGCGCCGTACTTGAGCCGGACGTGGTCGGAGAAGAAGCGGAACGCGTCGTGCATGCCGAGCCCGAG
CAGCAGGTCGGTGACCACGTTCTGGATGAAGATGACCGGCGTGGACAACCCGGCGAACAT
>paratb_13725
CTTCATCTCGGCGTCCACCAACAGCTGCATGATCGGCTCGATGTCCTTGCCGGCGAGGGCGACACCGCCC
TTGAACATCGACCGGACCGCCCCGTCGTCGGGCAGGAACCGGCGCAGCGCGTCGAGCATGCCGAACTCGG
TCACGGCGTTGGCGTACTTGTGCGCATACGGCATGCACGGGTAGAAGACGTAATCGGGGT
>paratb_13726
AGCGGGAACGGTTGGCGCGGAAGTGATCGCAGATCTCGCCGACCCGGTCGTGGGTGGTGCAGACGAAGGT
GCGGATGCCTTCCCGGTAGGCGGCGTCGAGCGTGTCCAGCACCGGCCCGAGGTGCTGGAACCGGATCGCC
TGGGCGCGCGCCTTCTCCTCGGACATGTGGTTGACCCCGAAGAACTGGTTGTCGCCGAAC
>paratb_13727
AGCACCCGGTCCATGCTCACGACGCCCTCATGGCCGCGAGTTTTTTGATGCGCGCGGCGATCTCGCGCCG
AAACGCGCCGCGCGGCGACCCGTTGACCGCGGGGAGGGCCGGCGACGCGGGGCGCCCGGCCAGGGCGGCG
CCGGTGATCATCGCCACGACACGGTCGACGGCGAGCGCGGAGCGGAACGTGTTCTCGCCG
>paratb_13728
TCGCGGCGGTTGTTCTTGACGCTCTGGGCGAAATAGTCGATCTGCGCCGAATACTCTTCGCCCCGAAGGT
AATACCAGACCTCGTCGGTGAGCTCGGTGGTGTAGCGGATCGTCCAGCCCGGCCCAACTCGGGGAGCCC
GGGGTGCGTTTCGCGAAGGTAGATCTGGCACTCCTGGCGATCGGCGACGAGGCGGCCGTT
>Contig16_13729
GGTCCCCCACACCGAGATTTTCGTCGACATCTTGCGGAAGCTCTCGTCGCTCCAGTTGACGCACAACTGG
CCGCTGGCGCCGTTGTCGTAGCGCAGCGTGCAGTAGACCTCGTCGTCGACGTCGCGGGAGAAGACGCTGT
GCCGCACCACCCCGTCGACCGAATGCGGCACACCGGCGATGAAGTTCATCAAATCGATGG
>paratb_13730
```

Figure 6-68

```
CGTGGCAGGCATAGTCGTAGAGGGCACCGCCGCCTTCCTCCTTCACGCCGCGCCAGGTGCTGCCTTTCGG
GCGTAGCACGACGGGCCCGTAAGCCTCGGCGCGCACGTGGTGCACCTGCCCGAGCCCGCCGGACGCGACG
ATGCGTGCCGCCTCCCGGAAGGCGCCGATGAAGCGGCAGTGGTAGCCGACCTGGGTGACG
>paratb_13731
AGCCGATTGGTCTCCGCCAACGTCACCAGGCGCTCGCCGTCGCGGACATCGAGCACGAACGGTTTCTCGC
AGAAGACGTGTAACCCTCGGGCAAGGGCCTTTTCGACCATCGGTGCGTGCAGCCGCGACGGCACGGCCAC
GACAACCGCCTGGGCCCGCGTGTGCGTCAGCATCCGGTCGAGGTCGTCGTAGCAGTCCAG
>paratb_13732
ACCCGTGTATTTGCCCAGGATGTCGCGCAGATAGCCCGCGGAGTCACACACCCCGACCACGTCGAGGTCC
GGGTGGGTGCGCAGGATCGCCAGGTGCGAAAGACCCATTTTTCCCAGGCCGACCACGGCCGTTCGAATCA
TGCTCCGCGCCTTCACTCGCTTCCACTGCCGCATCGGCAACGGGTACGGCCCGCCAACAC
>paratb_13733
CGTGGACGTTAGCACCGCGGGCGGATCGTCAACGCGAAATCCGGTCGATCTCTTCGTCGTCGGTAATCCC
CGAACGTGGGCGGGCGCGGGAGTTAGTCTTTTCAAGGCGATCTCGGCCCCGCCGGCCGCGCGGTGGCATC
GGATCGTCGCGGCGCAGCCGGCGGGCCGGCGCGAGCGCCTCAGGTGAGGGGAGACATGGG
>paratb_13735
TCGCGCTGCGGCTGTTGACCCGCCACCGGCCGGCCATGATCCTGACCACCGGTTCCGGTGTGGCGGCGCC
CTTTATCTGGCTGGCCTGGCTGCTGCGGATCCCCGCCGTGTTCGTCGAGTCCGTCACCCGCATCACCGAG
CTGTCGCTGACCGCGCGGATGGTCAAGCCGTTCGCCTCCCACCTCCTGGTGCAGTGGCCC
>paratb_13740
GATTGCACACCGCTTTGTGAGGCGCGCCGGTAATGGGCGATCGATCCCTTGGCGGCGGCCAGGGTGGGGA
TCACGTCGGCGTAGCGGAAGCTGCCGTTGCGCCAGCGGGTGTGTTTGGGCAGGGTTTTCACGTCGAGCGG
CCCGTCGCCGATCAGCACCAGGTTGTCGCCGCGCCAGCCGCCGCCGACCACATGCCGTTG
>paratb_13741
CCAGGCCGCGAGCACGACGTCGACGTTCTTGTAGGGGTTGAGCCGGCCGAACATGACGAAATCCCGGCGC
CCCTCGGGACCGACGAACGGCGGAACCCGGTCCAGGTCGAGGTCGCTGGCCAGCGGCACCACGCGCACCG
GGGTGCCGGCGACGTCGCGGCGCGCCGAGATGGCCGCCGCCACATAGTCGCTGTAGGCGA
>paratb_13743
CGCAGGGTGGGCAGCCAGGTGGCGGCCGTGCGGAATCGCGGGTCGAGCACCAGCTCGTAGTCGCGCGCGG
CGTCGGACTCCGGGTGCTGATCGGAGGTGACCAGCAGGACCTCGGCGCCGTGCCGCTGCAGCGCCTCGGC
CTGCACCCGCACCGCCGGCCGCGTCCACGGCGAAAGCCACAGCACCCGAGGGGAATTCAC
>paratb_13744
AACACGGCTCCGATCGCGTCCAGGTAGGCATCGGCCATGGCCTGCACCGTGTAGTGCTTGCGCATGCGCT
GCTGGCCGCGGCGTCCCACCGCCGGCAGCGCGTCCGGGTCGGCCATGATCCGGGCCAGACATTCGCGCCA
CCCGGACACGGTCACCGGCTCGACGAGGAATCCGGCCCGCCCGAAATCCAGCATTTCCGG
>paratb_13745
GACGGCGCAGATCGCCGACGCGGCAACGGGCACGCCGCGCGCCATCGCCTCCACGATCACCAGCGGGAAC
GCTTCGGAGCGGCTGGGCACACACAGCAGGTCGGCGTCGGCCAGTGCCGGGCCGGGACCGGCCGCCCAGC
CATGCCAGCGCACCCGATCGCGCAGCGCCGCCGGCGTGCCCGCTTCCAGCCGCTGCCGGT
>paratb_13746
CCGGACCGTCACCGAAAATCGAGAGCCGCCAAGGTATTTCGGCCAGCCCGCGCAAGGCCTCGATCAGCAG
ATGCGGGTTCTTGTGCTCGACGATGCGCGACAGCATGACCAGGTGCAGCGGCGCACCGTCGGCGCGCCGC
CGCGGGGCCGGGTCGCCGGTGACGACCACCCCGTTGGGCGCGATGAAGTGGCGCCCGCAC
>Contig16_13747
AGCCGATGCTGGTCGAGCAGCATGTCCCAATGCCGTTGCGCCAGCACGATGAAACCGTCCGCCCTGCGCA
TCGCGGCGGTCAGCGGCCGCGAGTAGATGGGCCGGTCCGGCTCCGGCGGAACATGCGGGCGACCATCCA
GCGCCGGCCGCGGCCGGCGGCCCGCCACAGCGTGGCGAACCCCACCTCGGTGTTGGTGTC
>Contig16_13748
```

Figure 6-69

```
GCCGGAGATCAGCACCGCCGGGCCGTCGGCGACGTCGATGATCGGCGCCCACCACGGCTGGCGGATCACC
CGCACCGTGTCCGGGATTTCGGCGATCAGCGGGCCGAACCGCTGCACGCAGACGATGGTGACCGGGTAGC
CGCGCCGGTCCAATTCGGTTGCCAGAAGCGCTTTTTGCCGCTCGGCTCCGCCGTAGACCA
>paratb_13749
GGCGGTTGGTGGTGATCACGACCGACGGCAGCTCGGTGCGCCGGCGGTTCGGCCGCCGCAGTCGCCCCCA
CGCGGCGGCCCCGGCCAGGTACGCATCCGCGCGGTGCACGCCGCGCCGATGCTCGAGCAGGAGGGCGGCG
TTGGCGCGCGCCAGGTCACGATTGCGCCGGTGCGCCGCGTCGGTGAGGCGTTGCGGCCCG
>paratb_13750
GTCGCCGTGTGCTCGACGCCGCGTTCGTCGACCGTCAGGACACGCCAGCCCGCCGCGTGGGCCCGGGCCT
GCCAGTCGGCCGCCTCGCCGTAACCGAAGAACTCTTCGTCGAAGGCGCCGAGGGCGTTCCAGGCGGTGCG
GTTGATCGCCAGGCACGGCGGGCGTCGCGTCACGAGGTTCTCCGGCGTGCGACGGCGCGC
>Contig16_13751
GCTCGCCTCGGGAGCCATCGGCGACACGGCCGCCACCCCGGGCCGGCGCAGCAGCTCCCGGGTCCGGGTC
AGCGGCCCCAGTAGCCGGGTGCCGGCGGGCAGCAGCAACAGGTCGGCGTCGGGCGGTGCGTGCTCGGCCA
GCACGTTGAAGGCGACGGCAGGGGAGACGTCCAGCGGACCCGAAACACAGTGCACCCCAG
>paratb_13752
GGTATTTCGTCGCCACCTCGGCGCCGTAGGCGTACACGGGCAGGTCGGGCAGGTGCTCGGCGACGCTGGC
CAGGCACGTATTGGTGCGGTCGCGGTCGCCGTCGGTGACGATCAACAGCGCCAGCGGCCGCTCGGCCGGC
AGCGCGATGGCACCGCCGGCCGAGCGCTTCAGGTATGCCCGGTCTGCCTTCGACGTCATG
>paratb_13753
CCGCCGGCTGCTTCTCACGCAACGAGGCCCGCAACGAGGCCAGGCTGGACCAGGTGATGGGGCCGAACAC
CGCGCTGGTGGTCAGGTAGGCCACGGCCGCCGCGGTCAGCACCAGGATCACATGGTGGCCCGAAAGCAGC
AGCGCCACAACGACACTCGCACCGGTGGGAACGAGCAGCCGCAGCACGAACGCGACCGGG
>paratb_13754
GTGCGGTAGCCGCAGTGGCGGCGCAGCCACCAGGTGGAGACGGCCATGTTGAACAGTTCCGTGCACACCA
GCGCCACGCCCGGGCCGACGGCGCCGTACCGCCCCGCCAGGGCGAGGTTGAGCCCGACGTTGAGCGCCAG
GGTCGCGACCGTCAACCACAGCAGCACCCGTTGGTGATGCGAGGCCACCAGGCCCTGGCC
>Contig16_13755
CAGGGTGCCGCCGACGAACCGCAGGGCCGCCGCGACGAACAGCAACGCCAGCGTGGGCGTGCCGCGCTCG
ATGAACGCGCTCTTGCCGAACAATCCGATCAGCGGCCCGGCGAGCAGCGCGCCGACCACGGCGACCGGGA
CCGCCACGAAGGACATCAATTCCACGCTGCGGCGCAGGAAGCCGGCGAATGCGGCGACGT
>paratb_13756
CCCGCGCGAACAGCTCGGTGGCCGTCGACAACGTCGACTTGTGGAAGATCAGCGAGACCACGATCGTGTT
GAACGCGATCGTCAGGGCCAGGCCGTAGACGCCCACCTCGGAGTGGGTGCTCAGCAGGGACAGGATCACG
CCGTCGGCACGGCAGTACAGCAGCCCGACGATCAGAAAACCGATCAGCGGCAAGCTTTCC
>paratb_13757
CGCAACAAATCGGCGGCCTCCCGCGGGGCGAACAGCGGCCGCACCGAGATGTGCCGCATCGCGGCCGCGC
CCTGGATCAGCAGCTGCACGGCGGGCGGGATCAGCTGGGCGACGGCGAACCAGATCACGTTGGCGTGCGC
TGCGACCAGGCAGGCGACCATGGCCAGGGTGCCCACCCGGGCGGTGACGTCGGAGATGGC
>paratb_13758
CACCGCCGAGAACCGGACGGTGGCAAGGAAAACCGGCTCGAATCGCGTCGTCATGGTCTGCAGCAGCAGT
CCACCCGACAGCACGACCAGCATCACCCGCACCTCGGTGTCGTGATAGATCAGCAACCCCGACCCTGCCG
CCAGCGCCGCGAGCGGAACGCAGTACAGCAGGGCCAGGCCGCTGTTGATGCGGACCAGGC
>paratb_13759
GCTCCAAATCGCCGCGGCCGGAAGTCACCCGTCGCACGATCACGGTGGCGATACCCAGATCGGCGAAGCT
GGTCCACATGGCGACGAACGCCACCGCGATGGTGAGCTGGCCGTAGCGTCCGGGACCCAGATAGCGTGCG
GTCATCGCCACCGAAACCACTGAGGCCAGCATCCCCAGTGCGCGGCAGATCAACTGGACC
>paratb_13760
```

Figure 6-70

```
GAGAACGCGTGGGCCATCCGGGCCAGCGGCACCGAGGGCACGACCGCGGCGGCTGCCGTCGGCTCACTCA
TGGGTGGCGAGTTTAATAGGCGCCGTGGCTCGTCAAGACGGCTTTGACGGTCTTGGCGATGATCATGAGA
TCGCCCGCCATGGACCAGTTGTCGACGTAGGACAGGTCCAGCCGCACCGATTCTTCCCAG
>paratb_13762
CGGGGTGACCCGCGGGTCCTGGCGCATCTTGAACAGCACCCCGGCGCCCTCGTTCACCGACAGCAGCTGC
TCGAGCTGGGTGTCGGCGCCGTCGGTCATGGTCCGAAACTTCAGCATGGTGAACGGCTTTCCGTCTAGGC
CGATCCGCTCGGACGGGTAGAAGACGGGGCCCTTGCTGGTCAGCTTGATGGCGAGGGCGG
>paratb_13763
CCGCGAGCATGACCGGCGCCGCCGCGATCAGCGCGGCCAGCGAGAACACCATGTCGAAGGCCTGCTTCTG
GAAGCGTTGCGTCCCTTCGTATTGCGGCTTTTCGACGTGCAGCAGGGGTAGCCCGGCGGTGAGGCGCAGG
GTCAATCGCGCTTCGGCGACGTCCATCACCCCGGGCGACACTACCAGGTCGACGTCCATG
>paratb_13764
GTCTCCAGCTGCCACATCAGCTCCCGGATTCCGTGCACACCGAAATGCTCGGTGCGGGTGACCGCGACGG
TGTCCGCGCCGGTGCTGCAGATCGCGGCCACCGCGTCGGTTTCGTCACCGAGAATCGGGACCTCGTGCCC
GGCGACGGTCAGGATCTCGCCGCGGGGCGGGCCGTATCCGGGGATGCAGACGCCGACCAC
>paratb_13765
GGTGCAGCCGTTGCGAGGGTCGCGGACCAGTTCGTGCGCCAGGTGGGTGACGGCCTGGCGGTCGCCGATG
GCGAAAACCGTTGTCTGGCAATGCCCGTGGGCACGCTGGCGGGAGATGTGCTGGCGCCACAGGCTGCGGC
TGGCCAGCAGGCCCAGGGTGCCGACGGGTAGGGCGATCGCCAGGTAGCCGCGGGCCAGAT
>Contig16_13766
CCACCTTGGCCAACAGGGTGACCATCGCGATGATGCCGAACGTCCAGAACGACGCGCTGCCGATCCGGCG
GTATTCGTCGATCCCCGAACCGATGATTCGCGTCGAGCGGGTCTGGAACACCGCCAGGGCCGACAGCCAG
AGCAGCGCGAACAGCACGGAGAACAGCGTCATGACCGGGTCGGAGTAGCCGGAGGTGTTC
>paratb_13767
GCGACCTCCCCGAATCGGACGTACTGTGCGAACAGCACCGAGACGAATACGATCACCGAGTCGGTGACCC
GCAGGCCCTGCGAATAGTGGTCCTGCCACCGCCGTACGGCGGTGCCGGCGGCCGACGTCGGCGCGCCGGC
AACCGCCGGCCGGCCACCGGTTCCGTCGCGCGCCACGGTGGTGAGGGCCGCCGGCCGGTG
>paratb_13768
CTTCGGCGACCACCGAGCGGGCATGGCGTCCACCGTGTTACGGATCATCACCGACTGAGGCATGGTGCCA
CCTGTTCCATTGGTGCCAATCTGGTCTGGGCTGAGGGCCAGCTCGCGTCCTGCTCGGAGATGACCGTGAC
CGGTATCGGCCAGGTGACTCCGAATTCCGGGTCGTCCCAGCGCAATCCCTGCTCTTCGGC
>Contig16_13769
CGCCGCGTGCCGCCCACTGGTGTGGTAGGTGACCTCGGTGTCGTCGACCAGCGTCTGGAAGCCGTGGGCG
ACGTAGGGCGGCAGGAACAAAGTCCGGTGGTCGTCGGCGGCCAGCTCGATCATCACGTGGTCGCCGTAGG
TCAGCGAGTCGGGGCGGACGTCCACCGCGGCGGCGACGATGGCGCCGCGGGTGCAGCGCA
>paratb_13770
GCAGCGTGGCCTCGGCGTGCGGCGGCACCGTGCGGTGCAGCCCCCGCACCGTGCCGCGGGTGTAGTTGAA
GACGATATTCGTCTGCGCCACATCGAGATTGAGCCCGTGAGCGGCGAAGTCGCGGGCGCAGAACGACCGC
CAGGTAAAGCCGCGATGGTCGCGACGGAGTTCGAGGTCGATGATCGTCACCCCGGCGACC
>paratb_13771
TTGGTGGGTGTGTACTTCACGTACCGCTCCTTCTTCCCGGCGGGGCTTAGGCGTATCCGGCGGACGGTGG
GCGGGTCATCACCGTCGGGATGACGCCGTAGCGCGGGCCGAGCGTCTTGCCCGATGCGGCGGCCAGCCGC
GGCAGCGAGCCCATGACGCTGGGCGGCACGTTCGCGCCGGCGAGGTTGATCGTCGGCAGC
>paratb_13772
GCGGAGACGGCGCTGTGGGCGGCCGGGATCACGCTCGTCCAGCTCGCCGGCACCGCCAACGGTCCCAACG
CGGCCGCTTTACCCAGCGTGCCGAGCACGCCGGAGCCCAGCGATCCGAGCGCCCCGGCCCCGGAGCTGGC
CGCACTCGCGACCCCCGACGCCGCGGCCGCCACACCGTCGCCGGCAGCCTTGGCCAGGCC
>paratb_13773
```

Figure 6-71

```
CTGCGCGGTCTGGGCGATGCCGAGGATGGACGACATTCCGTACAGGGGCGTGGCCGCGGCCGAGAAGGCG
CTGGGAATGGCGCCGGGTATGCCCGAAGCCAGGCCCGTCATGATCGACGACGTGGTCGAGTTGGCCGCCC
CGGCCGCGGCGCCCCGGCGGCCCCGCTGCCGGTGTCCGTGACCGTGTCCAGCCCGGCGG
>Contig16_13774
TCATCGGTGAGGAAAGCCCCTGCAGGGTGGTGGGGATCTTGGACACCGTGTGGTTGAGTTCGGCCTGGGT
GGTGACCTGCCCGACCACCGCGGCCTGGCGGGCGACGCCGGCCTCGTCGGTGGTGTCGGGCGGCGGGGTG
AACGGCGTCACCGCGCAGGCGGCCGCCGAGCCGGCGGCGTATTCGTACATCGCGGCGGCG
>Contig16_13776
GGCGGCGCCGGCCATCCAGGCCATGTACGGCGCGAACGCGGAGGCCATCGCCAGCGACGACGGCCCCAGC
CAGCGTCCGGTGGTCAGCCCGGCGATGACCGAGCGGTAGCAACTGGCCGCGGCGTGCAGTTCGGCGGCCA
GCGCGTCCCAGGCCACGGCGGCGGCCGTCAGGGACAGCGGGCCGGGCCCGGCATACATTC
>paratb_13777
TCGCGGAGTTGACCTCCGGGGGAAGCGCTCCGAAGTCGATCACGTCAGCTCCCGGCCCTGCGCAGGACCG
CGGCGGCGGAGGCGGCGCCGGCGCCGCCCCACACCGTCCATGCAGCGGAAAAGTCCTGGTCAGCCGAGGT
CTGTGGCCCCTGCGGGGCCGGTGACCAGCGGTTCGCCGTGACGAACGACATGTGTTTCCT
>Contig16_14004
CGCGGTGGCCTGCGCGCTGGCCTGCTCGAGCGCGGCCGCCGTGGTGGTCAGGTAGGACACGATGGGCTGC
GCCGCGGCCGCCGCCGCGGCCGACCCGCCGCCCGTCCACTGTTCGGTGGTCAGCAGCGAGATGATCGACT
CCCATTGGCTGGCGGTGCTGCTCACTTCGGCGGACAGGTTGGCGTACGCCGTCGCCGCCG
>Contig16_14278
GCAGCTGGTGCGATTTTCGTACGTTAGACCCACGCTCGACGATGCGATTGAGCAGCCGCTCGGTTGCGAC
GTGGTATCTCGCCAAAAGGCCGAAACCACTCGTAATGCTTTGCTACAGTCCGGTTCGCTAAACGGAAGAC
TCTGCAAAGGGATGCTTGACTCGGCATGGAAGCTTTCGTAACGATCGTCTTAATTGGGCT
>paratb_14279
TGCGGCCATCGTCCTGTACAGGGTCATTCTGTACATCCTCAAGGAGCGGTACTTCGCCAGCGAGGAATTC
CTGGCCCACAAGAAAAAGATCGCATCGGTGGTCGCCGAGCACAACGAGGTCGCCGATTACGTCTCGGAGA
TCCGCAGCGGTGGGTCGTTCAGGCTTGGCGCGTCATCTGCCGGCGCCCAAGCACATCTGG
>paratb_14280
CGTCTTTTCAGAACACCAGCCATTGGAATTACCGCCGGGACCGGAACGTAGCGAATTACGAAGCGCCGGA
CGTACACAACTGTTCCCTACAGGTTGTCCGCAACGCCAAGGCCGATCCCCTCAAGTACGTGATGAAGTAC
TTTGGAATTAAAGCTGACGAGGCCCATCTCGCCGAGGTGGAAAACTTGGGCGATAGCATC
>Contig16_14294
AGTTCAAAGTATGAGCCCTAGAACCCGACGACTCCGAATTGCCACTTGCCCCGAACCTCGCCACGGGAAA
GTCTTAGGGCATGACGACGGAAAAGCGCACGGCGGGTTGGGCGGCGAGCGTGGCGGCGGGCGGCGCGTTG
GCGATGACCGTCGTCGGTCTCGCCGGCGGCCCCGTCGCCGCGGCGGGCCCGGCCCCCGCA
>Contig16_14301
CTGCCGATGCCCCCGAGGACGGCGGCGCGCCGCCCCGCCGGACGCACCGCCGCCCCGCCGGACGCAC
CGGCTCCGCCGCCCGACGCGCCGCCTGCGCCGCCGGAAGCGCCCGCCGTTCTGATCGATGCGCCGGCGCC
CGTGCCGCCGCCCCGCCGGGCCCCTGAATTACCTTTTCCCGGCGACGCAGTAATTGCGA
>paratb_14546
CGAGGGATACATGAAGTCCTGCGTGGGCGGCGCGTCGGCGCCGAACCCGGGCGCCGCCGCGGGGCCGGC
GCGGCGTCGGGTGCGCCCGGGGTTGCCGGGGCCGCGGCGGCCGGCGCCGGTGGCGGCGGAACCGGTGCGG
CGGCCGGGACGGTGGCCGGCTGAACCGGCCCGGGCGCGGGAGCCGCGGCGGGTGCCGGAG
>paratb_14659
CGCACGCTGATCCCACATTCGGCGAACCAGGCATTAGCGCGTGTCCAGAACTCGGCGGCGGTTTCTTTGA
TCTCATCGTCGAGTACCTCGCTGTAGGCCAGCCGGGAATATCCATCGATGGCGGTGTGGAGATAGTGATA
TCCCCGTATTGGGTTGCGGTGCTTGCTGAACACCCCGCTGCTCTTGTCCGCGTTGGAGTT
>paratb_14661
```

Figure 6-72

```
TCCCCAGCAGATACCCGATGCGCGCTGGTCCCCACCGGCGGATCACCCGGACTTTGATGATGCGCCGCTC
GGTGCGCGTGGGCGTGCGGTTGGGGCTGTGATGCGGTCGTGAGCTGCGGTCGGCCATTCCGGCCTCGCCC
AGCTCGCGGTAGCGCCTGGCCCAGCGCTCTGCGGTGGTTACCGAGACCTGGAAGCGTTCG
>Contig16_14757
AGGCCGCCGACCAGGTAGGCGAGGCTGTGCAGGGTGGCCACCGGCGGCCCCGACGGGGTGGGCGGCGGCG
CGCCGGGTGCGGCCGCGGCGGGCGCCGCCGCGGACGTCGGGGCCGGCGCCGGCGCGGGGGACGGGGCCGG
TGCCGGCGCGGGCGGCGGACTCGGTGCCAGCGCCACCGGGACGAGCGTTCGGCGCCGGGA
>Contig16_14792
ACCCCGAATCCCGCCACAACTGCCGCGCGACCACCCCCATCTCGGGAAGCCCGGTGATGTCGTCGCGGTA
GTAGCTGGTCATCATCTCGCCGTCGGCCGCCGCGCCCTGGGCGGCCGCGGCGATGACGGCCGGCGGCCGG
CGCAGGTCGCGGGCGCGTTCGACGCTGGTGACGACCAGCGCGACCCCGCCGTCGCTTTCC
>Contig16_14903
GTTGGAGGCGTGCGCGCCCGGCTGAGCCCGACGACCGCGCCGCCGCCGGGCTAGGCTGTCCGCCGAGCTT
GCCTTCTTTTTCCTACAAGATCGAGTCCGACCAGGATCGAGTTCCTACAGAATCGAGGGGATCAGGTGTC
CGATCGTGACGGGGGAGCGCGCACGGCGGTCAAACTGACCGACATCGCAGCTCGGGTGCC
>paratb_14929
AACCGTCTAGCGGCGTGTTGTAGTCAGACCCTGTGGGTCGACAGAAAAGAGATCGCCCCGCCGTTGTTGA
GCGTGGCAGCGGTCGGCGGCTGAGGCAAGGCCTTGGTGTGAGGGCGTGTTAGGCGATGGCCCAGGTGGTG
TCGGTGCGGGTCAGGCCCATGGTGAGCAGCCGACGTAGGTTCAGTGCTGCGGCGCGGTGG
>paratb_14930
TGCAGCCAATGGTTGTTTTTGGCGGTTCCTCGGTAGCGGACCTTGCGGTTGCCGCGAGTGAGCCAGGCCA
TTGAGCGTTCCACCATGGGCCGGTGTTGGCGGTATTCGGCTTGCCAATCGGGGTCGCGGGCCGCGACGCG
AGCAGCGCGCAATAATTGCTCGTGGATATGAAGGGTGAGTTTGCGTCCGCGCGTGGCGGT
>paratb_14931
CGTGCACCGGGACGCCAACGGGCATGAGCGACAGTATCTTTCGAAGGTGACTCCGCCACTGGGACGGATC
GGCATTCCGTGTCCAGCCGGGCAGGTCACGATGCGGGCGTCGAAATCGATGAGGAAATCGTCGCTGGTGA
AGCCACCCGGAACCGGCGAGCGTAGCGGTAGCGGTTTGATCACCGCGACATGGCCGGCGT
>paratb_14934
AGCCCAGCACCCGGTGAGCATCACCGACCAAACCATCCACCAGCCGATCCCGAGCGGCCTTATCCTCCCA
CGCAATCGCGGGTTTCCCCGGATCGTCGTAATCATGGGCGCTGCAGTGGGCTTCGATCACCGCTGCAGCG
CCAGGGACTTCGCGGCGCACTCGTCGGATCGCGGCGATCAACTGCGTCACGGTGTCCTGC
>paratb_14935
GTGGCCACCGCATCGTCGAGCACCGTGGAATCCAAGGCCCGCCGTGTCTTGCCCGCCAACACCCCGGTCT
CGGCCACCACCGTCTTGACCGCCTCGAAGATCCGGTTGGGCCGATCCGAAGCCGCCAACCGACGCCGCCA
ATACGTCAACGTCGTCGAATGAAACGCGCCCGCCGTGATCGGCAACCCGCACGCTGCTTT
>paratb_14936
CCAGCGCAGATCGAAAGTCACCGCATCCACGGTCTCGTTATCCGAAAAACCGTGCAGGGCCTGCAAGGTG
ATCACCGAGGCCATCACCTCAGCCGGCACGCTGGGCCGGCCCCGCTGCGACGGGAACAAGTCCGCGAACA
TCTCCTCGGGAAACAACTGGCTGCGGTGCGCCGCCAGGAACGCAAACATGCTGTCGGCCT
>Contig16_14979
CGGCGGTGAGGTCGGCTGAACGCATGTTCAGCACGCTAAACGTATGTTCAGCCCGCGGTCAAGGGGGCG
CGCGTCAAGAATCGGTAAAAATGCGGCCGGCCCGGCAGAGGCCCGCCAAGGCCCGGCAGAGGCCCGGCAA
AGGCCCCGAAAGGCCCCGCCGACGGCCCGGCAAGGGCGCGACGGGCCCGAGGTGCCGTGT
>Contig16_15007
CTGCGGGCCGGCTAGACCGGGCCCGGCTTCTTCGGCGCGTTCGGCGCGGGCCGGCCGCCGCGGGCGACG
GCGCTTGCGGTGCGGGTCCGGCCGGGGGCGACGGCGCGGCTTGCGGTGCCACTCCGGCCGGGGGCGCGGG
GACCGGCCCGGCATCCGGGGGCGGCGGCCCGAACGGTGGCGGCCCGGACGGCGGCGGCGC
>Contig16_15025
```

Figure 6-73

```
GCCCGCCGAGCAGCGGCGGCTGGGGCGGGTAGCCACCGTAATCCGGACCGGGGTAGTAGCCACCCGGGTA
TCCGGGCGGTCCGTAGCCCGGCGGGGGCGGCGGCCCGTACCCGGGCGGGGCGGCGGAACAGGGGACGGA
GCCGGCGGCGGGTACGGGGGCGGATAGCCGGGTGGGTAGTCGGCCGGATAGCCCGGCGGT
>paratb_15056
TGTGCCGGCCAGGCGAAGTCGGCACGCCACCGTCGGCCGTGCCGGTCGGTGATGCTGTACTGCAGCTCCG
GCATCGGCAGCCCACTGCCGATGAACAGCAGTCGTGCCTCACTCTCCATGGGCGATTCGGCGCGGCCGTC
GGCGTAGGCCAGCAATTCCCGGACCTTGACGATTCCGCGACGACCATGCTGCTCGCGAGC
>paratb_15057
CGCCGCGTCCAGCTCCGCTGCGGTGCATGCGCCGACACGCAGTGCCGCATCAAGCGTGGCCAGGGCACGC
GCGGGCCGCAGCGCGCGGGCTACTTCTATCGCGGTCCACGCCGGCATCGTCGCCAGATGGCCCTTCACTC
GTCGCAGCGGCGCCCCAATCCGTTGGTGCACCATGATTTTCGGTGACGGGCGCATCCGGA
>paratb_15058
TTCCCGGATCGAGGACATGGATTCTGGTGGTGCGCTCGGTGTCGAAGCCGTACAGCGCGGCAGCGGTGCC
CATGCACGCGACCACCGGCCGTCCGACCCTCAGTTGCGCGGCGTCCAGCGCATCGGACACGTCGGGAACG
TTGGGTGCGTATACCCCGTGACAGACGCGGATGAGCATGCCGGACTTGACCAGACCGGCC
>paratb_15059
AATTGTTTGCGCGAGACCGCGGTCAGCAGTTGGGAAGTGGTTGCCAGCCCGTCGCCGCGCAGGATGAGGC
TCTCGATGTCCACAGCCGCAGACAATGCGGCAAGGCAAGTGTCGGAACCAGCCAGCTGCCGCGGCGATGT
GGATAAGTCCCCCACCCCCTCCCTCGAGCAGACGCAAAAGCCCCGACACGCCGGGCGTC
>Contig16_15109
TCGCCCCGTTGCCCGGGGCCGCGGCGGGCTGGGGCGCGGGCCGGGCCGGCTGGGCGGTCTGAGCCGGCGG
GGCCGTTTGGGCGGGCAGGGCGGGCTGGGCGGTTTGCGGGGCAGCCGGCGCCGGGGCGGACGGGCCGTCG
GTGCTGGCCGGGGCGGCCAGCACCGAGTCGCCGGTGGGCTCGGGGTTGTAGTCGACGAGG
>paratb_15132
GCCGCGGTGTGCGTCTTGCCGGTGCCGGGCGGCCCGTGCACCGCCAGGTACGACGAGTCCAAATCCGTTA
GCGCGGAGGCGATGTCGGCGACGGTGTCGGCGCTGCGGGGCAGCGCGGCGCCGCTGCGGGTGCGGGGCGC
GCGACGCAGCAGCACGTCGACGACGGCGCTGTCGGGCAGCCGCGGCAGGCCGGCGGCCAC
>paratb_15258
GCATCCCGAGGGCGGCCCGAATACCCCGGGGGGGCCGACGGGCGGCGTCATGCGGGGAGGGTGACGAGG
TGGCCGCCGTTGCCACCTCGGGCGGCGCCGCCGGGGCGGCGCCGTTGCCCCCGGCGGCGACGGCGGCAAC
GGCGGTCGGTGCGGCCGAGCCGGGCGGCGGCGGGAACGCGTACGGCAGCGGCAGGTCCGG
>Contig16_15305
GTGACGCCCGGCGGCCCGATTCGTTGCGAATCCGAAGGGCCCGCGCGCGACCGGCTAGGAGCCTGCTGAA
TTAGGGGATTTTTTGGGGCGGGGCGTCTCGAACCGTCTAGCGGCGTGTTGTAGTCAGACCCTGTGGGTCG
ACAGAAAAGAGATCGCCCCGCCGTTGTTGAGCGTGGCAGCGGTCGGCGGCTGAGGCAAGG
>paratb_15306
CCTTGGTGTGAGGGCGTGTTAGGCGATGGCCCAGGTGGTGTCGGTGCGGGTCAGGCCCATGGTGAGCAGC
CGACGTAGGTTCAGTGCTGCGGCGCGGTGGTGCAGCCAATGGTTGTTTTTGGCGGTTCCTCGGTAGCGGA
CCTTGCGGTTGCCGCGAGTGAGCCAGGCCATTGAGCGTTCCACCATGGGCCGGTGTTGGC
>paratb_15307
GGTATTCGGCTTGCCAATCGGGGTCGCGGGCCGCGACGCGAGCAGCGCGCAATAATTGCTCGTGGATATG
AAGGGTGAGTTTGCGTCCGCGCGTGGCGGTCGTGCACCGGGACGCCAACGGGCATGAGCGACAGTATCTT
TCGAAGGTGACTCCGCCACTGGGACGGATCGGCATTCCGTGTCCAGCCGGGCAGGTCACG
>paratb_15308
ATGCGGGCGTCGAAATCGATGAGGAAATCGTCGCTGGTGAAGCCACCCGGAACCGGCGGGCGTAGCGGTA
GCGGTTTGATCACCGCGACATGGCCGGCGTCGGCCAGTGCCGCCCGGGCGGCCCCGGTGCCATACGCCGA
ATCGCCCAGGACCCGCACCGGGGTGTGTTCACCCTCGAGCAGGCTCAGCCCGACGACGG
>paratb_15309
```

Figure 6-74

```
CCTCGTGGTTGTCCGCGCCGCTGGCCTTGGTCAACGCGCAATCGGTGATGATTCCGGTGTCGGGCTCGAC
GGCAAGGTGGGCTTTGAAGCCGTCCTGGCGGCGGTGCACCGTCTTGTGAGCGTGCCGCGTGTCGGCATCG
ACGGTGGAGATCACGCGATCCCCACTGACCTGCTGCGCGATGCGCCAGTGCCCGTCGGTG
>paratb_15311
ATCATGGGCGCTGCAGTGGGCTTCGATCACCGCTGCAGCGCCAGGGACTTCGCGGCGCACTCGTCGGATC
GCGGCGATCAACTGCGTCACGGTGTCCTGCGTGGCCACCGCATCGTCGAGCACCGTGGAATCCAAGGCCC
GCCGTGTCTTGCCCGCCAACACCCCGGTCTCGGCCACCACCGTCTTGACCGCCTCGAAGA
>paratb_15312
TCCGGTTGGGCCGATCCGAAGCCGCCAACCGACGCCGCCAATACGTCAACGTCGTCGAATGAAACGCGCC
CGCCGTGATCGGCAACCCGCACGCTGCTTTCCAGCGCAGATCGAAAGTCACCGCATCCACGGTCTCGTTA
TCCGAAAAACCGTGCAGGGCCTGCAAGGTGATCACCGAGGCCATCACCTCAGCCGGCACG
>paratb_15313
CTGGGCCGGCCCCGCTGCGACGGGAACAAGTCCGCGAACATCTCCTCGGGAAACAACTGGCTGCGGTGCG
CCGCCAGGAACGCAAACATGCTGTCGGCCTTCAGAAGATGCCCGGCAACCGACTCCGCATCCAACAACTC
ACGCTGATCATCAGAGCGACCCTGCACCCAACAATCATCCCCAAAACCCCAGGACAACTC
>paratb_15343
TGCGGGTGTTGCGCAGCGTCTCCCGGGTGCGCGTCGCGGTGGAGCACAGCACGGCATCGATGGCGGGCGC
GCCGGCGCGCAGCCAGTCGCCGGCCAGGCCGGCCTGCCGGATGCCGCGCGGCGCCAGCGGCCGATCATGG
TCGGCGACGCCGTCGGGGTAGTCCGACTTCGCGTGCCGCATCAACAGCAGGGTGCGTCGG
>Contig16_15408
CGTGTTCGACGTCGCCACGGGCAAGCTCGACGAGGTCAAGCCCTAGACCCGTGTAGTCAGCGCGAAAAAA
CGGCCCGAACGTCACCGTGGGTGCACGCTCGGCCGACAACTTGAGCGCCGGCCGACACAACTCGAGCGCC
GGCCGGCTCACCCCACCTTGTAGGTGGCCAGCGCCTTGGCCACCAGCGTGCCCTGCGGGT >Contig16_15461
CTGGAATTGCTGCCCCGCGGACGGGGCGGGTGGTGCCAGGGCCGTCAGCGATTCCACCTCGGCAGGACTG
GCGGTGCGCGGTGCGCCGGCCGGCGGGGGGTTCGCGGCGGCGCTGGAGGCGGTGGCGTTGGGGGTGGGCG
CCGCCGCCGGCGGCGCGGGGCAGCAGCGCGGCTTGGTGCCCTGGGCGTGGATCATGGCGG >Contig16_15682
GTTGCCGATGCGCATGCCAAACTTGACGACGTGACACGTCCGCGACCTTCTATCGGCCCCGCCCTGGCCG
GGGCCGTCGATCTTTCCGGTCTCAAGCAGCGGGCCCAGGCGGCGAGCGGCCCGGCCGGCGGGCCCGCGCC
GGCCGACGGTGGCCCCGGCATCAGCGCGGTCACCGAGGCCAACTTCGAGGCCGAGGTGCT
>paratb_15685
TATCAGGCGATCCTGGATGCCAACCCGGCCAGCACGGAGGCCAAGGGCGCCATCCGCCAGATCGACTTTC
TCACCCGCGCCACCGCGCAGCGCCCGGACGCCGTCGCCGTCGCCGATGCCGCGCCGGGCGACATCGACGC
CGCCTTCGCGGCCGCCGACGTGCAGATCCTCAACCAGGACGTCGGCGCCGCGTTCGACCG
>paratb_15783
TGGCGGGACGAGTTGTCCTGGGGTTTTGGGGATGATTGTTGGGTGCAGGGTCGCTCTGATGATCAGCGTG
AGTTGTTGGATGCGGAGTCGGTTGCCGGGCATCTTCTGAAGGCCGACAGCATGTTTGCGTTCCTGGCGGC
GCACCGCAGCCAGTTGTTTCCCGAGGAGATGTTCGCGGACTTGTTCCCGTCGCAGCGGGG
>paratb_15784
CCGGCCCAGCGTGCCGGCTGAGGTGATGGCCTCGGTGATCACCTTGCAGGCCCTGCACGGTTTTTCGGAT
AACGAGACCGTGGATGCGGTGACTTTCGATCTGCGCTGGAAAGCAGCGTGCGGGTTGCCGATCACGGCGG
GCGCGTTTCATTCGACGACGTTGACGTATTGGCGGCGTCGGTTGGCGGCTTCGGATCGGC
>paratb_15785
CCAACCGGATCTTCGAGGCGGTCAAGACGGTGGTGGCCGAGACCGGGGTGTTGGCGGGCAAGACACGGCG
GGCCTTGGATTCCACGGTGCTCGACGATGCGGTGGCCACGCAGGACACCGTGACGCAGTTGATCGCCGCG
ATCCGACGAGTGCGCCGCGAAGTCCCTGGCGCTGCAGCGGTGATCGAAGCCCACTGCAGC
```

Figure 6-75

```
>paratb_15787
CTCTGATGGCACCGACGGGCACTGGCGCATCGCGCAGCAGGTCAGTGGGGATCGCGTGATCTCCACCGTC
GATGCCGACACGCGGCACGCTCACAAGACGGTGCACCGCCGCCAGGACGGCTTCAAAGCCCACCTTGCCG
TCGAGCCCGACACCGGAATCATCACCGATTGCGCGTTGACCAAGGCCAGCGGCGCGGACA
>paratb_15788
ACCACGAGGCCGTCGTCGGGCTGAGCCTGCTCGAGGGTGAACACACCCCCCGGTGCGGGTCCTGGGGCGA
TTCGGCGTATGGCACCGGGGCCGCCCGGGCGGCACTGGCCGACGCCGGCCATGTCGCGGTGATCAAACCG
CTACCGCTACGCTCGCCGGTTCCGGGTGGCTTCACCAGCGACGATTTCCTCATCGATTTC
>paratb_15789
GACGCCCGCATCGTGACCTGCCCGGCTGGACACGGAATGCCGATCCGTCCCAGTGGCGGAGTCACCTTCG
AAAGATACTGTCGCTCATGCCCGTTGGCGTCCCGGTGCACGACCGCCACGCGCGGACGCAAACTCACCCT
TCATATCCACGAGCAATTATTGCGCGCTGCTCGCGTCGCGGCCCGCGACCCCGATTGGCA
>paratb_15790
AGCCGAATACCGCCAACACCGGCCCATGGTGGAACGCTCAATGGCCTGGCTCACTCGCGGCAACCGCAAG
GTCCGCTACCGAGGAACCGCCAAAAACAACCATTGGCTGCACCACCGCGCCGCAGCACTGAACCTACGTC
GGCTGCTCACCATGGGCCTGACCCGCACCGACACCACCTGGGCCATCGCCTAACACGCCC
>Contig16_15791
TCACACCAAGGCCTTGCCTCAGCCGCCGACCGCTGCCACGCTCAACAACGGCGGGGCGATCTCTTTTCTG
TCGACCCACAGGGTCTGACTACAACACGCCGCTAGACGGTTCGAGACGCCCCGCCCCAAAAAATCCCCTA
ATTCAGCAGGCTCCTAGTTCCCTCGACACGGTGCCGGCGCGAGTTCGCCACCGAAATCCT
>Contig16_15959
GCAACATGATCGCGCAGTACATGCTCGGCCTGGGCAAGCCGGCCTACGCGCCGGTGGCCCAGCGCGCCAG
CTGACGGCGCGCGCCGGCGGGCCTCCTGCGCGCCTCCTGCCGCGCCTCCTGCGCGCCGAACGTGCACTGG
CCGCGAAATTCCGCGCACTTTTTCGCGCTGGGTGCACGCTCGGCGACGGTCAGGTGGTCA
>Contig16_16477
GCCAAGAGCCCCGCGAAACGCCCCGCCAAGAAATCGGCGGCGAAGAAGACCGCGGCCACCTCGGCGGCCA
AGACGCGCGCGAAAAAGACTGTGGTCGAACCGAAGTCGCGCACCACCCCGGCCGCACCGAACCCGGAAGT
CGCCGCGTCGCACAACGGGGAAGTGAGCCCCTCCCGCGCGGCCGACCCGATCGGCGCCGA
>paratb_16614
ACGTGCTCCCGCCGAGATCCACCGCGCGGCCAGCGGCGCCGAAAAACGCGACGGCCCGGTCCAGTTGTGC
CGCAAGGCATTCCAGTGCTCTCCGCTGTTCGGGTAGACGATCACCGGCTTGCCGATCGCCGCGGCGATCT
CGATCGTGGGCAACACGTCGTCCGGCGCGCAGCAATTGACGCCGACAGCGACAATCTCGG
>paratb_16697
GGCGACGACGACTCCGACGGCCAGGACGCCGAGGACGCCGACGACTCCGACACCGGTGACGACGGCTCGG
CCGACGGCGGCAATCGCCGCCGCCGCCGGCGCCGGCGCCGCAAATCCGGGTCCGGCGACGACAACGAGGA
CGGACCCTCGCCCGACGATCCGCCCAACACCGTCGTGCACGAGCGGCCTCCCCGCAACGG
>Contig16_16838
CGACCTGGACCCCAACCTACGCGTCGTCGACTCCAAGTCGGCCGCGATGGGCACCGGCTTCGTCGCGTTG
GCCGCCGCGCGGCGGCGGCCGCCGGCGCGCAGCTGGACGCCGTCGCCGACGCCGCCCGCGCCGCCGTGT
CCCGCGGGCACGGCTTCATCGTGGTGCACCGGCTGGACAACCTGCGCCGCAGCGGGCGCA
>paratb_17028
AACCACCCAGGTCCACACGATCTCGCCGGGATCGGCCCGGCCGTCCAGTTTGGGCGCGTACACCAGCTTG
CGGGCCCGCTGCGCGGTGGGCAGGCTGCTGCGGGTCACCGGCCGGCCCAACACGGCGGTGTCCGGCGGCG
GGGGTGCGGCGGCGGCGATGACGTTCGCGGTGATCTTCACGGCCTGCTGCAGCTCGCGCA
>paratb_17153
TGCTTGCAGCAGCCCTCCTCCTCGTCGGGATGGGTTAATTCACGGAGGCCCGGCAACCGAACTGCCCGCA
GAGATGCGGCCGTTCGTTCGTCTGTGCTTTCGGCGCTGAGCGCTTGGCGCTGAAAGGGTCGCGCCAACCG
CGTTGACGACATAAGCTTGCCGGGTCACTCGGAAGGCCAGCCGCTTCGGTTACCAAAGCC
>paratb_17154
```

Figure 6-76

```
CGTGTGACTTCGGATTATTGGCAGGTCGGCCGCCGTGGCGAATCCGGCGGGAGCGGCGCACACCGCGGGT
ACCGCGTTCAACACCTGCATGGCGGTGGCCACGCTGGCCGAACGCACATGTTCTGCCATCGAGGCCGCGC
GGGTGAAGCTTGCCAGGGCGAAGAAATGCGCGCGCATCGACGGGTCGCCCTCGATGGTCA
>paratb_17155
AGGTCCAGCCGTGCTGCGGTTGCGGCCAATGCTTCGGATATTCACCGCCCACCGTCCATAGCGTCTCGAT
TTCGACGAGCACCTCGCCGTCGCGTCCGCCTGACCAGTTCCAGCGTTGTCCCGCAGTGGTTCCCGCCTTG
AGCAGGTGGTCGAAGATCTGATGGTCGGCTTCGGCGGGAACGGCCTCGACCGATGCGGTG
>Contig16_17156
ACCTCGTCGATATCCGCGTTGAGTGAGTCGGCGATCAACCACACTTGTTCGGTGAAGATGGCGCTGTTGA
ATGCCAGGAACTGGTTGGTGTGCGGGCTGATGTCGGCGACGGGTTGCCCGAAACGCCATGTTGTCGAACG
TGATCGACGTGCTCTCGTACGCCGACCAATCGGCGCGTTCCTGCAGGGTGATCTTGTCGA
>Contig16_17157
TAGTGGGACTCATCCCCGAAAGCGCGAGCGGCAGTGCGCTCGAGAGGTTGCCGGGATTGAGGCCCCCGCC
GTGCACGGTGGTGCCGCCGGTGCGGCAGGCATTGAGGACGCGAGCGCGATCGGCCGTGTTGATGCGCGCC
GGATGAAATTGGAAAGCCGTTGTGGCAACGTTCTTTCCGCTCGACAGAAGGCTGCAGACG
>paratb_17158
TCGTCGATGCTCTGGCTGCGGGGGGTGTACAGCACGCAGTCTGCCTCCAGCTCAAGCACCGCATTGACGT
CGGTGGTGGCGGCAACCCCGATGGGAGCACGCCCGGCCAATATCCCGACGTCTTGGCCGGCTTTGGAATC
GGAGTAGACGCGCGCACCGACGATCCGTAGGTCGTCGCGGTGATCGATGATGGTGGTAAG
>paratb_17159
CATTTCGGCTCCCACGGTGCCGATACCCCAGGCGATGACGTTCAGCGGTCTGCGGTCAGACATCGGACAG
AAGCCGACGCGTGGGCAGCACCGTCAACGGGACGCCGCGATCTTCGAACTGCCAGTTCGGCCCATGAGAG
ATGTAGGTCATTTCGACTTCCTCCCGGCGCTTCGCTTCGGTGTCCGACCACCGGATGTCG
>paratb_17160
ACGACCAGGTCGCTGGCCTCGTAGGTCGCGTGCAGATCCGACCAGTGCGGATCGACACCGGTGGCCATGA
CCTCGAGGGGACTGACATCGTGCGTCGACAGCGTCGCCATCCAACTGCGGTCGCGGACGGCGGGGGAGTT
GCTTGGGATGCGCACCCGCACCGCGTCGCGCGCTCCTGTCCCGAGGCGCTCCACGGATGC
>paratb_17161
TCCGGTGTAGGCGAACGGGCGCAGGGCGGGATGCAAATCGAGGACCGAAGCAAGGTCATCTGCGCCGACG
CCAAACCCGAGGCTGCTTTGATGCGCGCCGAACCGACGTAGGCGGTGCCGGTGAACTGCCTGCGCAGCAG
ACCGAGCGCCTTGGCCTCGCCGCCGTGCCGGCGCACCGAGCGCTCGAACGCGAGCGCCAG
>paratb_17162
CAGATGATGCTGAATGGCGACTTCCTCGGCCAACCGGACGAGCGCCGAGCGTGACCACTGATCAAATCGA
ATGTCCGAGAACAACGGACCGGTGTAGTCGCCGAGGCCGTCGTCCGAGAGGTCGATCGGGTCGAACTGCA
GGGCCGTCAGCTCGCAGCGCGAGACCTCGACCGCCTCGGCGGGGATGGGCAGGTCCTCCC
>paratb_17163
GGCTGTCTTCGATGGTGACCGACCAGTGGCAGTGGGGGGTACGGTCGGCCGGCTTGCGCGGGGGCCGGTG
GATGGGTCGGAACCGCGCCTTGGGGTTGGTCGCGATGGCCGTCGCATCAAAGGTGAAATCCTGGATGGTG
TGGCACATCGCGCGGACCCAGACGTCGCCCATCGGCTCGACGTCGATCAAGGCGCCGCAG
>Contig16_17164
TAGTCGTTGCGGGAACTCCCCGTGGTTGGGATCGATCAGCGAGTAGCGGAAGTCGAGGAACTGCGGCGGCG
CTCCGACGTCGAACTGCAGCACCTTGAAGATGTCCTCGACGGTGTCACCGGTGACACCGAGCGCGTGGCG
CAGGCGTCGGGTGTAGTTGGGACTGGCTCCCATCCACTCCTCGATGGCGACCTGGGTCTG
>Contig16_17165
AACCTCTGGATCGACATTTGTGCGGTGCTCGCAACAAGCCGCCGCGATCAGGCTGACGGGATTGCCCGAC
GGCGGCACCGATGCGCGCGAATCGATTGGAACCGTGTCAATTTGATCAACGGTGTCTCCCGCCGGTGAAG
CGACTACGAACTCGCTGTCCGCGACACCAGGGCGGCGGCGACCTGGGCCACAGGGGTGTT
>paratb_17166
```

Figure 6-77

```
TGACGCTTCCGGATGAACGACTCCGCCACCTGCGACGCAGGACCAACCGACGCGTCGGACCGTGCCAAAT
TCGCCGGCAGCCGAGAAGTCCCATCCGCGATCGGGGGTTGCGGCAAAGAAGACCCCGATGAAACCGGACA
TCGCTAGCGCCGGCTCCTGTCTAGGTCGACGGTTCCCGTGCACTCGTTGAGGCCATGATT
>paratb_17167
GCGTCTACCTCTCAAAGCCGACTTCGGGCCTGCCTGCGCGGTGTTGACTTTCCGGCGAGCACGAACGAAC
TGATTGAAGCCGCCAAGCGAAAGGCGACGATAACGACACGGTTCAGGTGTTGCAGAGACTGGCACCAGTG
ACCTACACGAATCTCGCACAGGTTGCTGCGTCGGTGACCATCGTGGATGAAGAGGGCCTC
>paratb_17168
GGCGGGAGTCCTGTTTCGGTATAGCTGGCACCTCAACCCAAGCCCCGGCCAACAGCGCAAAAGGTTGGTG
TATAGCTAAAAGCCGCAGACGAACGTGCCGCCTGTTAGGTGATCCAATTTCAATCCGAACTGAGTAACAT
GCCCTGCCAGGTTTTCGGTGCATTCGCCCGCACCAAATCCGACTGCCGATAAAGCTGGCC
>paratb_17169
GTTGGGCGCAACGTATCGCCCAGTACGGGGGTCGTAGTGCAGCACCGCAACTGAAGGCGAGACACCAGAA
CTGTTGGAGTCGAACGCGCTTGGTGCCGCTGGCGCGGCAGCCACATCCGGCGCTGTCGGCGGCTGGTTGA
GCGAACCCGGCGCTGGCGGGCCTGGCGGTGTTCCAGCGGGCGCCGCCCCGGGCGGCAACG
>Contig16_17170
GCGTCCCCTCGACCGGACCGAAAGTCCTGTCCTCGATACCAGCCCGGTCATCCGGTGGCAGACCCTGCGA
TAGAAGGTTCGGGTCGAGCGGATACGGCCCCAGCGCGTGCTGCCTCTCCGCTAGCGGCACATACGGTTTA
TCGCTATTGCAGATTTCGACTGTGGGCGCACGCTTTCCGGGTTTGCCCATGCAGGGGTAG
>Contig16_17171
GTCCGCGCCCCCGCACGCTGATCGGCGAGTCCTGCGGAAGTTTGCAGTACAGATTGTCGGGGGTGTCGG
CCTCACTGGTGTCGGCGGGTGAGCGCCACTGCGACGGTGGCAGGAACCCGACCGTGCACGCCGGCGGGTC
GGCGATGGTCAGCGTGAAGCGGCCGACCGCCAAACCGGTCGGGTTGTTGGTGACGCCGTA
>Contig16_17172
AGACCCGTAGGCCGCGACGGACGGGGGGAGCAGCACCAGCAGCTGTTCCAGCGCCGGGTGATATGTCACC
CCGATCTGGCCGATGGTGGACAGGTTCGCCAAGAAGACCGGCAGGGTCGGCTTCAGCTGGTCCAGCAGTC
GCGAAACCTCTTGCTCGAAGCCAGGTCCGGTGTGCAGTAGCTTGCGGAACTGCGCATCGT
>paratb_17173
CGGTCACCATCTGGTCGGTGAAGCCGGCCAGGTTGTGCGCCCACCGTCGCGTCTTGTCGGCGGTCTGCGC
CTGCGCATCCAGGAACGGCGCGCCGTCGTCGACCAGCGCACGGGTGTGGTCGACAACGCCGGACGCGTCG
CGCGAGAGCTTGCCCGACGAATCGAGCAGCCACTCCAGGTCATAGCCCGCGCCGTTGAAC
>Contig16_17174
GCGGAGAACGACTCGTTGAGCAGCTGCCCCAGTTTGTCTTTGGGGATGCTCTTGACCAACGCGCTGAGCC
TGTCCAGCATCGGCCCCACCGGCCGCGGGATGCTGGTGTCCCGCGCGGTGATCACCGACCCGTCGCACAG
ATAGGGTCCGGATTCCGAGCGCGGCACCAGGTCCACGTATTGCTCGCCCACCGCTGACAT
>Contig16_17175
GCTGCGCACCGCCGCGTGCACATCGGCCGGGATCTTCGGCGAGGTGTCAAGCTGCAGCGTGGCTTTCGCG
CCGGTCGCGGTCGGGGCGACCGCGGTCACCTTGCCGATCTGGACGCCGCGATAGGTGACGTTGCTGAAGC
GGTACAGCCCTCCGGTATCCGGCAGCTCCAAGGTGACCGTGAGCTTGCCGATCCCGAGCA
>Contig16_17176
GCGTCGGCACCTGCATGTACTGGAAGAACATGAACGCCATCGCGACCACCGACGCGAGCGCGAAGATGGT
CAGCTGAATCCGCACGAACCGCGTCAGCATCAGCCACCGCCTCGCGACGGTTGATCCACGGGCGCAATGA
CACTCATATCGGGAGCCATGACAGGCGGCGCCGAAGCGGGCGCGCCGGGAGAAGGCGGCG
>Contig16_17177
GCGCCAAAGGCGGATTGGTGACGCCGAAACCGAGCGGGTCGTAGGTGTAGTTCGAAAACCAGGGATCACC
CGGCGCGGGCACCAGCGGCGCGTCCGGATCTCCCCACCGGGTACCGGCGAGCAGCGTCCTCTTCAGCCGG
GGAATGGTCATGTCGATGACGGCGAAGACGTTGAAGTAGTCACCCCGCACCGCCCGGTCA
>Contig16_17179
```

Figure 6-78

```
TTCGCGGATCAGCACGTCGAGCGCGGGCGGAATCTTGCGCAGCGCTTGGGTGATCACCTCGCGCTGGGAG
GCGAATGTGCCGGCGAGCCGGTTCAGTGAGTCGATCGACGCAATGATCCTGTCGCGCTGTTGGTCCAGGA
CGCCGACGAATTCGTCGAGGCGCGTCAGCAGTTGGCGCACATCGGTCTCGTGGCCGGACA
>Contig16_17181
CCACCACATCGGGTTTCACCGAGACCTCGACGTCGGCGTGATCGTGCTTGACCCGCATCTTGCCGACGCT
GCCCACGATGACGTCGGCCATCATCACCGGCGAATTCGATTCCAGGGTGCCGATATTGGCGATCTCGATG
TGATAGATGCTGGCGTGTGGCCCGCGACCGACAGCACCGGGCAGGGGCAACGAGTTCACG
>paratb_17182
CCCTGAAAGGAACAGCCACCAACGGCGAAGGCGCACGCTACGATACAAAGCCGGACCCTCGTCATGGCGG
CGTCCCCGGGCCCGGCGGCGGCTGATCGCCCGGCGCCGGCTGGCGATCGTCGGGCAGCAGCAGGTCC
TGCACGCTGTGCGGTGTCGAGTCACCGTTGATGCCGGTGTAGGCGGATACCGCCGGCGGG
>paratb_17183
ACGTCGGGGGCGTGGGCGATGGCCCTTCGGCGCCGGGCGCCAGGCGCGGTTCGGCGTAGATGATTTTTC
CGGGAGTGGCGATCTGCTGCAGGATGATGTTCGTCGGGATGGGCAGGTAGTTGAGGTTCGCGGTGCGCAG
ACCGGGGCCGGCGTATTCCGCGCACAGCTTCCCGGTTTCGGCCGCGGTGACGTTCGCGAC
>paratb_17184
GGCGCCGATGGCGTCGCAGAAGAAGTGCACCGGGTTGGAGAGGTTGTTGATGATGAAGCTGCCCATGGCT
CCGGGGGTGTTGGGGTTATAGATGTTGTAGCCGTTGGAGAATGCGGTGGGCGCGGCGTGCAGGATGTTCT
CCACATCCATCCGGTGGTCGACCAGAACCTGCGTGACGGTGGTCAGCCGCTGAATCTGTT
>paratb_17185
CGGCGGTCTTGTCCCGGGTTCCGGCGACGAAGCGTTGCACCTCACCGACGGCCACCGACAGGTTCGACAG
CGCCGCATCTAGATCGGATCGGCTGTCGTCGAGCACGCTGCTCAGTGTCGTCAACCGGTTCTGGAACTGG
ACGATCTGTTGATTGCTGTCGCGCAGGGTGGTGACGAACTTCTGCAGGTTCTTGATGATG
>Contig16_17187
TTCGACGGGTATCGCCGTTCGGTCGGTATCGATCACGGCCCCGTCCAGCATCTTGGGACCGCCGCCCCGG
TGATAGGCGGGGGTGAGCTGGACGTAGCGGGCGGACACCAGGTTTTGTGCGACGATGATCGCCTTGGCGT
CGGCCGGGATCGACACGTGGCGGTCGACGTGCAGAATCAGCCTGGCCCGGCTGGGCTGCG
>paratb_17188
GCTGTACGGAGGCGACGGTGCCGACTTTGACGCCGGAGACGCGGATTTCGTCGCCGGCGTAGATCCCGGT
TGCCGACGGGAAGTAGGCGGTGATGGTCAGTGGACGGAAGAACGTCTGGCGCACCAGGAATCCGCTCGCA
CCCACGAGCAGACCGACCAACAGCGCGGTCACCAGCAGCCGCCTGCGCACGGTCATCGCG
>paratb_17191
CAGCGAGTTGACCCCTTGGCTGTGCTCCGAGAGGATGCCCGTGACATCGGTGGCGCTCTTGAGCAGCGCG
TCCAGGCTTTCGCCGCGGCTGTTGATCGCCCGCGACAAGCGGGTCACTCCGTCGAACGTCGGGCCCAGCT
GCGGGGCGATCTGATCGATCGTCGCCGACAGGGCGTCCAGCGATTGATTGAGGGTGTCGG
>Contig16_17192
TGCTGGTGGTCGAGAGGTTCGTGGTCATGTCGGACACGGCCTCCGTCAACGAATACGGTGACGACGTCCG
GGACAGCGGGATGACCTCCGACGGACGCAACAGGCCGGCGCCGGCCGACTCCAGGGTCAGCACCCGAGCC
CCCAGCAGCGAACCGGTGCGAATGTGCGCGGTGCTCAGCGACCCGAGCCGCACCTTGCCG
>paratb_17193
TTGACCCCGAAATCGACCAGGGCGTTGCCGTCGTCGTCCAGCGAAACCCTAGAAACCGTACCGACATTGA
CACCGGAGACCAAAACCTTGTTGCCGGGTAACAGCCCGCCGGCCTCGGAGAACAACGCCTCATAGCGAAT
CGTCGTCGCCCAGGTCACCAGCCGGTCCGGTGCCAACCCGACGGCGACGACGAGCAGGAT
>paratb_17194
CAGCACCGTCCCGATGAAGCCCGGTCGAATGAGGTTTGCGCCACGGTATTTCAGCATCAGGGCTCCGCGC
ACCTTCCCTCGGTTTGCTTTAGCCAGGGGTAGACCGCCGTGCGGCCCTGCAGATCGGTGACGCGGAACGT
CAGCCCACAGATGTAGTAGTTGACGAAGCTGCCGTAGGCGCCGGTGCGGGCGAGCTTGCG
```

Figure 6-79

```
>paratb_17195
GAAGTTGTTGGGCGCCCGCTGCAGTGCGTCGTCGAGGCGCCCCTTGCCGTGCTCGAGCAGGGGGGCCAGC
CGGTTCAGCTGGTCGACCGTTCCGGACAGCGGTGGGCGCGCGGCGCTGAGCAGGTCGGTCACCGAGGCGG
TGCCGGTGGCCAGGGCCTGGATCGCGTCCCCGATCGGATCGCGGTCGTGCGCGAGGTCGG
>paratb_17196
TGACGAGGCGCTGCAGGCGTTCGATCGCGCCGGAGAACTGGCTCCCTTGGTCCGACAGGGTCCGCACGAC
GGTGTTGAGGTTGTCGATCAGGGTTTCGATGGCCTTGTTCTTGCCGGCGACGTCGTTGGAGAAGGACGAC
GTTTTCGCCAGCAGGGACTGCAGCGTTTGGCCCTGTCCCTGGAACACCTGTAGTAGCGCG
>Contig16_17197
CCGGCCAGAGCGTTGACGTCCTGCGGATTCAGGCCCTGGATAACGGGTTTCAGCCCGCCGAGCAGCAGGT
CAAGATCCAGGGAGGGCATGGTGTGGTCGATCGATATCTGCGACCCCTCCGGCAGCACCCGCATGGAGCC
GGGGCCGATGATGAGTTCGAGGTAGCGATCGCCCACCAGGTTGAGATATCGCACGGCCGC
>Contig16_17198
CCGGGTGCCGGTGGTGAGCGCGACGTCGTCGTCGGCGTCGAAGTCCACGACTACCTTGTTGTCCGGCTGC
AGCGCAATGCCGTTGACCGTGCCGACCCGAATTCCGGCTACCCGCACCGAATCTCCGGTCTTCAGCTGCG
AGGCGTCGATGAAGACCGCTGAGTAACTGTGGGTGGGGCCGTTGCGGAATTGGCCGAAGA
>paratb_17199
TGAAGAAGAGGGAGGTCGTGAGCATCAGCATCACGGCGGCGAAGACGCCGAACTTCACCATGATGCGGCC
GGTGCCGGTCATCCCGGTTGCCCGATCTGTGCGGTATTGCGCGGCGGTCCGTCGAGGGGGCCATAGAGGA
ACTGCTTGAGCCCGTCGGAGTTCAACAGGATGCCCTGCTGTCCGTACTGCCACGGGTTGG
>paratb_17200
CGCCTATGTCGGCGACGTCGAAGGGCGGGAAGGTGTTGTAGGCGAGCGGTAATTCGTGATCACACTGCGG
GCCGCCCCGGGCCGCCACCTTGGGCAGGTTCTTCGGAAACCGGTAGCGCTCGGAGCCTAGCGTGATGCCG
CCCAACACCTCGAGCCCCGGCACCGGCGTGGGCGGCTGCAGCGCCAGCGGGAACATGCCC
>Contig16_17201
TTCAAAGAACACGTCAGCGCCTGGTGGTACTCGTTGGTCAGGTCGGTCGTCGGTGCCAGCAGATGCGTTA
CTTCGGCAAGCTTTTCGCGATTGGTGCCCAGGACGTCGTTGCCGAGGTCGGCCAGGCCGATCGAACTGAT
CAACAGCGCGTCGAGGTTCTGCTGTTCGTCGACCAGGGTCTGGCTGATGCGCGTCGTGCG
>Contig16_17202
GTCCGCGACGGTGATGAGGTCGGGCGCCGCGTCGGCGTAGGCGCTCGACACCTCGGCCGTGGCCTCGATG
TCGTGGCTCAGGTTCGGCAGGCTCGGCTCGATCTTGCCGAGAAAGTTGTTCAGGTCGCTGAACATCTGTC
CCAGCCGTGCACCGCGTCCGTTGAGTGCGGTGGCCATGGCACCGAGCGTCTCGTTGAGTT
>paratb_17203
TGGCCGGGTCGATTTTCGCCAGCACCGACGTGAGTTGTTGGAACACCGAGTTGATTTCGACGGTGACGCG
GCCGGCGTCGAGCACCTGACCGGCGCGCAGGCGCTGCGGCGACGGGCTCTCCGGGGGAATGAGCTGGATG
AACTTCGCGCCGAACGCCGTCGTCGCAACGATGTTGACGAGAACGTTGGCCGGGATGAGC
>Contig16_17204
TGCAGCCTGGACGGATCGAGGGCCAGATGGATGTCCGCCTGCCCGTCGGCTCGGTCCTGGATGGAGGCGA
CGCTGCCGACCGGTGCACCGTGCAGCTTGACCTTGGCGCCCGGGTTCATCATCAAGCCCGCCCGTCCGGC
GACCACCGTGACCGGCACGGTTTGGGTGAAGCCGCCGCGAAACTGCGTGAGCGCGAGGGC
>paratb_17205
GAGGACGGCGGCGGCGGCGATGACGGTCGCCAATCCCGCGAGCGGGCGGGCGTAGCGAAACGTGGGGCGG
CGACTGGCGAGGGGGTGCGAGGGCGCTCGGTGTCCGGCCGGCACGGCCTGGATTCGTCTGGTCACCTAGG
CCCCTTCGCCGCCGCGGGATGTCGGGTCGACGCACCAAACAGCCAGTGCGACAGTCGAAG
>paratb_17206
TGGTGCGCACATGCCGGCTACAGACCCCCGTCACGCTGTCCCGATCCATAGTCATCCAAGCCAACCGGTC
CGCGGTGTGATACAAATCTCACGTTAGTAGCGAGCAGAACGATACATCCGCATTACGAGAACTTCAATAC
TGTTCAACACGAGAGTATCGTTCTACGCTGGCCACGGCTGAAGCCCACCGGAGGAGCAAT
>paratb_17207
```

Figure 6-80

GTGACCGGTATCCGTGTCGTCGCGCCCGAGTTGGCGCGCCGCTACGAGGAGCAGGGCTGGTGGACCCCGG
ACACGCTCGGGGATCTGCTGGCCCGCGGCCTCAAAGACAACCAGCACAACACGTTTCGCGTGCACTCCGC
GGTGCGGCCATTCGCGGGCACGTTCGGCGATGTCGAGCTGCTGGCCCGCAGGCTCGCGGC
>paratb_17208
AGGGCTGCGCGCCCGGGCGTCGGCCCGGGTGACGTGGTCGCCTTCCAGCTACCGAACTGGGTGGAAGCG
GCGGTCACCTTCTGGGCCTCGGCACTCCTTTCCGCGGTGGTCGTGCCGATCGTCCACTTCTACGGGCCGA
AGGAATTGCGCTACATCCTGTCGAGCGTCAGGCCGCGGGTCTTCATCACCGCCGAGGGAT
>paratb_17209
TCGGGCGCATGACCTACGTGCCGGAGGTCTGTGCGGGCGTACCGACCGTCGCGCTGGTGGGCGAGAGCTT
TGACGCGCTGCTCGAGGACGAACCGATGGACGCCACGGTGGCGACCGATCCCGCCAACCCGGCGGTGATC
GCGTTCACGTCGGGCACCACCAGCGACCCCAAGGGCGTGATCCACAGCCATCAGACACTG
>Contig16_17210
GGCTTCGAAACGCGCCAGCTGTTGGCGAATTACCCGCAGGGGCTCGGGCGGCAGCTCACCGCGCTGCCCG
TCGGGCATTTCATCGGCATGCTCGGCGCGTTCCTGATGCTGGTTCTCGACGGCGCGCCGATCGACCTCAC
CGATGTCTGGGACCCGGACAAGGCGATCGACCTGATGGACGCCGACGGCGTGGCACTCGG
>paratb_17211
CGGGGGACCGCCGTACTTCGTCACCAGCCTGCTAGACCACCCCCGCTTCACCCCGGATCACCTGCGCTAC
ATCAAACACATCGGACTGGGTGGATCCACCGTCCCGGCGGCGGTCACCCGGCGCCTGGCCGACCTCGGGA
TCGTCGTCACCCGCTCCTACGGCAGCTCCGAGCATCCGTCGATCACCGGTTCGCAGCACA
>paratb_17212
CCGCACCGGAGGCCAAGCGGCTGTTCACCGACGGCAAGGCGCGCGCGGGCGTCGAGGTGCGGTTGGCCGA
CGACGGCGAAATACTTTCGCGCGGACCGGATCTGTTCGTCGGCTACACCGATCCCGTGTTGACAGCCCGA
GCGTTCGACGAGGACGGCTGGTATCACACCGGCGACATCGGGGTGATGGATGACGACGGC
>paratb_17213
TACCTGACCATCACCGACCGCAAGTCCGACATCATCATCCGCGGCGGCGAGAACATCAGCGCCCTGGAAG
TCGAGGAAGTTCTGCTCGCCATGCCGGCGGTCGCCGAGGCGGTCGTGGTTTCCGCGCCCGATGCGCGGCT
CGGCGAGCACGCCGCGGCCGTGCTGCGTCTTAAGCCCGGGTATGGCATGCCGACCATGGC
>paratb_17214
CGAGGTCCGCGAGCACTTCGAGCGCGCCGGGGTGGCCAAGCAGAAGTGGCCCGAGGAGCTGCACGAAGTG
GCCGACTTTCCCCGCACCGCCAGCGGCAAGGTGCAGAAATACGTTGTGCGCCAGAGTATTCGGGAGAAAG
CGTAGCGGTCGGCGGGCGGGTCAGCGGCTCGACCGGCCGAAAATTGAGAGTTGAACTTCT
>Contig16_17215
GGTCAAAATAGAATACGGTTCTACCGTTACCTGGTATTTAGGAGTTGTCGTGACGATCGTCGCGGAACAA
CGCACGTATGTCGCGGGCCGTTGGGTCACCGGTGACGAAGTGGTCAGCGTCGAAAATCCCGCCGACGAGA
GTCACGTCGCCGACATCACCGTCACTCCGTTGCCCGAGGTGCAGCGCGCGATCGCCGAGG
>paratb_17216
CGCGCCGCAGCTTCGACGACGGGGTGTGGGCCGACATGCCGCCCGTCGAGCGGGCGCAAATACTGCACGC
CTTTATCGACCACATCGAGTCCGAGCGCGCCACACTGGTTCCCACCCTCGTCGCCGAGGCCGGCCAATCG
GCGCGCTTCGCCGAGATGACGCAGCTGGGTGCCGGGGCGGCCATCGCGCGCCAGACGATC
>paratb_17217
GACCTGTACCTGTCGATGTCGCACGAGGAAGCCAGCCCGGTTCCGGTCGATGACCTGGTGCGTGGCCGGG
TCGCGCTGAGCGTGCGGCGGCACGAACCCGTCGGCGTCGTCACCGCCATCACGCCGTACAACGCGGCGCT
GATCATGGGCTTTCAGAAGCTGATTCCCGCGTTGATGGCGGGCAATTCGGTGATCTTGCG
>Contig16_17218
GCCCAGCCCGCTGACCCCGATCTCGTCGCTGATCTTCGGCGCGGCCGCCGACGCGGCCGGCCTGCCGCCG
GGAGTCCTGAGCGTCGTCGTCGAGTCGGGCATCGCCGGGGCCGAGTTGCTCACCAGCGATCCGAGCGTGG
ACATGGTGTCGTTCACGGGCTCGACGCTGGCGGGGCGCAAAATCCTGGCCCAGGCGGCGC
>Contig16_17219

Figure 6-81

```
CGACCGTCAAACGGGTGTCGCTGGAACTCGGCGGAAAGTCGGCGCAGATCTACCTGCCCGATGCGGTGCA
CCGCGCCGTCGGCGGCGCCTTCGTCGCGGTCGCCAGCACCGCCGGACAGGCCTGCGTAGCGGCCACCAGA
TTGCTTGTGCCACAAGACAAGAAAGCCGAAGTGCTGGACGCGGTCAGCGCGATGTACCAG
>paratb_17220
CAGATCAAGGTCGGGCCGCCCAGCGACGAAACGGCGATGATGGGCCCGGTCATCAGCGCGGCCTAGCGCG
ACAAATGCGAGCAGTACGTGAAGTTGGCCGAAGAACACGGCGGCAAGGTGTTCTGCGGTGGCGGACGCCC
GGCGGGTCTTGACCGCGGCTACTACTTCGAACCGACCGTGCTCGACCTGCCCAGCAACGC
>paratb_17221
GAATCCGGCTGCGCAGGAGGAGATCTTCGGCCCGATCATCGGCGTGCTGGGCTACCGCGATATCGACGAC
GCGGTCGCCATCGCCAACGACAGCATCTACGGCCTGTCCGGGCAGGTGTACGGGACCGACGCGGCGGCCG
CGCTGCAGGTCGCGCGCCGACTGCGCACCGGCGCCGTCAACGTCAACACCACCGTCTTCT
>Contig16_17222
CCGCCTACGCGCCGAGCGGCGGATACAAGCAAAGCGGTCTGGGCCGCGAACGGGGTCCGGACGGCATTCG
CGAGTTCCAGGAGGTCAAGCACATGTCGATTGGGGAGTTGAAATGAGCTCAGAAACCAACGGAGATAAGA
CATACAACCTGGACTGGCTGATCTCGGTCGACGACCACATCCTCGAGCCGCCAAACCTGT
>paratb_17223
GGGTCGACCGGGTCGCCGCCAAGGACCGCGACCGCGCCCCGCACATGGAGAAGAACGACCAGGGCGTGGA
CAACTGGGTCTACGACGGCAAGCGCTACCCGAACTCGGGCCTGAGCGCCGTCGTCGGAAAGTCCAAGGAG
GAGTTCAGCCCCGAGCCGCTGTCCTACTCCGAGATGCGCCCAGGCTGCTATGACGCCAAG
>paratb_17224
GCCCGCGTCGAGGACATGGACCGCTCGGGTGTGCTTGCGTCGCTGTGCTTTCCGACGATCACGCGGTTCT
GCGGCCAGCTATTCATGGAGGCCAGCGACCGCGAATTCGGGTTCGAGTGTCTGCAGCACTACAACGACTG
GCTCGTCGAGGAATGGTGTGGTGCCGCCCCCGGCCGCTACATCCCGCTGATGCTGATCCC
>paratb_17225
GATGTGGGACCCGAAACTGGCCGCCAAGGAGATGGAGCGGATGGCCGCCAAGGGCGTGACGTCCTTCGCG
TTCTCGGAAAACCCGGAACCGTTGGGGCTGCCTACCATTCACGACCCCGCGGGCTACTGGGAACCGGTGA
TGGCCGCGGCCAACGAACTCGAAATGGTGGCCAGCATGCACGTCGGCTCCTCGTCGACCC
>Contig16_17226
TGCCCAAGATCTGTTCGGACGCGCCGTTCATGGCCAACCTCACCTGGGGTGCCTCCCGCACCTCGGGAAC
GATGCTGTCCTGGTTGTTCAGCGGCATGTTCCAGCGCTACCCCAAGCTGAAGATCGCGCTGTCCGAGGGT
GAGGTCGGCTGGATGCCCTACTTCCTGGAGCGCGCCGAACAGGTGCTGGACAAGCAGCGG
>Contig16_17227
TACTGGGTGATGCGCGGCGCGAAGTTCGACACCCACGCCGGCGCCGGCCAGGCGATCGACCTCGACACCC
TCGACATCCGCGAGACGTTCCGCAACCACATCTACGGCTGCATCATCGAAGACCGCCACGCCGTCAAGAG
TTTGGACGAGATCGGCGAGGACAACATCATGTGCGAAACGGACTACCCGCACTCGGACTC
>Contig16_17228
CACCTGGCCCGACTGCATCGGCGTCGCCCGCAACACCATGAAGGACCTCCCGGAGAACGTGCAATACAAG
CTGTTGCGCGGCAATGCCGAAAAGCTCTACCGGTTCACCCCGGCCGAGCCCCCCGTCCTGGCGAGCGCCT
GATGCCCGGAGTGCTCGCCGGCAAGAGCGCCATCGTCACCGGCGCCGGCTCCGGGGTGGG
>paratb_17229
CCGGGTGTCGGCGCTGCGGTTCGCCGAGGAGGGTGCGCGGGTGGTCGCCGCCGATATCGACCTCGACCAC
GCGAAAGAGACTGTCTGCCAAATCGAATCGGCCGGCGGCACCGCCATCGCGATCGGGACCGATGTCTCGG
ACGAGCAACAGGTGCAGGCGATGATCGCGGCCGCCGTCGACCAGTACGGCCGGCTCGACA
>Contig16_17230
TCCTGTTCAACAACGTCGGCATCCCGACGCCGCGGCTCGGCATGATCTTCGAGGACCACACCCTCGAGGA
CTTCAACCGCCTGGTCGCGGTCAACCTCGGCGGGGTGTTCCTCGGCTGCAAGTACGCGGTGCTGCGCTTC
AAGGAGCAGGGCGCGGGCGGGGTCATCCTCAACACCGCGTCGGTGGCCGGCCTGGTGGGC
>paratb_17231
```

Figure 6-82

TGGGGCGGTTCGGTGTACGGCGCGACCAAGGGCGGGGTCATCCAGCTCACCCGGGCGGTCGCGATCGAGG
CGGCGCCCTTCGGGATTCGCGTCAACGCGATCTGCCCGGCGGCCATGCCGCTGACCGGTTTTCATGGCGGC
GGGCGGGCTGGAGGTCGACGCGGAGCAGCAGGCGGCGATCGCCGAATCGGTCGGGGGTCA
>Contig16_17232
GCATCCGCTGGGGCGCGCCATCACGGCCGAGGACTGCGCCGAGGCGGCGCTGTATCTGGTCTCGGACGCG
GCGCGCAACGTCACCGGGGTGGCGCTGCCGGTCGACGGCGGGTTCGTGGCGAAATGACCGCTCCCGCACT
GGATCGCGACCGACTGCGCGAGCTGTTCGACCTGCGCAGCTCCTACAACGCTTGGGCCGG
>paratb_17233
CGGCGCATACGAGGACGACCCGTACCCGGTGTGGCACCGGCTGCGCGAGAAGGGGCCGGTGCTGCCCGGC
GTCCTGCACGAGCTGACCGGCAGCACCGACACGATGTTCTTCCACGGGCTGCCGTACCCGGACTGCCCGC
ATTTCACGGTGTTCGACTACGACTCGTGCATGATCGCTTACCGCAATCCGGAGGTGTTCG
>paratb_17234
CCTCGTCCCCGGAGCCCGTCGACCTCGAGCATGGCCCGCTGGGCCTGACCAACAGCATGCTGTCGATGAA
CGGCGAACAGCACAAGCGGTATCGCGCGTTGGTCCAGCCGTCGTTCCTGCCGGCGAATGGCAAGTGGTGG
ATTGACAATTGGATCTCCGAGACCGTCGACCTGCTCATCGACGGACTGGTTCACGAGGGG
>paratb_17235
CGCGCCGAACTCAACGTCGACTTCTGCGCGGCCATCCCGGTGCTGACCATCACCGGCAGCTTCGGCGTGC
CCGTCGAGCAGGCCCTCGACATCCGCGAGGCGCTGGCGCGGGATCCGCAGAAGGTGGTCGACCTGCTCAA
GCCGGTGATCGCCGCCCGCCCCGAGGAGCCGCGCGACGACCTGATCAGCGTCCTCGTGCA
>paratb_17236
GGCCGAACTCACCGACGAGGACGGCGCCAAGGACCGGCTCACCGATCGCGAAATCGATTCCTTCGTGCTG
CTGTTGCTCGGCGCGGGCTCGGGCACCACCTGGAAGCAGATGGGCACCACGCTGACGACGCTGTTGCAGC
GTCCCGAACTCCTCGAGGCGGTGCGCGCGGACCGTTCGCTTTTGCGGCCGGCGATCGAGG
>paratb_17237
AGGCGATCCGGTGGATGCCGACCGATCCGATGTTCTCCCGCTGGGTGATGGCCGATACCGAGCTGGCCGG
CGTGTCGATCCCCGCCGGGTCTGTCGTGCACCTCGCGCTCGGGGCGGCCAACCGGGATCCCGCCCGCTGG
GACCGTCCCGACGAATACGACATCACCCGAAAGTTCAAGCCGTCGTTGGGTTTCGGGCAG
>paratb_17238
GGTTCACACATCTGCCTCGGCATGCACGTAGCCCGCGCTGAGATGACTATAGCGATCTCGGCGCTGCTCG
ACCGGCTGCCCAACCTGCGGCTGGATCCCGACGCCGAACCGCCCCGCTTCGTCGGAATGTACGAGCGCGG
GGCGACCGCCATACCGGTGGTGTTCGATGTCTGAACCCGGCTACACACCGCCCGACCTGA
>paratb_17241
ACCACGGCTAGCATTTCTTCGGTGTCACGTGCTGAAGAACGGGCCGCGGAGCGGTCGGCGGCGGTGCAGC
GTTCGCGCGAACGCATCGCCAACCAAGTCAGGCTGATGCTCGACGCCGCTCTGCGGCTTATTCGCGAGAA
GGGCGACAGCTTCACCACCCAGGAGCTGGTCAAAGAGGCCGGCGTCGCGCTGCAGACGTT
>Contig16_17242
CTACCGCTACTTCGCCACCAAGGACGAACTGCTGCTGGCGGTGATCGCCGACGCGATGACCGACGCGTGT
GCCCGCTGGAGGGACGCCGCCCGCGACCTGCCCGATCCGGTCGCGCGGTTGCGCTTCTACGTCACCGCGG
TCATCGAGGTGCTCGACAACGAGCAAGGCGATGGCGGCACCGCTAAGTTCGTCGTCTCGA
>paratb_17243
CGCACTGGCGGCTGCACCGCGTCTTTCCCGACGAGCTCGCCGAGGCCGAGAAGCCGTTCGTCGATCTGCT
GCTCGGCGAGATCAACGCCGGCATCGAGGCCGGGCTGCTGGCGCCGGCGGACCCGAAGTGGGCGGCCTGG
TTCATCGCCGAACTGGTGCGCTCGGTGTACCACTACTACGCCTACGCACCGCGCGAGGTC
>paratb_17244
GACGTCAAAGAGCAGCTGTGGCAGTTCTGTCTGACCGCGTTGGGCGGGACCGCACGCAAGTCGCGTGGTA
GCCGATCGAAATAGAGGTGCGACATGCCCCATGCAAAACCGGACGAGTTGCCCAGCGGAGGAGGGGGCG
GTGGCCGGCGGCCGGCGACAATTTCCGTTCGGTGCAGTGGGGCGACATGGAGGTCGGGTA
>paratb_17245

```
CACGACCACCGGGCCGCTGGACTGCACGCAGCTCTACCAATTCGGCGGACTTCCCGGCGGCGTATGCCCT
TGTCCGCACTACGGATACATCTTCGAAGGCTCGATCCGCGCGACCTATCCGAACACCGACTGGCCGGACG
AGACGGCGACGGCCGGCGAGGTGTATTTCTTTCCGGCCGGGCACATCCTGATCTATCGGG
>paratb_17246
AACGAACCAAGGCGCTCGAGCTGAACCCGGCGTTCGCGTTGCAGCAGTGCATGGATGCGATGCAAAGGGC
TGGGCAGAAGGCCGAACGCGCTCAGCGGGAGCGAGAGTTACAAGCGTGACAACGTGAACGGATACGTGTA
GGAACCGGCGGGCGCTCCATGGCAACCCGCGTCGAAGGAGGATTGCAGCGAGCCGGCCAG
>paratb_17247
CGTGGTCGGATCCCACGTGTAGACGTCGTGGGTGGGAACGGTTGGGCCGTAATAGATGTCGTCACACCTC
AGGCCGTCGGGAACGTCGACCGTCAAGACGTATTGGCCGTCGACCGACCGCGCGTCCCCGACGTACGGGA
ATGCCTTGGCCACCGGCCTGGCGATGGCATTCACATGCACGCAGCCGCCGCCCGGGCATG
>paratb_17248
CGGTGATCGCCCACAGCCAGGTGTGAAAGTCGTATCTGCCCTCGACGTGGAGGTCGTAGTTGCCGAAAGG
CATGGCGGCCTGCGCGATTGGCGGGCATGCCGCGGCCGCGAAAGCCAGAGCGCCGGCGAGCGTCGAGGTC
TTCCGGGCGAGCCGTCGCGCAGAACCCATGACGTTCCTCGGAGATCTTCGTTTCTTACGG
>paratb_17249
TTCGAGAAGTCGATTCTACTTGCACGACGCTTTTTTCGATAGAAGGTGCGGGAAAGTTGCTGACATCCCT
GCGCGGTTCTGGAATGCTTGCGGCATGGCCGTGACCGAGTTGCGGGAGGTGCCTTGCGGTTCGGGGGTTT
CGGCCCGGCGCATCAACTGCGCGGCCTGCGTGGCCGAGCTGGACGCCGTCTTCGCCGGCC
>paratb_17264
GCAAGCCGAGCGGCAGCCGGATGCGCCCGCGGTGTTCGCCGGTTCCGGCGACCTCAGCTACGCGCAGCTG
CGCGATCAGGCCCTGGCGGTGGCGGCGGCGCTGCGCGCGGCCGGCGCCGGCGCCGGGGACACCGTCGCGG
TGGTCGGCCCGAAGAGCGCCGAGCAGATCCCGGCGGTGCTGGGCATCCTGTCCGTCGGCG
>Contig16_17284
GCGGCGATCCTCGAGTATCTCGACCGCATCGGCGAATCGACCGAAGCGACCGGTGCGGTAGCCGCGACCT
TGCTGCGGCTGCGGCGGGTGCGCCGGCACCGCGCCCTGCTGCGCGCGGCGGACCGCGCCGAACTCGCCGC
CGGACTGGGGGCGATCGCCCGCGGCGAGGAGCACGCGCTGATCACCCGCTCGGCCCGGAC
>Contig16_17366
TCGTGCCCACCGAAGGGGGAATCATGAACACCGTCAAAACCATTGCCACCGGCGTGGCGGCGCTGGCTAT
CGTCGGGGGCGCCGCCGCCGGACTGGCCGCCGCCGCGGCGCCGAGCGCGCCGGGCACCGTGCGGCTCGCG
GCCGTCGGCGCACCGCTTCCGCAGGATCCGCCGCCGGCACAGCCGGTCGCGGGCGCCAAC
>Contig16_17403
ACAAGTCAAGGTATTTCGACCATTGAGGCCATCTAAACACTGTACCTGACCAGGTAAAACGTGCTGAAAC
GGCAACTCAGTTCAGTCAAATATCTTTGACTCAGTTAACTCCTTCATCGCAACGCGAAGGAGACACGCCG
AATGTGCAGGCCCACGCTCCACTGGGACGCGGACCACGTGTCCAGGTTGATGGAGTGCAG
>paratb_17404
GAACATCCGTAACCGCCGAGCCCTGGCCAAAGCGCTCAGGCGTCACCCCTCCGGGGTCTATCGTGCGTTC
GATGAGGACTGGTCGGGTGGCGTGAGCCTCGACATCCTCGCGGCCATGTCGGTGCGATTCAACGTGCCGG
TCGGCTGGTTGGTGCGCGACCCCAGGGGGCGGTGATGCCCATCAAGAGGTACCCGGTCGG
>paratb_17406
TGGTGATCGGGTGGATCGGCCTGGGGGCCTACATGATCGGGGAGCACGTGAGCCACAGGTCAGAAGGGGT
GAACGAATCGTTACCCCCTTCGCGAACAGTGCAGATACCGTCCAACGTCGCGAAGCCGACGACAACGGCG
ACGCCCACCCCGCGCTGAAAATCCAGCCGAACGCGTGGGAGGCGTTCACCTATCTTCTG
>Contig16_17407
CGGGCGCGCGGGGGTTGAGTATCGACCCGGCCGAGAAGGACTACGACGACAAGGCCAACCGTCATCTGTG
CTGGACGCTGTTCAGCAACGATGATCCGGCGTTTCGGCAGAAGACGATTCAGGGCTCCATTGAGGCCAGC
GAGGGCGGTACGTGGGGTAAGCCGGAAGCCACCTACGCCATCCGCAGCGCGATCATGGCG
>paratb_17408
```

Figure 6-84

```
TACTGCCCGCAGTTCGATAGGTAGCCCGTGGGCTCGCTATGACTCGTCGCCCCACCCGGCGTTGGGCCAG
TTCTTCCTGACACTTGTGATTGCAAATTGGCCGGTGTTTTCCATCTCCACGGTGAACATCGATCCGTCTT
TCGCGTGGTAGACCACGTGGGCGCGGAGTCCCTGAACATCCACGACGACGGGCCTCAAGT
>paratb_17409
CATCCCTTGCCACACCGAACCCCTGCTCGATTGCTCCCAGCGCCAAAGGATTTGCATTTTCCATCAGGAA
TCGTTCCTGGGGCGGTGACCCGGCGGTCCACGAGAACCGATGCGACAGCTTTTTCAACGCGTCATAGATG
ACGTTGTACGCAAGGGCAGTGGGCAACCCCACCGCGAAGGCGATCCCGTATTGAGCGAGG
>paratb_17410
CCGCCGCCGGGGTAGGGAGTCTGCGACTCGGTGATGACGGGCTTGGTCTCCGATGTCTCGGCCAGCGAGT
TCACAAGGTTCTGAAGTTCTTCGCGGAAAGCGGCCGTGTCGCGCCGAACAATGTTGGTAAAGAGAAGGGC
AACTTCGGCAAGTTCACCTTCCGGCGAGGGGGCCACAATCGAGACGCGCGCCGTTCTGGG
>paratb_17419
CTGGTGTGCGGCCGCGGATTGGGCTGTGTTTGCAGCGTAGTAGATGGCCTCGTATTCGACCGGTGGGATG
CGGCCCAGGCGGTGCATGAGCCGGTCGGTGTTGTACCAGTGCACCCAGTCGGCGGTGAGCATTTCGACGT
CGGCCAGCCGGTTCAGCGGTCCGCGCCGGAACGGTGAATCCGCCCGCACCGCTTCGGTCT
>Contig16_17420
TGTACAGCCCTATGGTCGTCTCGGCCAGGGCGTTATCGAAGGCGTCGCCGACCGTGCCGATGGACGGGAC
CAGCCCCGACAGCGATAGGGTTTCCCCGAACCGCACCGAGGTATATTGCGAGCCCGCGTCCGAATGATGA
ACGGTGTTGCCCAACAATGGATTACCTTCATTGGATCGGAGTTGCGCGGCGTCCCGGATG
>paratb_17421
GCCTGGCGTAGGAACCGGTCCTCCTTGCTGGCCGAGCAGGTCCAGCCCACGATCCGTCCCGCGTAGGCAT
CGATGGCGAACGCGGTGTAGACGAACGCCCCGGAAGCCAGTCGGACGTAGGTGAAATCGGCCACAAGCAA
CATGTTGGGAGCGGGCACTCGAAACTTGCGTTTCACCAGATCCGCAGCACGTGCCGCGGC
>paratb_17422
TGGATCAGCGATCGTGGTGCGGACCTTCTTGCGGCGGGTGACCCCACGCCACCCGTTGGCCCGCATCAGG
CGCTCCACGGTGCAGCGGGCCACGCCGATGCCCTGGCGTTGCAGGTGAGCCCACATCTTCGTGGCTCCGT
ACAACGACTCCGGCTTGCGTCGACCGTGCTCGTCGGGCTCGTAGTAGCCGGCCAGCACCT
>paratb_17424
CTGCCCTTAACATCTCGACGGTCTGCTCCAACTCGGCGACCTTACGCTTGAGCTCCCGGTTTTCCCGGTT
GGTGGCCGTAGTCACCCCGTCACGCTCACCGCCATCGATCTCGGCTTGACGGACCCACTTGCGCAGCGTC
TCTGGGCCAACACCGATCCGAGTCGCGACTGCCCGGATGCAGCCATACTCGCTGTCGTAC
>paratb_17425
TCGTCGCGATGGTCCACGACCAGACGGACAGCCTTGCTCTTCGTTGCTTCGTCGTACTTCTTCGGCATGA
TGCGCCTTACCTTCCCTCGAAAGAAGGTGTGCATCAAACACGGGGCGATTCAAAGTCTGAATTTCCGGGG
CTCAGATGGCCGCTGCGGCGTTTTCAGCCGGTGGGTGGGCGGGTTTGCACCCGCTTGTC
>paratb_17426
GGACCAGGGTTGAGATGGCGCTTAGGCTGCACCGTCCGATGTGACGAGTTGGCGGGTCAGCACCTCAAGG
CGGCCAAAATCCTTATTAAGTCGGTCTCGAATTTCGGTGTATGTCTCGATGGGGTCGCTGTCGACGAGGT
CTTTCCAAAGCTGAGCGACTGTCCGTATGGCATCCAGAGTCGAGGAAATTCCGGCGTCAG
>paratb_17427
TGGTCAACAGCCAGGCTCGAATCGCAAGCTGTTCAACCTTATTGAGCTGCGGCGTGTGCTCATCGCGTAC
CTGCAAGGCCTTGTTGAACCGCTCATTAGCCGAGACCTCCGGCCGCTGCCTATCGGTTTTGTACTCGTCT
GCCGCTGTCGCGAGTTTGTATGCGGCCTTATCCGTCGCCCAACGCTCACCAAGCAGGTTG
>paratb_17428
GCGACCTCCTCGCGCAGTCGGTCGTTGCGCTCGGCCGCCCGATCGGCACGCCCTTCGGCCCGAGTGGTGT
CTAGCTGCTCTCTGTGACGCTTGTCTGCGTTCCTATTGGTGCACCAAACCCCGACCAGTCCGCCGACGAA
TAGCACACCCGAGCCGACAAGCCCGAGTACCGGACCAAGCCAGGCCCAGGCCGAAGCCTC
>paratb_17429
```

Figure 6-85

```
GTTGACGATGTCTACTGGCCACGGATACACCCAATAATCCACGCACGCATTTAACCAGTGACTACCGACA
AACGTCGTGGGGTATGTCGGCGCCGACGATGATCGGCAGCCAGACGACGGGGATCAGTGCGGGACGGCCA
TGCGGTAACCGCCCACGCAGCCGCTGACACCATTGATCTCGCTGGTACGCCAGGAGCCGG
>paratb_17430
GACCGTGGGCACTGTAGCCCCAGCCGGTCGGTGGCGGTCGACTTGCCGCATACCGGGCAGGGGTGGCGG
TCGCGCTTGGGTTGCTGGAACCGCCTCACGGCACCCCGGCCAGATGGTCGAAGCGTTTTTGCAGATCGGC
AAGCACTTCATCACGGCCTGCGGTGTCGCGGCCGTTCAACTGATCGACGTACTTGCCTTC
>paratb_17434
TCGCCCCTGCGTCGGGATGACTATTGCCGCCATGCGCCCAGGAATTGGGCTAGTTGCTACCACCGCACCA
CTGAACATCTCGCCGGTCGGTACCTTTTCCATCGCGCAATACAGCCACGGATGAAACTCCCACCGCAGCT
TACCCACGATGGTCACTCCTCGTACTTGATGTAAGTTTTCGTCGGACAGGCGTATGTAAG
>paratb_17437
GTGGTACGCGGCTTTCTTGATTGCGGGCTTGTAATAGCCAGAGGTCGAAACGATAGCGCGATGGGTCACG
CCGGGCATATCGTTAAGCTTCGCAGCGAGTTGTTCAACGTGAGATTCGTTGAGCGGCTTCTTCCAATGCT
TTACCTCGTAGCCCATAAATGCGTACTCCCCATCTGGGGTGTCGAGGGTGACGGTCACAT
>paratb_17438
CGACATCGCGAGGCTCGCCGGACGCCTGGTCTAGCACCATGTCGCCGAGAACCACCTCCTTCACAGACGC
GGCGGCGCCCCATTTCAATACACACAGGCCGGCGAGGTACTGAACAAGCATTGGCGACAATGGCAACTTT
TCCTTCGGCGACATGACGCCAATGTTAGGTACCTACTACGACACGCTCCCGTAAAAGTCG
>paratb_17439
CGGTGCGGGCTGTCGGGCCGTCGCTGGTTTGGCTCTACTGCAACATGGCGGGCGCGGTTTTACTCATCCC
AAGAGTTGGAACGCCATACACTGCTTCGCGTGAGTCAGCCGAGCGAGCAGCCCTCTGGGCGCCCGTCCCT
GGAGAGTCTGGTTCGTTCTGCAGCCGATCCGCTGGCAGCAAGCACTGCCGTTGCGGCGGT
>paratb_17440
AGACGCGCTGAATCAGTCAGACCGCGCCCTTTCACGGCTATTGGAGAATGAATCGATAGCGTCGTCACCA
TTCAGGAACTCCGCGTTGCGCCCAGCGAAGCGCAAAGCGGCGGCGCTTCGCCAGCTTCTCCGTGACGATC
TGTCAATTCACCCGTTCAACGTGGTCAGCGAACATGATCTACCGAACCTTGAATCGATTA
>paratb_17441
GTGTGCCTTTCGGTGCGCTAATTCCGCGTGATCAGTTAAATATTTTGATGGCCCAATGCGCGTCAATGAA
TTAAGTGCTGAGAACGCCAGCCGCAAGTTTTTCTGCATTCGAAAGTACTATTTCAGGATTTCTGAAGTAT
CTAGATGAATTCAGTGAGAATTCGGTTAAGCCGGCGCTAGACGTTTTGGATGGGCTCCGG
>paratb_17442
CAGCTTCGGGACGAGTACCACATCGAGATCGGTGGTCAGGCGCTAGACGCAGCACTCGCGGATCGTCGCC
GTCAACTTTTGGATTCGTATGTCGAGTTGCTTGAAAGCGTCCTGAGTGATGCGCAGAGTCGCACTCAAAG
GCTCACAGAGGATGAACAGGCTGTTGAAAAAGCCGTATCGCGGAAGGGCCGTCAGCGTCT
>paratb_17443
CCAACGAGACTTCGCCACCATGGTCAACCGTGAGACTTGGTGGGCGGCAGGGTGGACGGTAACAGCGTTC
TTGTTGACATGCACTGCTATCGCGATCCCCGTCGTACTGTTTTCACGGGGCGTACAGTTTCCCGCAGTTA
CCGGCTTGTCCGCGACGCTGATTAAGGCATTCATTGGGATTCCGCTACTTGCATTCGCTG
>paratb_17444
CCTACTGTGGCAAAATTGCGTCCCAGCACCGAGACACGGCTCGGCACATGAACATCTTGGTGACACAAAT
TGACTCAGTGAGTGCTTACGTAACTGATCTACCCGCCGAATCAAAAAATGAGCTCAAGGTGATTCTGGGC
AAACGAGCGTTTTCAACCCCTGACCTTGATTCCGGCGCCAAGGCAGAGTCTGAGCCTAGT
>paratb_17445
TCGGGAGAAGTTGCGCTGCTGCTGTCGAAGGCTCTGGATATTCTTTCGAAATTCGGTGAGAAGTAGTCGC
GGTTAGTCTAAGCGAGGCATCCGGTGCTTCCATGCCCAGGTGTCATCACGAAACGCTGTATCCGTGCCCT
TGGCGGTTCATCGCGGGCGAAGGCGATAAGGCGATCAAGCTCGGTATCACTGAGTACGAG
>paratb_17449
```

Figure 6-86

```
CCGCCCCAGGATGTACGGCACCGTCTCGCGGCACTTCTCGCACGTCCAGTACTCGGGCCAGCCGTGGGCG
GCGACCGCGATCAGGTGAGCTTGGCTGACCTTCTCGCGCCGGCCATCGCGCATTTGTACGCGCACGAAAC
CGTGCCGGGTGGCCACTACGCGGGTACCGTGCCGGATCGCGCTGGTTGTGCCCCGTGAAG
>paratb_17457
ATCGCGCTGCCACCGCTGCGACGCCATTGGTAGACCGGCGCGACCGCCTGGGCGGGGTTGTTGGGATTCT
CAACCTTTAAGTCATCCCAGATTTTTTCGTTCGTCATTTCCTTCGTTCGTTCAGGATCGCATTTCAAAGA
ATGAGTGTGCGTATGCACACAATGCTGGATCACGGAGCGGAAGCGCAGTGATCCTGCCCT
>paratb_17458
CGCCTTTAGGCGAGCCTCTTACGTACCGAGTCGGTACAGTGAGTCAGCCTGGAAAGGGAAGACAATTACC
CAAGTCGTGTAGTGACGTTGCGTTCTCGAATCAGACGTTGCATTGTGGTCTGTTCGCGCGGCCTGTCACT
GACCGTACTTCGGCGGATTCTTTCAAGAATCGAAGATTCAAAGAACCACAATCGGAACTG
>paratb_17459
TCACGTTCTCGCACTCTCCATGCCCCGCACTTCTGGGGTACGGCTGGGTCTAGAGACTCTCACCTAGCGG
TGAGGGTTTCGCCATCTCGCTGCGCTCAATGGCTCACAAGGAATAGACCCTCTACTTATAAGGACACTTC
TGGGCAAAAACGTGAATGTTGAAATCGCATTTCCCCAGGTCGCCCCAAAAGCGTGTGACC
>paratb_17460
AACCTCACATTGACAGGTGGCCCGCGCATCCCGGAGGCCATCACGCCGCCTCCCGCGCGGCGACGATGGT
GGCCCACAGGTTGTCGGCAGTGTCGCAACAATCCAACAGGTCTTCGCGTACCAGCTCGCGACCCAACCGG
TCCTAAAAACAGCTCGCACACAACCAGCCCTGCGTGGGCGGGCCGTAGATGCGCCACAGC
>paratb_17461
TCGTCACTCACCCGGTAACAGTCGGCACGGCCGCCGCACCACTTGCACGGCCACCATGCGCCCCGGTCGT
CTGCTATCGCGCCAGTCTCGTCATCCCGGCCGGTCCGGTAGCCCTCGCAGAAGGCGTCCACCCAGCCGCC
GTCATACCCGTCATCCCAGCCGCCGACGTAGCCCTCATCCCACCCCACGTCGAAGCCGAT
>paratb_17462
GTCACGGCCATCGTTGAGGCCGTGGGCGTAGTCCTCCTCGCTCACGCCGCCACCCCGTCCCGGCGACGGC
GCCGGGACTCGACGGACTTCAACGCCATCTTCTTGAAGTGGGCCGCGCGGGCGTTCTCGGCCATCTTGGC
GCGCAGGGCGGGGGGTAGCTTGCCCTCGGGATCGACCTGCTTTTCGAAGCGGTCCCATGC
>paratb_17463
CGCCTTACGGGCGTTATGCGTTCGCGCGGAACGGTTTTCGGTGCGCGCCCAGCTCTCGTGAACGGCGACC
TGTAAGCGCAAACGGCGCTCAGTAGATGTTGACACTTGCGTACTCCTGGCATCCTTGATCAGGCCCCCGA
GATGCCAACTCGCCCAAGGGTGGACGAATCTGCCGGGTGGCCAATGTGATCAAGGCACGC
>paratb_17464
CCCAAAGTGGGGGAGCTACGCTGTACGCGCCTTTAGGTACGGCTGCAAAGCTACAGCGTTGACCAGCCGT
GCTCAAGCGGAAAGTGTCACATTCCCCAAAGTCGCAGTAACACTTTGGAAAGTGCCAGCTCAGATATCGC
CCAAGTTGAGCCTGCGGGCCTCGTCGGCGGCAAGGCTGGCGGCAGCGGCGCCGACGTACC
>paratb_17465
TGTCAATCATGCTGCGGTTCTTCCACCCGGCCACGCTCATCAGCCCCGACTCCGACCCGCCAGCGCGTAG
CCAGCGGGTCGCGGCGGTGTGCCTGAGCATGTGCAAGTGGAAGGTCTCGATGCCGGCGGCGGTAGCGCGC
TGCTTCAATGCCTTGCTCAGCCCGTAGTACCCCAGGCTCTTCCCGCCCCCGCCCAGCCAC
>paratb_17466
AGCGCCCCGGTGTTGGACAGCCGATGCGCACGCCGTGCCCGAAGGTAGCGGTCGATGGCGGTGGCGGTCT
GCACGCTGAAGGGCGATACGCGGCCCTTGCCGCCCTTGCCGCGGACAATCGTCACGATCCCGGCGTCGAG
GTTGACGTCGGTGATCTGCAGGCTGAGGGTCTCATTGGCGCGTAGTCCGGTCTCGGCCAT
>paratb_17467
GAGGCGGACTATCGTCTCGTCGCGGCGGTCCATTAGGGATTTGCCCTGGCAGGCTGCGATCAGCCGTTTG
AGCTGATCTTCGGTGAGGGCGTTGACCACCTTCTGGTCACCCTTGGGCGGTTTGAGTCCTAGTAGGGGAT
CGGAGCTAAGCTCGCCTTCATCAACCAGCCATTTCGCATACCGCTTCAAGGCGAGGTCCC
>Contig16_17707
```

Figure 6-87

```
CAGGGCGACCGGCAGCTCGGCCGCCGCGAGTTGCGCGGCGACGTCCGCGGCGAGCTCCTCGGCGTTGCCG
GTCTGCGACGCCCACAACACCACGACCGGGGCCCGCTCGGGCGCGGGTGTGGCACCGGCCGGCGCGGCCG
GTGGCTGCTGGGCGGCCGGCTGGGGCGGCTCGGGCAGCGCCGCCTGCTGGGATGCGTCGG
>paratb_17835
GTAGCTGCGTTCGTGAGCGCCTCGCCCAGCCGAGGCCCTCCTTACTCCGCAAGTCCGAGGAAGACTAGGA
GCGCCATGTCGAGCCGAACGATGTCTCCGTCCGGTAGCCGGCCGACCCGGCGGGTCAGGCTGGCGCGCGG
GACGGTTGTGATCTTATCGATCATCAGCCGGCTGGTCTCCGCCAAGCCGGTTGTCTCCGA
>paratb_17837
ACGGCATCGACGAAGGCCTGGTCGTCACGATCCTGTTCGCTGGCAGCCACGAGCGCCGATTGGCGGTGCG
CTTCTCTGACGAACTCCGTGGCGTTCACATCGGGAACCCAGAGCTGGATCGGCCGCAGGCCTCGTTGGCG
CAGCCGTTCCCTGTGCCTGCGAACGCGCTCACGACCGAGTGACATTCGCTCATGTAACGG
>Contig16_17882
TCGCGGCGAAGGCGGCCGTCACCAGACCCCACGTGTGCGCATGGGCGGCGGCGTCCCCGGCGACGTAGCG
AGCATTCAGATCGTCGAATGCGGCCTCGATGTCGTCTGGGTCGTATGCGACGCGTGCCAGGATCCGTTTG
TCGGCGGAGGTTTCGACGATGATGAGCATGTCGATGTGGAATCCTCCGGGTTGCTGATCT
>paratb_17883
TCACCCCGGATACAGGTCCGGCAGAGGACTAGGCGTTCACCTCGAGTCGCGATGACCGTCGCCGTACTCC
TCGTGGCCCCAAGACCGGCGAAGGCGCGCATGTTCGCGATTTCGACGTCCCGGCCGCGTCGGGTCTCGGC
GCTCACGACTCGTCGGTGGTCGTCGACAGTTGTCTCGGCCGTGAGAAGTCTCGCCATGGC
>paratb_17884
GTCCCAGTCGCGGGCGGCAAAGCAACTTCGGAAGCGTTCGTACGTTTGGCTGGCCGCGTTTTCGAGCCGA
CCGGGGTGCGGGTGCAATTCATCGAACCTCGCGATCGCGGCGTCGACGTCCGCCTCGTCGAAGACTTCCA
ACCGGTCGACCAGATCGCGGTCGACCGTGATAACGGCGATACTGCGCCACTCGGCTTTAA
>paratb_17885
AGCCCTCTCGTGAGGTTTCGTGCGATACCGTACTGAACACGGCTCCAAGGCTGTCCAGCCGGTGCACGGC
CTCGACGGCGCTGCTCACATCGGATGCGAGTTGCCATTCGGCCAGCAATGCGGGCAGTCCACCGGGCGGG
AACGACGACGCATGCCGGTGGTCGATAGTGACCCAATCTGACGTGGTCGGCGGCGTCTCG
>paratb_17893
GTGGTGGTACCGCCACTCCGCGTCGACCCCTTCTGGGGAGGTCCCCCGCGCGACGTGTGTGACGAGCGCG
CCCATGTCGTTCAGCCGATGAACCGCGTCGATGTAGCTGGTGAGGTCAGGCGTGTCGTCCCATGCCGCGC
GCATGTAACTGAACAACTCACCCGGTGCGAACGCAGTCCCGCGCCGGTGGTCGATGCTCA
>paratb_17935
GGGCTGGGGCTGGAGCGTCGAACTGAATCAATGCGTGTTCCTGCTGCCGGCCGCGAACGGACCCGGCGGA
CCCGGGGGACCGGGAGGGCCCGGTGGACCGGGCGGACCCGGCGGACCTGGAGGGCCGGGCGGGCCCGGCG
GACCGGGCGGGCCCGGCGGACCCGGAGGGCCCGGCGCCCCGGGGCATCCCGGCCCGCACT
>paratb_17946
AAGTAGCCACGTTGGGAGTCCCCATGCCAGGGACCACCCGGGCCGCCGGGGTGATCGGGCCCGCCCGGCC
CACCGGGGCGGCCGGGGTGATCGGGACCGCCAGGTCCACCTGGTCCACCAGGGCCACCGGGATGACCGGG
GCCGCCGGGACCGCCAGGCGGCCCACCGGGCCCACCCGGCCCGCCGGGACCGCCCGGTCC
>Contig16_17959
GCGCCTGGGCTTTGGCGCGGCTTCGATCACGGTGGGCTGGCTCGGGCACTGTCGGCCGAACGGGGCTTCG
AGGTCATCACCGTCGACCTGGCGGCGCCGCCGGCCGCCGGTGCGCTGCGCCTGCCCGGCGCCGATCCCGA
TTCCCTGCCGGCGCCGCCGCAATCCGCCGACGAGGCGCGCTGGATCTACTACTCGTCGGG
>paratb_18067
ACACCAAGTCCTGGCAGGGAGCGGTAGATGTCGGCGTCCGGGTGTGTCTCAAAATGTGTTGCCAGTTCGG
CCTCAAGGTCGGTGATCTGGCGGTTCAGTTCAGCGATGATGCCGACCGTGGCGCGGGTTGGTTGCGCCGA
ACGCGGCGGTGACCGCGGCAGGGGCGGCGAGCTGCTCAGCGCGTAAAGCGGTTTGAATGT
>paratb_18069
```

Figure 6-88

```
GTTGGTGTGCCGATTGCGGGTCCAGATCAGATTCTGATGTGCCCGGGCCAGCACTTTGACCGCCTCGGTA
TCAGCGGAGTCACCGGCGACGCGGCGGTGATTGTGGCGATCGGTGCGCACCAGATCCGCCAAGAGCTTGG
CGTCCCCGGCATCGGATTTGGCCCCCGACACATGGTGGCGGTCGCGGTAGCGGGCGGCCG
>paratb_18070
CCATCGGGTTGATCGCATACACCTGGTAATCGGCCGCGGTGAGCGCCTCGACCCACAAACCACGGTCGGT
TTCGATTCCAATCACGACCTGGTCGGGCTCTTCGGCATGGCGGGCCAAAAGCTGATGGAACTCGCCGATG
CCGGCAAGTCCCTCCGGTAACCGACGCGAGGCCAGCCGGGCCCCGGATTCATCCATCAGG
>paratb_18071
TGGACGTCGTGATGATCCTCCGCCCAATCGTCGCCGACAAATATCACGTAGCGCCTCCTCGGTGGTCATC
GAACATGTTCGAGCCCAAGGGCACCCGGCGACAAGCTAATGGATCAGTGCTCAACGGCACGACACCCCAT
CAGTGCTACAGGAACCCTCACCAACCGGCCGGGGCGTGATCTAGCCTTAGAAGTCGGCCA
>paratb_18182
CAGTAGGGGCCTCGACGCCGGGCGGCGTCGGGCAGGGCCGGTTCGGTCCGACTTGCTGCGGGAAGGTTGC
CATGACGAGCCATCGCACGGTTTTTAATCACGTTGGGTTATGCGTGGCGGACCGGGAGCGCTCCCGCCGG
TTCTACGAGGGCCTGCTGGGGTTCCAGTTCTGGTGGGAGATCGACCCGCCCGACGATCGG
>paratb_18183
ACCGCTCAGCTGGTGGGGCTGCCCGAGCCGCTCGGCGTGCATGCGACGTATCTAGTGCGCGACGGCCTAG
TGCTCGAGCTGATCGACTACTCCAAGCGCTGGGTTCATGCCGGCTCGCAGCGGGCGATGGATCAGATCGG
GCTGACGCACATCTCGTTCTCGGTGTCCGACCTCCCGGGTGTGTTGGCCCGGGTGCGCCA
>paratb_18189
AGCACGTGCGGTGCAGAGTCGCAGGGGCGAATGCGTTCCAGTCACACGCCGGTACGCGAATGGCGGTGGA
GTTGAGTTCACTCTTCGCTCGCTGCTTTTCTGTCGGACCATCAAATTAGTTGTAAGCGGTACTTCCGGCT
TCGGGATGCGTCGTGCTGACGAGCTTGGCGGCGCAGTGATCTCGGTCAAACCCTTGGAAC
>paratb_18190
CTGCACCAGGCCAACGGGCCAGAGGAGTCGGCGAAGGTAAGGCCGGCAACGGTAACCCAGAAGTCCGGCC
CGGAAAAAGTCGACCAATCACCCGACCAAAGCAACTTTACGTTGGGATACCGCTGCCTCAGCTGCAAGTG
CTCCCGGAGAGTCATTGCGTTGTCCCACACAACACCATTGTCTACGACACCCGGACGTTT
>paratb_18191
GGAGCTAAGTTGTGGAACCCAGCGGTCGGCGAGTTGCGCGCGAACAAACGCGCGGTCGTCATTGGCGATC
TGGTGTAGCTGCTGTGTGGCGTCTTGTGGTGCCGACGTCGGCGTGCTGGGTAATCGGGCCGGCTCGGTCT
CATAGGTAGGCACGGGGTTGGTATAGGAAACAAGCGGTGAGGTTGATGGCTCCGAGGTGC
>paratb_18192
TTGAATTTCGTTGTGTGGTAAGGCCAATGACCAGTCCGGTGCCGCCGACCAAGAGCGCCACCGCGACCCC
AACAATGGTCAGCACCATCAATTTCTTCGAGCCGCCTTGGTCTGCGTCGGTAGCACTTACCGGACCTGTT
GCGGGATAAGGATATTGGGCAGCGAACGGCGGATAGCTAGAAGGCGCACTGACGTATTGC
>paratb_18193
GGCGCCAGCAGTGTATTGGTGCCGGCCGAAGTGGCCGGATCGGGAGCCAGCGCGCGCTTTGCCGCGCGTC
CTAAGGCCCCAGCACTCCCATAGCGGTCATCTGGATGTTTAGCCATGCCGCGGGCAATGACATCGTCAAA
CGACGCCGGAACGTGCGGATTCACGGCACTCGGCCGCGGAGGCGGTGACGACAGATGGGC
>paratb_18194
GCGGATGGCCTGCTCCGCGCTGTGAACCGGAAACGGTTTCGCACCCGTGAGTGCCTCGTACAGGACGCAT
GCCAACGCGTAGACATCCACCGCTGAGGTTGTTTCCTCATCACCGAATCGTTCAGGCGCCATGTAGTCGA
AGGTGCCGACTGTGTGCCCTGCCATGGTCAGGTGCGTATCACCTCTCGCTTCCGCGATGC
>Contig16_18195
CAAAGTCGACTAAGTATGCGAAGTCGTCTGGCGTGACAATGATGTTCTGGGGCTTCACGTCACGGTGAAT
GAGGCCTGCGGCATGGGCAGCGTCCAACGCCGATGCGACCTGCCGAATTATGTCGGTGGCCCGCCGCGGC
TCAAGTGAACCCGTCTTGAGCATTTCGTGCAGTGTTTGACCCTGGACCAGTCGCATGTCG
>Contig16_18258
```

Figure 6-89

```
GGTCGGGGCCGCGTTGCGGGTGGCGCACGCGGACGCCGGCGCGACGTTCACCGCACCGGCCGCACCCGCC
ACCGCCACCGCCCGCGCGGCGGCACGGCCGGAGCCGCGCGCGGACGCGACCGCGACCGCCGCGGTGCCGC
CGGCGAATCCCGCACCGATGGCGGTGCAGGCCTGGTCGGACACCGGGACCGACGCCGCGG
>Contig16_18562
CAGCCGTCGCACCAGCGGTGTCACGTAGGGGTGCCCTCGCCGCCGGCGGCCGGCTGGGCTTGCGCCGGT
TGGGCTTTCGGCTCGGGCGCCGGCTGGGCTTGTGGCTGTGGCGCGGGCTGCGCCTGGGGTTGGGGTGCCG
GTTCGGGTTTCGGTTCGGGCTTGGGGGCCGGCGGGGGTTGGGGCGCGGCGGGGGCGGGCG
>paratb_18564
GTCACCGACTCGCCCAGCTCGGGCATCAGCACCGGGGTGGCGGCGCCGCCACCGGACTCCTGTGGCGCCG
GCTGGGCCGGTGCCTGCGGCTGGGCCGGGGCCTCGGGCTGGGCCTGGGCCGGTTCCTGGGCCTGAGGCTC
GGGCTGGGCCGGTGCTTGGGGCTGGCTCGGCTGGCTGGGGGCCTGCGCCCCGCCGCCGGC
>paratb_18590
GCGTAACCGGGTTCTGTGCTCATCCGCATCACCCTAACGGTCCGCCGGTCGCGGCTGGCTAGGGTGAGAA
GTCAGTGTCAGGGTGAGGTTGCCGCGTGTTGCGGTGGTTGGATCCTGATCACCTGGTGTCTGGCTCGTAG
GGTGCTTGCCGCGTTGGGGTTGGCGTTCATGCGTTTTGTCGACGCCAGGTGTGAAGGACC
>Contig16_18592
GGGGCATGCCGAGGCGGTGATGTGGGCCCGGGAACGCTTCGGAACCGAGGTGGTGTGGGCGATCGAGGAT
TGCCGGCATTTGTCGGCCCGGTTGGAGCGTGACTTGATGGGCTTTGGCCAGTCGGTGGTGCGGGTGCCGC
CGAAGTTGATGGCCCAAACTCGGGCGAGTGCACGCACGAGGGGTAAGTCTGACCCGATCG
>paratb_18593
ATGCGTTGGCGGTGGCGCGGGGGTTTTTGCGGGAGCCTGATCTGCCGGTCGCTTCTCATGACGAGGTTTC
GCGGGAATTANAGTTGTTGGTGGATCGTCGCGAAGTCCCTGTGGCGCAACGCACTGCGACGATCAAACCC
GGCTGTGTGGCGGGTGCACGAACTCGATCCCGACCACGCACCTAAGGCTGGTTCGCTGGA
>paratb_18594
TCTGGCCAAGCATCGCCGCATCCTGGGTGACTGGCTGGTCACGGTGCCCGGCCTGGTCGCCGAACTCGCC
CGTGACGAGCTGGCCGACATCACCCGGCTCACCGAGACCATCAACGCGTTGGCCAAACGGATTGGCGAGC
GTGTCCGCGTTGTGGCCCCGGTGCTGCTGTCTCTTCCTGGCTGCGCGGAGTTGACCGCGG
>Contig16_18608
TCGCCGACACCCACGGCTGGATGACCCGGCTCGGCTGATTTGCGGGCTCGCGGCCTGCGGGCGCCGGCTG
CCCGCGACTGTCGGCGCCCCGCCCGCGACTGTCGGCTCGCCCGCGACTGTCGGCTCGCCTGCGAGCGTGA
AGTTAGTTTCACGCTGGGCTCCGACCGTGAAGCTAGTTTCACGCTCGGCGGGTTGCTGAG
>paratb_18700
CTCCGGCGCGGCCGAACAGCTGCTCGCGCGTTGGGTGCGGTTCGGTCAGCAGCTCTGACGCCCGCAGGGC
CTGCTCGCTTGCCAGCCGGGCCGAGCGCGCCGCCGCCGCCCACGCCGCCCAGGCCCCGGCCGAGCGCAGC
GGGGAGGCCCAGCCCGCCGCGTCCGGGGTGCCCTTTACCCGGACGATGCGCACCCCCGGG
>Contig16_18728
GACACCCTGGCCGCCCGGCTGGCCGGGCTGCTGGGCGACTAGCGGCGGCCAGCGGGCCGGGCCGCGCCGC
GGCCGTCACGCGGGGCCTCGAGCGTCACGCCAGCGTGACGCTCGCGCGCCGGCGCCACGCCAGCGTGACG
CTCGGCGCCGAAGAGCCGTCAGAGCCGTCAGTCCTTGGCGTAGATGGCCTCGAGGTCGGA
>Contig16_18748
GTGCTGACCCCGCACCTGTCCGGCGAGCCGATCGGGCCCAAGGCGCTGGGGCGCTGCTCGACGCCGCCC
GGCGCCGGGGCGGGGCCGCGCCGCCCGGCCCGCTGCGGCCCACCGTGGACCTGGAATCCGGGACGGGACT
TGGGTCGATCTACCGGATGCGGCTAGCGTTGCCGCAACTCGACCCGTCGGCGCTGACGTT
>Contig16_18833
CCTGCAACGAACGCAAGCACCGCAGGCGACCGGGAAAGGCGATTGATGAGAGCAGAGCGCGAGACGGCGA
AACGGCGCGGCGGCAGCGATCGTCGGGGCGCCCGCGACGGTGCCGCCCGCCGCGGCAGGCGTCCGGCGGC
CGACGCCGGCGCGGCGCGGCGCGCCCGCGGTGGCCGGGCCTCGGCGCCCGCCCGGGAATC
>Contig16_19342
```

Figure 6-90

```
CCGTCGAGCAGCACCAGTGGCAATCGCATGCCGGTTATCTTGTCACGCCGCGTGTTGCCAGGCCGTCGAG
CGTCGAGTTGTTGCGGCCCGTTCTCGCTTACCTTCTAGCGCTGGATGCAACAGCCTCTAGCTGAGGGGTT
GTTGATGAGGTCGTCGCGGTATGCCGTTGTGGGTCGTCGGTTCTGGGAATTGGTGCGGGC
>paratb_19343
CGGAATGTCTGCGGATGACGCTGGGGTGGCTGTCGGCGTGTCGATGGCCGCAGGGCGGCTCTGGTTTGCT
GATGCTGGCGGAGTGAGACCACGATTCGTTGACCAGTCCATCCCGCGACGGCGTCCTCGGTTGACGGTGG
AGGAACGCGAGGAGATCCAAGACGGTGTGGCTCGCAGCGAGTCCATCCGTGTGATCGCTC
>paratb_19344
GCCGACTGGGCCGGCATCCGTCGACGGTGATGCGTGAGATCGAGCGCAACGCGATCTGTCGTGGCCGGTA
TCGGGCGCGGTATCGATTCGGGGTGCGCTGGCGTGGTGGTCACGATCCCCGGCCGCGATATCGCGCCAGC
TTGGCGCACACGCGTGCGCACGTTAAGGCGCGCCGTTCGCGGCCCGGCAAGCTGGCGACC
>paratb_19345
AATCAGCTGCTCCACGACGAGGTACAGACGCGGTTGAATGAGCAGCACAGCCCGCAGCAGATCGCTTGGC
GGCTGCGGCGCGACTTTCCCGACGATGCGGAGATGTGGGTGTCTCAAGAGACGATCTATCAAGCGATTTA
CGTTCAGGGCAAAGGGAATTTGCGACGTGAGTTGCACACCTGCTTGCGTACCGGCGGGC
>Contig16_19346
CCTGCGCAAGCCTCGGCGTCGTCCTGGTGAGCGTCGCGGACACCTGCGCGACATGGTCAACATCAGCGAG
CGCCCCCTGAGGTCGCCGACCGCGCCGTGCCCGGACACTGGGAAGGCGATCTCATCCTGGGTAGCACCG
CGTCGGGTTCGGCGATCGGCACGGTGGTCGAACGAACGACGCGGTTCGTGATGCTGCTAC
>paratb_19348
AACACCAACGGGCTGCTTCGCCAGTACTTTGCCAAGGGCACCGACCTCTCGGCGTTCCCGGCCGACTATC
TCGACTACGTGGCATCCAAACTCAACCGCAGGCCACGACAGACACTCGACTGGAAAACACCAGCCGAAGC
CCTCGATGAATTACTCTGCAAACCGTTCACACCACCGGCTGTTGCTTAGAGCGCTAGAAA
>Contig16_19364
AGCCCCCGCGGCTCCGGCGGGCGGTCCTGGTGGCCTGGGTGGTGTCCATGATCCGGCGCCCGCGCCAGCG
CCGGCCACTCCTTTCGGAGGCTCTGGTGGTCCGCATGATCCGGCGGCCGAGCCCGAGCCCGCGGCAGCCC
CCGCCGCTTCGGGCAGCCCGGGCGATCCGGCGTCCGTGCCGTCCGGCGGTCCGCACGAGC
>Contig16_19367
CGGCGGCAAGCCAAGTGGTGATGGGGACGGCCATGGCGGTCCACCGGACGGCAAGGATCCTGATGGTCAT
CACGTGTCGGGGCACGGCCATGATGGATCATCCGGCGGCGAGCCGCAGGATCCAGTGCATTCGAAGGATC
CGTCTGGCGACGGGTGGCATCGGCTGCCAGATGAGCCACTTGACCCGCATTACGGCGAAC
>paratb_19368
CATTGGACGAGCATTGGGATTTCGCCGACGACCCGGTCGATCTTGACAAGATTAATAGCGACGTCCGCAA
TCTAATTCGGGATCCGGAAGCGCTATACGGCCGAGATCCGGAGGGGCATCCGTATACGCAAGAGCAATAC
GCGGAACGTTTCAACAGCATGGGCAGTGAAGGTCAACATTGGATGAGCTTTCCCGGCAAT
>paratb_19369
CACGGCGCTGTCCCGCAGACGCGTGTCGCTTACACGGATGCCGCATCCTACTTGCGGGATTATGGTCCCT
TGCTCGATCGCATCGGCAAGACAAACGGAAAGTACTTGGCAGTTATGCAGGATGGACAAGCGGCATCATG
GGAGCAGCGAGCCCTCCACGTCAACTCCCTTCAAGATCCCTACCACGCTTATACCTTTGA
>Contig16_19370
ACACCTACCGGACAATTGGACTATCGAAGTGTCGGAGGTCGCGCCTGGGGTGGGTCAACCGGGTGGTTCC
TTGCAGGTACGCGTATTCAACTCAGAGGGTCGGCCGATGACGGTTGAAGAGCTCACTGAGCCTGACATTG
GAGTGTTGAGATGACAAGCGGCATACAACTTTCCCAACGCCTTGAGGAATGGGCGAAGCT
>paratb_19499
GCCGGGCCCGCCGAGCTGCGCCAGTTGTGCGACGCGCTGATCCAGGCCGCCCGAGCCGCCGACGGCTGGC
GCCGCGCCGGTGTGTGACAGCCTCGTGCCTGCCGCGCCGCCCGCGCCGGCTCGGCGGCCGAACCGGCCGC
GACCCGCGCCTGACCATGCACGACGGGCGGCCGGGTACAGTCGCGCCATGGACCAGGGGC
>Contig16_19753
```

Figure 6-91

```
GCGGTCCCGCCCGCGCCCGCTGAAGGCCACTACATCGCCCAAAGCCTGTTCCGCTGAGCAAATTCCGCCG
CGCGGCGCGCGGCGGTAACCGCGCCGCCGGTGGCCGGCGCCGATGTGGGCCGGCTCACCGCCGCAGCAGG
CCGGCCCGCCGTCACGCGTCGGCGCCCGCCGAGCACCAACTCCGTGAAGCCGCACAATCA
>Contig16_19777
CCGTCGGGGGCAAAGCCCTCGGCGGCCACCACGGACAGGGTGTAGGCCGCCAGCGCCGCACCGGCCAGCA
GCACGGGTTCGGCGGCGCGCGGGCAGCGGCACGCCAAGCAGTGGCAGCGGCGCGGCGAAAAGCCTTCG
GGCCCACCACAACAGCACCATTTCGACCGCCGTCACCGCGCTCAGGACGGCCACCCATTC
>Contig16_19892
CCGGGGATTGTCGAGGGCCAGACGCAGTCACGCTCGAGCACAAGCACTTTCAGGCCAAGCCGGCCGAGCA
GGTTGGCGGCGGTCGCGCCGGTCGGCCCGTACCCGATCACCGCTACGTCATAGATGTCTGAAGTGGGCAC
GGTCGTCTCGCATCGTCGAGTGCTTGTCCTGTAGTGATCGCTACGGTGATGTAGTGATCA
>Contig16_19893
CTACGGAGTCAAGCACCCCGGGTGAGGAGAGCGGAGATGGCGGCCACGAAGCAGCCGAAACGGCGCAAAC
GCGCCGACGGTGAAATGTCGCGTGAACGGATCCTCGACGCCGCCACCGAGATCGCCGCCGAGCGCGGTTA
TGAGGCCACCAGTATCGGGCTGGTCAGCGCGAAGTGCGGCCTGCCCGCCAGCTCCATCTA
>paratb_19894
CTGGCATTTCAAAAACAAAGATGACCTGATCGCCGCGGTCATCGAGCGCAGTTTCGCCGACTGGCGCAAG
GCGTGGCAGGTTCCCGACGAAGGCGCCCCACGCGACCGGCTGGCCGGGCTGGCGATGCAGATCGCCAAGG
TGCTGATGGACTCGCCCGACTTCATCCGGCTCGGGCTGATGCTGGCGCTGGAACGCCGAC
>paratb_19895
CGGTCGAGCCGCGTGCCCGCGCGATGTTCATCCAGGCCCGGGCCCAGGCCTATGACGAGCTTGCCGACAT
CGTGCGCGAACTCGCCCCGGGGCTCACCGACAAGCAGATCGACCAATTGGTCACTTATGCGATCGCCGGC
GCCGATGGATTGTTCATCGCCAGGGAGATCGGTGGCGATGCGGTGAACCTGGTGGGGCTC
>paratb_19896
TTCGAGCTGCACGCCGGAGCGTTGTACGACGCGGCGCTGCGGATGATTTCGGAGAATGCCGGTCAATGAT
GCTGAGGCATAACGCGATCCGCGAGGCGGCCGATCTGCTACACGACGCGCAGCGCACCCGCAGGCCGATC
GGGCCGCTCACCGAACGCTTCCCCGGCCTGGACGTCGCCGCTGCCTACGCCATCCAGCAG
>paratb_19897
GCCAACCTGAATCGCCGGACCGGGGAGGGCCGCCTGGTGGTCGGGCACACAAGCTGGTCTTCGACGCCAC
CTCCGCCACCGCGCATCGTGCCAACTGGTCCAAACTGGTCAGCAGTGGGCGTGCGCGACGACGCCTGATC
GCTGGGGACCGCGACTTAGAGGAGCGATACGGCCACGCCGACGCTGGCCGGGCTATCAAT
>paratb_19899
CCGGCCAAGTCGACGAGCCGGCTTCGATCGCTGGCGGATGCATCTGCTGCCTGCCCGACGGCGGTGGGCT
CGACGAAGCACTCGGCAAGCTCGCGGACCCGGCTCTACGCCTGGATGCCATCGTCGTCGAGGCCAGCGGG
TTGGCCGACCCGGTGGCGATCGCGCGGCTCATCGGGTTCAGCGAAATCCGTGGGGTCCGT
>paratb_19900
CCGGGCGGGTTGGTCGACGTCGTCGACGCCGTGAACCACTTCGACACCGTGGATCGTGGCCCGCTGCCGC
CGGTACGCTACGGTGCGGCCTCGCTGATCGTTGTCAACAAGCTCGACCAGGTGCCCGAGCGAGAACGGTC
GGTCGTGGTGCAACGCGTTAGAGAACGTGCGGCGCAACGCAATCCGCGCATACATGTGGT
>paratb_19901
GGGCACAATCGGAGGTCGGATAGCCCCGGAGCTGCTCTTCGACGCGTCCGCCAGGCCTGAGCAGATTGGG
CAGCTGTCCTTTGTGGACCTGGTGCCCGAGCACGAGCATGACCACGTCCATGCGGACGCCGTCACCGCCC
ACAGCGATGGCTGCATCGACCCCGATGCCCTCCTCAACCTTCTCGAAAACCCACCGCCGC
>Contig16_19902
AGGTGTTCCGGATGAAAGGCGTCGTGGCGGTGCGGCAGCGCGCGACCGTGCGGAACTATGTCGTCAACCT
GGTGGGTAGCGCAATCGACATCGCCAAGGCGCCGCCGAAGGCCACGGCCAACCGTCTGGTGGCCATCGGG
ATGCATCTCGACGTCGCCGCTGTGGGGGCGCGACTCGATCGCGCGCTGCAGCCGGTCTAC
```

Figure 6-92

>paratb_19903
GGTCCGGCGTCGGGGCAGGCGTCGCGGCGGCTGCAGCGATACCTGCGGCTCAGCGCCTGAGAGGCGATCC
GGCAAGATACGTCGTGATGTCATCTTCGCTCGGCGACGTGCTCGCCACCTTGGAGCTCGAGAGGGTCGGC
CAGTGGCGCTTCGTCGGGCAGCAGCTTCCGGCGCCCGCCAATCATATTCTCGGCGGGCAC
>paratb_19922
GAGGGCGAAGCGGGCGGCCACCTCCTTCGGTACGTGCTGCCCTTCGGGGATCAGCGCGGACACGCCGGCG
ACGCTGTCGGGAGAGGACATCAGCGAAGCCGATCCGGGCGGGCCGTAGGACGGCACCATCACCGGCGGAC
GTCCGAGCCGGGCGCCGATGGCATCGCGCACGGCGAGGGCGGTGACCTTGACCGAACTCA
>paratb_19923
CCGGTGGGATGGCGAATGAGGAGGCGAAGCCGTCGGTGAATGGGCACTGCGAGATCGCGGCGGCGATGCG
CTTGTCCTGGGCGGCGGTGATTATGGTGTGGCCGCCACCAAAGGAGGTGCCCCACACCACGACTCGGTCG
GGGTCGATGCCATCGAGGGTCCGCGCGTAGGCGACGGCCGAGCGCCAGTCCTGCAGTTGC
>paratb_19924
TTGTCGATGTCGAGCAGTTGGCGCGGTTCGCCGGAACTCGCGCCGAAGTGGCGGTAGTCGAAGACCAGGC
AGACGTAGCCGGCAGCGGTGAACCGCTCCGCGAAGGCATCCAGCCGCATCTCTTTGACCCCCGCAAGGCC
GTGCGCCATCACGATCACGGGCCGTCGATCGTCTGCGGAGTGCGAGGAGGGTGTGTAGAG
>paratb_19925
CCAGGCGGCACAGGTGCCGTCGGCCGAGGTAAAAGTGATGTCGCTTCGAGTCATGACGCCCACAGTAATG
GAAGGGATACAAACATTAGAAGGCCATCCAACTATTGTATGGGTTACAGTTCTGGTGTGAACGCCGCCGC
TCCTGCACCTGCGCCGATGACCCGCACCCAGCAGCGCGCTGCCGAAAATCGCCGTACGGT
>Contig16_19926
CATCGACGCTGCGCGGGAGATCATCGCGACCCAGGGCGTCGAGGCCCTCACTCTTGAGGCCGTCGCCGAA
AAGGCCGACGTGGTTGTGCAGACCATCTACAACCGCGTCGGCGGGCGCTCCGCTCTACTGACCGCAGTGG
CCGAACAGGCACTCGAACAGAGTCGCGTCTACATGGATCCGGCCTATGAGGCGGACGGCA
>paratb_19927
CCGTGGAAGAGCGAATGATGTTGGCGGCCAACGCCTATGCGCGTTTTGCGCGCGAAAGGCCACACGAGTT
CCGGATTTTGGTCGAGCCGCCGAACGAACCCGAGGCTGTCGCACGCATCGCCGAGCTCACCCGTGCCCAG
AACGCACGCCTCACTGCGGTGCTCCGCGAAGGCATGGCCGCCGGTCTCATTCGCGCAGAC
>paratb_19928
CTCGATCCCGACGACGTCACCACTGCACTGTGGGCAACCTTCAACGGGCTACTCGCACTGGCCTGGCGTC
CCGGGGGGCCTTCAGGAAAGCCACGAAACCGTCGACCGCCTTCTTGCCGCGTACATCGCCACGGTGAGTG
ACGGCCTGCGAACCCGCTGATGCCAAAACCATTGGAATCCCGTTCGGTGCCACCTGCCGG
>paratb_19929
AACCGTCGAATGGCGCTACCAAAGCAGCCGCTGAGTCCTGCGGATCTACGGCCGCAACGTAAAGCCGGTA
CGGTGCGGCAGCCGATCCAATAGACAGGACGATCGCATGGAATACGGTGGAATCGAATACTGAGGGTTAC
CAGTCAAGCCCGTCGTATTGCATGGTGAATCAGAGCCCGCCCCCTGCCGTCGCCGAACT
>Contig16_19931
TTCGTTCCCGGGCTGCGCGGCTAGCCCCGAAAATGCGGAAGAGGACGGTGGGCATGGAGCCCGTTGAGCA
GGATGGCCAAGAGGACGAAACACCAGGCGACACCGAGCGTCGCCGCCGCTTCACGCTGACTCGGCGGAAC
GCATTGCTCGGCATGAGCGCGGTTGCCGGATTCGCCGCGGTGGACGTCGGCGGGTTCGCC
>paratb_19932
TACGCGGGCGGGTGGCTGCGCCCCGACTCCCCGCTCACGCCGCCGCGGTTCGCCGATCGCTTCGAGCACG
TCTACGGCCGCCACGACGGGTTCCGGCGAAATCACGCCAAGGGCCTCAGCGCTACCGGGTCGTTCACGAG
CACCGGCGCGGGCGCGGCGATCTGCCGGGCGGCGGTCTTCCGGGAGGGCACCGTCCCGGT
>paratb_19933
CGTCGGCCGGTTTTCGCTAGGCGGGGCCTGCCGGACCAGGCGGACAAGCCCGAGACTGTCCGCGGCCTC
GGGCTGTTGTTCGACGCGGGTGGCCAGCAATGGCGCACCGCCATGGTCAACGTGCCGGTCTTCACCGATA
GCACGCCGGAGGGGTTTTACGAGCGCCTGCTCGCGACCAAACCCGTGCCCTCAACCGGGA
>paratb_19934

Figure 6-93

```
AGCCCGACCCGCAGAAGATGGCCGCGTTTCTCGATCGTCACCCCGAGACGGCCGCGGCGATGAAAATCAT
CAAGCAGTCGCCGCCGAGTGCCGGGTTTGCAGACACCACGTTCTACGGGCTCAACGCCTTCTTGTTCACC
AACAGCGCCGGCGCCACCGTTCCGGTGCGGTGGTCGGTAGTTCCGCATGACGGCGGCGTG
>paratb_19935
GCCGGCGCACCGGGGCCGACGCGTGGCAAGGACTTTCTTTTCGACGACCTGATCCGCACGCTGGCCCAGC
GGCCGCTGAAGTGGCGGCTGATTCTGACGCTGGGTGAGCCCGGCGATCCCACCCACGATGCCACCAAGCC
GTGGCCGCAATCGCGGCGCACCGTCGACGCCGGCACCGTCACCATCACCGCGGTGCACAC
>paratb_19936
CGAGGAAGAGGGCAACGCGCGCGACATCAACTTCGACCCGCTGGTGCTGCCCGACGGCATCACGCCGTCC
GACGATCCGTTGCCCGCGGCGAGGTCGGCCGTGTACGCGCGGTCCTTCACCCGTCGCGCCGAGGAGCCCA
AGTCGCACAGCGAGGTCAACGTGACGCGGGTGCTGCCATGACCAGCGAGACAAACGAAAC
>paratb_19937
AACCACGGCCCCAATGCGTTTCGCCCTCCCGACGCGCATCCTGCACTGGCTGATGGCGCCGATGGTCATC
GGGCAGCTGCTCATCGGGGTGGTCATGATCACGTCGTTGACCTACTATCCGCTGCTGCTGGCCATCCACC
GGCCGTTGGGCGCCTTGATCCTGGCGTTTGCGGTGGTGCGCCTGGCGAACCGGTTCACCC
>paratb_19938
ACCGGCTGCCGCCCTTCCTTGCCACGATGGGCCCCGTCGAACGCCGCGTCGCGACATGGTCGGAGTACCT
GCTCTATGCCCTGCTGCTAGCCCAGCCCTTGATCGGGTGGGCGATGCTGTCGGCGGCGCGGTTCCCGGTC
GTCTTGGTGGGACCCGTGCATCTGCCCGGCATCGCACCGCACAACGTCGACGTCTATGCG
>paratb_19939
GCGCTGCGCCAAGCCCACAACGTCGGCGCCTTCCTGCTTTTCCTGACCTTCACGGCCCACGTCTGCGCGG
TCCTCTTTCATACGCTCGGCCTGCGCGACCGGCTCCTCGATCGCATGGCGCTGTGGCCCACCAAGCCCGT
CGCCTCGCGGCAGGACGAAATCAAGGCGTGACGGCCGGCCTCGATGCCCCTCAACACCTC
>paratb_19940
ATCGCCGGCCGAGTTAGTGCGCCAAAAGGGGCGACCTCTCCCCCTCCAGGCAAAAGCACGGGACCCCGGA
TATGGCGACCATCGCGAGTAGTTGAGCGCGATGATCAACGAGCCCCATGGTGTGTGAACGTAAACACGCC
ACCGGGCGCCCAATTAGCGGCAGTCACGATCGAGCGGACAGGCATGTAATCCCCACCCCC
>paratb_19941
TATCGACCTCTTCGCCACCATCTTCGATCTCAATCCCGTCCATGCTGGCCATCCTCACCGCCATCACTGA
CAAGGCAGGCCGGTTTTCGCCGCAAAGCTGGCTGGTCCTCGGAAATGCGATCAGTCCTGTTTGAGGGCGT
GTAAGGCGGAGAGGGGGCCGCCACCAACCTGCATGAGCCGACCGCCGTCTCGGAGGGGCC
>Contig16_19958
CTCGGGCTCGCCGATACCTTCAACTTGCCAGTCAACTGGGGTTGAGCTGAGGGTAAAGCCCCATACCGAC
CGCCGAGCGTGGAGTTGTTGGCGTTGAAATGGCCGATTCGGCACAACAACTCGACGTTCGGCGTCAGGGT
CCGAGGTGCCGCTCGGCGAGCTTGGCGAACGTCGCACCAGCCGGTTGCGGTCCCCGTGC
>paratb_19959
GTCGGCCAGCGTAGGACTTCGGTCCCCTGTGACGCACGAGACATAGTTAGTTGGATTAACCATTTCGTCC
GTGCGGGTAGACGAGATGGCATGAACGCGAAACTTTCGAAGCTCACACCAATTCTCTTCGCCGGTGTCGC
TGCCGCAGGAATCGCAGTCGCACCCTCCGCTTTCGCCGATCCGGAACCCCCGCCGCCGGC
>paratb_19960
CCCTCCGGCTCCCGGTTGCTATAACCCTGACGGCACCCCTGCACGCCGTCGGCGGGCCCGCAGGGAGCC
GGTGCCGAAATTCCGGGCGGCCCAGGGGCGTTGGCGCGCTCCGATGGCCACGTCTCGGCCGGAACCCCGG
TGGCCCCTGGGCTAAAGCGGGGCCGGGTGGAGGAATCGCGTGCGTACCAGGCGGTCCGTG
>paratb_19961
CCGAACCATCACCTTGCCCGGATAACGCTTCATTCACTTCACGTTCGGCGCGAGGGGCGACTGTCGAGTC
ACCCCTTGCGCCGAACTCGTCTGAAGGTGCGCTCGGACCGTTGACGCTGGGACGAGGCAAAACCTACAAA
CCGTTCGCAACCCCTGAAAAGCGCCTCATCCGTGCGCGGTCGAGCGGATCCGGTCCTTAA
>paratb_19962
```

Figure 6-94

```
CTCAGTGTCAAGATCGTGCCCACGGCGACGCTGATCACCACCATGATGGACACCAAGATCACCGTTATCG
ACGCGCCCACGATCTCTTCTTCCGTGAGGCGCCAGCGGGGTTTGTCGGCAAGAACGGTGCGCCTTTGGGG
CGCAAACGCGTTCATTGCCGCGACCGCCAAAAGAAGATCGTCCGCGTCGTCCGCATCCTT
>paratb_19963
CTCGATTGCCTCGTGCGCGGCTAATGCGGTCGTCATATGAACCCCCAGGATTGCGGTCGCCAATAGGCGT
TATCTCGTATCTCCACGCTAAGAGTGCGAGATCAAGATTGCGGCAACGCTCCTTAACGGTCGCAGCACAA
CGTCCATGCTCTAGGAGCAATGGACCATGCGCAGCGCTTGACGTCTCGCCGCCAGTCCA
>paratb_19964
CGCCGCGATCAGCCGCACGGGCAGGTGCTCGTGTCGGTGAATCGCCCGTCGACTGGCCCACGCGAATCGC
GTCGCCGCCAATTGTGTTGCGATGGCAGCTACTTGGTCCGCCGATAAACCGAAGTAGATCTCACCGTATT
GGGTCGGGATGGGCTCGCCGGGCATTTGTTGGGGAGCCGATAGTGATCGGCACGCCGGCG
>paratb_19965
GCCGACAGCAGGAACTGGATGCCGTCGATTGCCTTGTCGACCGAGCCAACTTGGTAAAGGTCACCGCTGT
TTGGCCTTTCTCTGGCCGGCCGGTATCCGATCAAGACTAAAGCCAGCCGCGGGTGCGGCGGCTGAGAAAT
AGCAAACGCGTGCTTGGGTCATCCCTGTCCGGCACCTTCCGCGACGGTGAAGTAGTCGCC
>paratb_19966
GTGCTCGAGGTCTTCCAGCAGCGTGTGGTGGCTCGGGTTCCAGCCGAGCAGCGCGCGGGTGCGCGCACTG
GAAGCCGGCACGTCAGCGGCGAAAACGGAGCTCAGCGCCGCGCTCCCGAAATGGGCTGGCGCGTCGTCCA
ATTCGACCGACACGACCGGCAGATCAAGCTTTCGACCGATCTTTTCGGCGATGTCCCGCA
>paratb_19967
GCGGCACACCGCTTTCCGCCGTTCCGTGCAGCGCAGTTCCGGCCGGCGCCTTCTCCAGCGCAAGCCGAAA
CAGGGTTGCCGCATCGAGACGGTGGACCGCGGGCCACCGGTTGGTCCCGTCCCCGATATACGCCGAGACA
CCCGTTTTGCGGGCGGTCGCCACCAACATCGCCACGAACCCGTAATCACCCGGGCCGTGC
>paratb_19968
ACAGTCGGGGCGAGCCGGATCACGCTCGAGCGCACTCCCCGCTCGGCGTACCCCAGACAAGCCCGCTCGC
CGGGGATCCGGTACGCGGCGAACGCGTCGGGGTCGGGCGCGTCCGTCTCCTCGCTCACCCGTCCCGGAGC
CATCACCATGGTCCCGGACGTTGACACGAACGGTTTGCCGGTCCCGGCCAACGCGGCCCC
>paratb_19969
CATGGCCTCGATCGCATCGACGTCGCGTTTGGTGATGCCGGACAAATCGCCGGAGTCCCCACCGATAGCC
ATATGGATGACGCCGTCGGCGGCTGCCGCGCCCTCGCGCAGCCGGTCGAGATCGTCGAGCGAACCCGTGA
ACGGCTCTGCTCCCAGGCGAGCCAGGCGATCTGCCGAGGCGGCCGAGCGGGCCAACCCGG
>paratb_19970
TGACCCGGTGCCCCGCAGACAGCAGCTCCGATACGACGGCGGGCCCGGTCAGGCCCGAGCCTCCAGTGAC
GAACACGTGCACGAGATTCCCCCTCGAAGCTAAGTGGAGCGCGTTCCGATTAGCTGACGAGAGTACATAA
CCGGAACGTGTTCCGCTAGAGTGGCCTGCGTGGCTCAACCCGTTCGCAGCGACGCGGCGC
>paratb_19971
GCAATCGCGAGGCGCTCATCGAGGTCGCGACCAGGTTGTTCGCCGCGGCCGCCGGCGGCGACGAGCCCTC
GCTGCGGTTGATCGCCCGCGAGGCCGGTGTCGGGGTCGGCACGTTGTTCCGCCACTTCCCCACTCGCGAG
GCATTGGTCGAAGCCGTGTACCAGGACCAGGTGCGTCGCCTGACCGAAGGCGCCGATCAG
>paratb_19972
CTGCTGGCGAATCATCCACCCGCGCAGGCCATGCGCCGCTGGATGGATCTGTTCACCGACTGGTTGGCCA
CCAAGCACGGCATGCTCGGCACCCTGCGGGCGATGATCAATAACGAGCAACTCGGCTCTGGTCACACCCG
CATCGAGTTGCTGGCCGCCATCGATAAGATCCTCGCGGCCGGTCGCGCCGCGGGTGACAT
>paratb_19973
CGGCGACCACATCAGCTCCGAAGACGTCGCGGCCGGCCTCATCGGCATCTTCACGGTGGCTCCGACCGGC
GGCAACAGCGAGCAAGCCACCCGGTTACTCGACATCTTCATGAACGGACTCTCGGCACCCCAGTCGACCG
TGCACACTACGACGAGCACGACGGACAACCCGTAGCCCACGCGGGATCGAGCCCGATCGA
>Contig16_19974
```

Figure 6-95

```
AACGCGCGCCAGCAAATGCCAGGGTTTGAAATTCCACGCTTTGGATAGACCTCGCTTCAACTGCCGCTCC
CCGGATAGCGGCACATCAGGAAGGGAGCCCGACGTGGCGTTCTCACACATTGCATCGAAAACGACGGCAG
CGACGGCCGCGCTGGCGGCGGCCGGACTCCTCGCCGCGGCCCCGGCATTCGCCGATCCGC
>Contig16_19975
AAGTCCTGCAATTCGGCCAGATGGCAGAGATTTCCAGCAACGGTGGCACCATCGACTACACCGTGAGCAA
CCTGCAACCCAGCGGCCACAACGACGGCGTGTGGTACTCCGACGTCACGGCCAAGGGTGTCAGTGGTAAC
GCGGTTCCCAACATTGCCGACTTCAACGCGCGGGCCGTCAACAGCTCCACGTTCGCGGTG
>Contig16_19976
ATGAAGGGCAACCAGACCGACGGCCTTCCCGAGGGTCCACTGCCCCTGGGCACCCCCGTCACGGGACGCC
TTTACTTCGACGTGCGCAACGGCACGAACCCCGACAGCGTCGTCTACCGGGACGCCGGAGGCACGGACAA
GGTGGTCTGGAAGAGCTAGCCGGTCGGGTGACCGCCTGATTCGGGCTACAGCCCGGACGG
>Contig16_20261
GCCGAATCCCGCACCGCGCGATGGTAGCAAAACCCGCGGTCGCGGTTTCGGGTCGTCGGCGCCGGTCAGC
CGGGCGCAGCCGGTGCGCCGCCGGGCGCGCCGCGCGCCGGCCACCGACCGGTCGGACGGAGGACGCCCAC
GAGCCAGTGGCATGATCTTTGCGTGTCGGACATCCCGGGAGCCGCCTACGCGCGGGACGG
>paratb_20370
CGCCGCAGACGTTGCCCACGCAACCGCCGCCGCCGCCCGGTCCGCCGCCGCCCCCGCCGACACCCGGGAT
GCTGCCGCCACCGCCGCCGGGGCCGCCGCCACCGGTCGGGCCACCGGGGATGCTGCCACCGCCGCCGCCG
GGGCCGCCGCCACCGGTCGGGCCACCGGGGATGCTGCCACCGCCGCCGCCGGGGCCGCCG
>Contig16_20399
TTCGGCGGCTGATCGGCTGGCGGCCCTTCAGGTCCTCAGCGGCGTTGTACTCGGGGTGAAGGTGATGCCG
CGCCTGCCGCGACATCCGGCGCCGGCGAGATAGCGACCGTCGATCGGAATGACAAGTCCTGGAACCCCTT
CGGGCCGGGCCGGTCACGCTGCACGGGACCGGGCCTGTCTAGCTCCAGCGATCTGAATTT
>paratb_20400
CAGATGGCTGATAGCTGAACTAGCTATTAGACATATGGATTTTGGGCGGCCATGGTTAGTACCGAGCTTG
AATTCCGATTCGCCGAGAGAGGACAGGGGTGAGGGATTGTGGCTGTATTTCGCGATTTGCGCGATTACAT
CCAAACGCTGACCGACAAGTTGGGCGGCGAGGAGGTCAAAACCATCCGCGGCGCGCATTG
>paratb_20401
GGACCTCGAAATTGGTTGTCTGACCGAGCTTTTAGCCGAAAAAGAGGGGCCGGCGCCGCTCTTCGACAAC
ATCGAGGGATACCCGAGCGGCTACCGGGTCTTCACCAACTTCATGGGGACTGTGCCACGCTGCGCGGTGG
CGTTAGGGTTGCCCCCTTGGACCCCGGCCATGGATATCGTCAAAGCTTGGAAGGACCTGA
>paratb_20402
GCAAGAGCATCGATCCCGTTGCGCCAGTGCTGCTTTCGACGGGATCGGTACTTGAAAACGTACTGGAAGG
CGATGACGTCGACCTGAACATGTTTCCGACGCCACGCTGGCACGATGGTGACGGCGGGCGCTATATCGGA
ACGGCGTGCATGGTCATCACCAAAGATCCCGATACCGGTTGGGTCAACGTAGGCACCTAT
>paratb_20403
CGCGGATGTGTGCAGGGCAAAGACAGGCTGTCGTTGTGGATGCTGGGCAATCGGCATGCACTTGCGATCG
CGCAGAAGTACTGGCACCGCGGTCAAGCCTGCCCCATCGCTGTGGTGGTGGGCTGCGATCCCATCCTGAC
GACCGCCGCCGCGATCGCCGCACCCTCCGGGGTCTGCGAGTACGACGTGGCCGGAGGCCT
>paratb_20404
ACGAGGTAGCGGTGTCGAAGTACTGGCCGCGCCGGGTACTGGCCTTCCCGTTCCAGCGCACGCCGAGATT
GTTCTCGAGGGCGAGATGCCCCGGTGGAGGAGGAGTCGGTTCCCGAGGGGCCGTTCGGTGAATGGACGG
GGTATTTCACCCATGCCGGCAATGAAACCGTGGTCCGGGTGCAACGCATCTTGCATCGCG
>paratb_20405
ATTCACCGATCATTTTGGGCGCGCCGCCGATGATTCCAACCGTCCCTGCGGGGACCAAGCGGTTCCGCT
GTATTCCGCCTCGGTGACCTGGATCACCTTGAAGCCTCTGGGGTGCAAAACATCAAGGGCGTGTGGGCA
TATGCGCGCCAGTTGATGATGGTGATATCGATCGAGCAGACCGGCACCGGCGACGCCATG
>paratb_20406
```

Figure 6-96

CATGCGTTGTTGGCGGCGGCGGGACGAAAGAGAACGGGCGGCATGGACCGCTACTTTGTCGTCGTCGACG
AAGACATCGATATCACCGACATCAATCATGTGCTCTGGGCGCTGTTCACTCGCGTCGACCCGACCGAATC
CATCCACGTCCTGCGCACACCGACAACGGCGATCGATCCGCGACTGTCGCCTGCGAAACG
>paratb_20407
CGATGCGGGTGACCTGTCGATGGGGATCGTGCTCATCGACGCGTGTAAGCCCTTCGCCTGGAAGGATTCT
TACCCGCGAGCTAACCGGTTCGACGACAACTATCGGGCCGCGATTCGCGATCGCTGGCAGGCCGCGTTGC
CGTTGTAGACACGATGACGACACAGACGGCCTTGATCAGACCAGTCAGGAGGTGACGATG
>paratb_20408
ATGGCGGGGATGCCGGAGGAGGTCGCTGCGCTTCTGCGCGGTTTCCCACGCATCGGCGCGCGCGAGCAGG
CGTTTGCGTTCTTGACCGTTGACACTGGCGGGTTTCCACATGCGGCGTTGCTGTCGCGCTGCGAGCTCGA
GCCTGGGCGGGACCCCCAAACACTGATGGCCGCCATAGCTAGCCGACAGACCCGCGCCAA
>paratb_20409
CTTGCGGCGTAGCGGCACCGCGGGGCTGCTCGCAATCAATGGCACTAGTTGCCACCACCTCAAGCTGCGA
GTGGTCGCCTCGCTCGTCGGTCGCGGAATACTCGGATGTGTGTTTGCCGTGACCGAACATAAGCGCGATG
ACATGGGAATACCCTTGCAGCCTACGCTATTTCGGACCTCGGCCGAGATCTCGGTGCTTG
>paratb_20410
AGGACTGGCCGCGTAGTCGGGCCATGTTCGACCGTCTCGCAGCGCTGCGCAGCGCAGCGCGGGAGGTCCT
ATGAGCACGCAACCGATACGAATCATCGTAGGGGTCACCGGCGCCAGCGGCGCGCCGTTTGCCGTGCGGT
TAATGCAGACGCTGCACGGGATGGACGACGTGGAGACCCACTTGGTGATGAGCGGGTGGG
>paratb_20411
CTCGGTCGAGTATTGGAATCGAAACACCCTATAGCGTTCAACAGGTTTCAGCGATGGCGGATGTCACCTA
CAAACTCGAAGAACAGGGCGCCGCGATCTCATCGGGTTCGTTTCAGACCGCCGGAATGATTGTAGTGCCG
TGCAGTATGCGGACGTTGGCAGCGATTCGCTACGGGCTGGCGGACAACCTGGTGTGCCGT
>paratb_20412
GCCGCTGACGTTGTTCTTAAGGAGGGACGACGGTTAGTCCTAGTGCCCCGTGAGACACCATTGAATACAA
TCCATTTGGAGAACATGCTGGCACTCAGCCGGATGGGCGCGCGGATTGTGCCGCCGATGCCCGCCTTTTA
CAACCGGCCGGAATCGGTCGACGACATTGTTGACCACGTGGTGGTCCGTGTTCTCGATCA
>paratb_20413
GTTCGGTATCAATGCCCCGCAGGCAAAGCGCTGGCAGGGAATGAAGTCGGCGAGGACCACCGGCTTCGGC
AAGAACTCAGCGATCCTGGCGTAGCTCGGCCGGTCGCCGAAGTTTAGTTGTCGCCGTGGTGGCGTGTTCA
ACGAAGGCACGAGCCGCTGGGCTGGCGGCTTGCCCTTCTGGCCAGATGATGCCTAGGCGC
>paratb_20414
CCGGGCGGATGATCGCTGACTGGCAATCCTATTACGTGATCGCTTTGCGCGAGGGCTGATTGAGGAACGA
GACCCACGCCCAGCCCCTTCGCAACGAGCGCAACGAGTACGTCGGGATCGCCGGCTTCGAAGGCGATGTG
GGCTTGAACGCCGGCCCGCCGCAGCGCGCGGTTGAGTTGCCAGCGCAAGCCTGATCCCTC
>paratb_20415
CGGGAGCGTGATGAGCGGTCTATCCGCCACGTCGGCCAATGTGAGCTTCCGGCAAGGAGATAACGGATCG
GACGGTAGAAAGATCGCGATCACCGGCTCCCGATGCAACTCGCGCATCCGCACGCCGGCTACTGCCTCAT
CCGTCAGGCTGGTGAAAGCTACGTCTAAAGCGCCATTGGATATGTGGCGATTGAGCATCG
>paratb_20416
CTGCAGTGTCCTCAACCAGCGACAGGTCTACCCCCGGGTGCTCATGGTGAAACGCTGCTAGAAGCTCGGG
GAGGTCGATGCTGCGCGGTGAGATCGAGGTGATGGTGCCGATGGCAAGGCGACCATGTAGTAGACCGGTG
AGTCCGTCGATCGAGGCGCGACCTGCGGCCAGCGCATCGAGTGCTGCGCGGGCGTATGGC
>paratb_20417
AGAAGCGCGTTTCCAGCCGCGGTAAGCCGTACCGTGCGTGGCCGCCGTTCGAATAGCTGCTGCCCGATTT
CGCGTTCGAGCGCCTTAATGTGTGCACTAACACCAGATTGCGCCAGATGTATCCGCTGTGCCGCGGCGGT
GAAGGTGCCTTCCTCGGCGACCGCGATAAAGCACTCCAGCTGATGAAGATCCATGCTGAC
>paratb_20418

Figure 6-97

CGAAAATCTATTACAGAGCATCGTCTCGTCGCGCAGGGCATCTAGTAAGCCGACTAGCCGCAATCGCGGG
CGCGCTCCACTGCGGTCGCTCCGCGTCGAAATCGGTGATCGGTACCACCAAGGGTCACCTTTGCGAGGCG
CAAAACGTCGGGATGGATGAGACGGCCTACGTACCGTCTCGACAGAAAACGCATCAGAGA
>paratb_20419
AAGTAAATTGCCATGAGCGTACAGATAGTCCGATTCCGCATCTCACCGGAACACATCGCACCGGTAACGA
AGAAGATCGAAGCGATCTTTAGCGCATTGCGCGAGGCGGATCCCCCTCCTTCCATGCGGTATGTCGCGCT
GCGCGATGACGTCGACCCGGTATTCACGCTGATCCTCGAACTGCCCGAGGGTGCTGCCAA
>paratb_20420
CCCGTTGTTGTCGATTCCCGACGCGTTGGCCTTCCGCGAGTCGCTAGCGGGATGGGCGCATGACGATGTT
GCTCCTCGGCCCACCACCGTTGTCGGGAGATACTGCGCATGACCAAGGTGCTGTTCGCAGCCACGGTGTT
ATGCATCGTGGCTAACACATTGATCGCGATTGCCGACTACGTTCCCGCAGGCTTCGTGCT
>paratb_20421
GAAGAACTCTGCTGAAGTTCATGTTCCTGCCGCCGCATTGCCCTACCTTGCGACATTGAAGTTAGCGGGC
GCGGTGGGTCTCACCCTGGGGCTAGTCGCCCTGCCGCGGCTAGGCGTGGCAGCGGGAATCGGCCTGGTGT
TGTTCTTCTTTGGCGCGGTTGGTGCGCATGTCAGGGCCCGCGTGTTCCACAACATCGCGT
>paratb_20422
TTCCAGGCGCATTTCTGCTTCTCGCACTCGCCGCGAACGGCTACCTCGTCCATCTTGCGAGCGGCGCATG
AAACGCGTTGGACACTGAGGGTGGGGGAACCTGCTGGTTCCCCACTGACCTCGGAAACGGCGGGCAGTC
GCTCGCTCTTACTCTGAGGTCCACGGGCGCGTAGAAACTCTTCAGTGAGAATCCGGTTGT
>paratb_20423
ACCGTTCCCCTTTTCCGTTATGACGCGGAATGTAGGGCTTGACTTTCTGGTGGCGCTCGAACGCGATGCG
CACTACTAACCATTTTCGCGTGCGCCACAATAGTTCGATACGGGCGAAGCGCCAATGGCGACGCGCGCGG
GCGCAGTCTCAGGAGGGCTTCGGCGTTTCTCCCCGCGCTTGGAGATTCGGTTCGAGTGAG
>paratb_20424
CTAGATAGCTTGGTGCATAGTCGATTTCGTGCCGTCTGGACCTAACCTTCCGCCAACGTGACGTCCTACA
ACCCCCACTTCGGAGGGCCGATTGTCTAACCTACATACTAGTATGTATGCTGATCTCGACACCGCGATAG
GGGTAGGGATGACTGTTGACGACGAAATGACCCAGGCCAACCGCAGCGCTGGTCCTCCGG
>paratb_20425
GCGAAGCCGGCGCGGGTTCTGCCTCGATGCCACAGCGACTCGGACTGGCCGGCCTGTGCCTGGGCACCGC
TCTGATCATCATGGAAGCCAACGTGCTCAACGTGGCCATTCCCTCGATCCGACAGGCCTTGCACGCCAGC
CCAGCGCAGAGCTTGTGGATCATCGACGCCTACACCCTCGTGCTGGCCGCATTACTACTG
>paratb_20426
TCGGCCGGTCGTTTAGGCGACCGCATCGGCGCACGGCGTTGCTATCTATTGGGTCTGGCAGTGTTCAGCA
TCGCCTCAGTGCTGTGCGCCCTCGCCGCATCGTCGGCCGAGCTGATTGCCGCACGCACCATTCAGGGAGT
CGGTGCCGCCGTGCTGATCCCGGCCCCTCTCGGGCTGATCTCGGCAATGTTTAGCGATCT
>paratb_20427
CACCGCGCGCGCGAAGGCGGTCGCTGTGTGGGTCACAATCGGTGGGGTCGGTTTTGCGGCGGGACCCTTG
ATCGGCGGTCTGCTGGTCAGCACGTTCGGTTGGCGCTCGATCTTCCTTATCAACATTCCCGCCGCGGCGA
TCATTGCGGTCATGGTGCGCCTCACAGTCGCTGAAGCCTCTCGGTCCCCCTTGCCGTTTG
>paratb_20428
ACTATGTCGGGCAGGCCCTGGCAATTGTCGGTCTGTCGGCAGTCGTCTTCGCCTGCGTGGAATCGAGTGC
CCTGGCGTGGATGTCGCCATTCGTGTTATTGCCTGCTGTGGCGGCCGCGCTGATCCTCGGGCTGTTTGTG
ATCGATCAACGCCATCGAGGCCGTGCCGGCGCCTGGGTGCTACTGCCGGTCGAGCTGTTG
>paratb_20429
AATAACCGGCCGGTGAACGCCGGACTGATGTCAGGATTTGTTTACAACTTCACCCTGTACGGTCTGGTCC
TCGTCTATAGCTATGTCTTCCAATCCGCCCGCGGCTACAGCCCCGTGCAGACCGGTCTGGCCTTCGCGCC
GTTGACTGTGGCAGCGCTGGTTACCTCGCTGCCCGCGGGACGCTTTGTCGCCGCGCACGG
>paratb_20430

Figure 6-98

```
TGCGCGAAGAGGCATCATGATCGGAATGGCGCTGTCTGCCATCGGATTATGCGCACTGGCATTCGATGCC
CAGCGGATGCCGTTCGTGGTCCTATCGATCGCCTTTGGCATCTTCGCGACCGGTCTCTCGCTTTCGGCGA
CCGGACAAACCATGGCGGTGATGGCCAACGCCAGCGACCAGTACAAAAACACGGCGTCCA
>paratb_20431
GCATGCTCAACACCGCGCGCCAGACCGGCGGTGTCATCGGCGTGGCGGCGCTGGGTGCGATCACGTCGCG
CGACCTGCTGGCCAGCGCGCCGGTGGCGTTGACCATCGCTGCCGCAGCATGTCTGGTCGCCGCTCTGGGA
GTTGCAACGTTGATTGCGCGTCACGCCCGCACACATGATTCGGACCAACACTGATACCGG
>paratb_20432
CATACATACCGCTAGGTATGCTTGCCTTATGGCGGACGAACAGGCCGATTCACGCGAGCGATTGATTAGT
GGAACCCGAGAACTGCTGTGGGATCGCGGCTACGTTGGCACCAGTCCCACCGCGATCCTGCAGCAGTCCG
GTGTTGGCCAAGGCAGCCTCTATCACCATTTTCGTGGCAAGCACGACCTGGTGCTGGCCG
>paratb_20433
CGGAGCAGCAGGCCGCAGCCGATATGCAGCGCAGCATCAAAGAGGCGTTTGCGGGCAACAGATCCGCCCA
CGACAAAATCGCCGACTACCTTACTCGTCAACGAGAAGTGCTGCGCGGCTGCAGCGTCGGTCGCCTGACA
GCAGATCCGGTGATTGTCGGCGACGATCAACTGCGTGCCCCTGTCGCACAGACCTTTGAG
>paratb_20434
GTACTGCATACCTGTCTGACACGAACGATCCGAGAAGGGCAGCGGTCGGGTGAGATCTCGGTCGAGCTTG
AGCCGCACAAAGTCGCGGCAGCGATTTCTGCAACCATCCAGGGCGGTTACGCCCTGGCTAGGGCAGCCAA
CTCGGTCGAACCCTTCAATCGCGCGATTACCGGCATCCTGCAACTGATAGAAGCCTCCAC
>Contig16_20435
CGCCCACCGTCGACGCACAAACCCAGCGGCTCACGATGCCGTGCCAGCCCAACGACGCCGAACGTCCCGG
TCAAAAAACCCAAGCAATCACAAACCAGCCCGATAAGCGAACCGGCGGCACGGCCACGAGGACGAGCTGT
CGGCGCGGCTGCCCGAATCGGTTGCGGCCTACCAGAATGCCGTTGCCGCAGGGGATTTCG
>Contig16_20436
ACACCGCAGCGATCCTCATCGGCGAAGCGGTGGGGGTCATCCGAGAGGTTCGTCCCGCCGCGGGATCGT
CGCCGAGATGGTCGGTGCAGTACAGCGCATCCTGCACCGCGACGGCGCGCCCTAGACAGCACCTTCCACG
AGACCTACCACGCCTACAACCCGGCGCTGCGGTTCCTGCTCGAGCGCCCCGTGCACGCGA
>paratb_20958
ACCACGACCAGCAGCTGCACCTGCTCGGCGGCGGCCCGTGGCAGCTGAGCCCGGTGGAAAAGGAGCCCGC
GCGGGTTTGATGCGCGCCTACGCTTTCGCGGCGCGCCGCGCCGCGTGCGCTCCGGCGCGGCGCCCGAAGA
ACGAACCCTCACCCAGCTGCGTCCCGCTGGCGTACCCCTTGCCGTCCTGAGCCAGGTTCG
>paratb_21004
GCAGTGAAGGATATGGATTTTCCATGGATTCACCCGCCGCACCCAGCCGTCGGTTGACCGCCGGCGTGCC
CCGCCTGGCGCCGAGCCTGGCCCCGCCTAGCCTCGCCCCGCCTGGCGCCGAGCGTGAAACTAGGCGCACG
TTCGGCGGCGAGCGTGAAACTAACTTCACGCTCGCGCGGCGTTCACGCTCGCCGCGGCGC
>Contig16_21065
GAGGCCGAACGCCTGGCTGGATTGCCGGATCGCGATGATGTCGACGTCCGGGGCCACCCCGCTGAACGCG
TCGGGGCCCGGCTTGGGCGGCGCCGGCGGCGGGTCGAGCGGGCGCGGGCCGCGCAGGTTGTCGACGTTGG
TCACCCGGGCGGCGCCCGCGTGGCCCGGGATGGTCACCGTGCCGCCGCCGTGGTTGCCGG
>Contig16_21164
AGCACGCTGGCAGCAGATTATGCGCTGACTCACAGCTAGCACCGGGGTGACGCAGTTGCGGCGGCATGAC
CGGCGTTCGTCTGGCAGGTGCGGCTAACCCCGCCGGCGCCGGCGCGAATTTTGCGCGCCCCGCGCCGCC
CGCCGAACGCCGCGGCCGGCCGCCCCGCGAGCCGCCCGGTCCTTTCCCGATCCGATCCAA
>paratb_21187
CGGGGGCTGCGTGCTGCTGTACCTGACGCCCCTGATCCTGGGGCTGTGGCGCGGGGAGACGAGTCACGAT
CGCCGCGCCGCGGCGCGCGCGCGGCGCGAGCGCGCCGAACTCGACGCCGACACCGCGATCGCGATCAAGC
GGGCCGAGGTTCGCCGCGAAGCCGAAATCATGTGGGCCGAGCACCAATTGACACAGGCGC
>Contig16_21952
```

Figure 6-99

```
CGCGGTGGCACCCTCGGTGCTCAGCGATTGGTCCACCGCGGCCGTCAGCGCCGCGCCGGGGCCCAGTTCC
AGGAAGGTTCCGGCGCCGGCCTGCTCGGCGGCGCGCACCCCCGCGAGGAATTGCACCGGCGCGCGCACGT
GCTCGACCCAGTACTGTGGCGTGCCGTAGCCGGGGCCGGCGAGTTGTCCGGTCAGGTTGG
>Contig16_22117
GGCCGAGCGGTCCAACACCGGCAAGCGTTAGCGCCGGTGGCGTCGGTTGCGCGCGTGCGGCGTGCGGTCT
TCGCGCGGCACTGCCACCCGTGCAGCGCGTGGTCCCGATGGGCGAGCACGCCGCTGATCCTGGTGCCGCC
CTGGACGCGACGGGCCAAGCACGCGGTATGGATTGCGCTGTGGCTGGCGGTGAATCCGTT
>Contig16_22118
CATCTTCGGCGAACCGGCCCATCACCGCGCCTGGGCCACGCGGGCGATGCTGGGCGAGGAACTGTGGATT
ACCCGCCGGCCCCGGGACGCGGCGATGGTGGTCAGCGCGGCGACGTCGGCGGCCGCGCTGGTTGCGGTGA
TCGCCGCCCATCGCCATCGGCTGAGACCCGCGCTGGTCGCGACCGCCCTGCAGATGGCGC
>paratb_22119
TGACGCTGGTGTACTGGCAGCAGATGGTTCGGTATCTCGAACGCGAGATGCGGTAACGCGGCCGATCGTC
TGCGAGACAGGGCAATACGCGCGTATCGCTGAGCGATACGAAGGTATTGTCAGGCCGTGGGACCCACCCG
GCTGTTTCCGTACGATCCGCCCCCCGCGCAACGATCGGCGAAGGAGCGGATACGCGACGC
>Contig16_22123
CGGAGGTACCCGCCGATCGCACGTTTCAGAAACGGGGTCCCGCCCACGACCCAGGTGCTATACACGAGAC
ACCATGCATGAGTCCGCCGTATCCGCCTATGCCGCGCAACTTCTCGACGCCGACAACCCCGACGACATGC
CGGAGTTGCAGCGGCTGCAAGGCGATCCGAACGTGGAATTCATCGATCGGCTCGACACGC
>paratb_22127
GCCCGATCTTGCATGGCCTACTCGGCGACCTCGACATCGGCCTACTCCCGGGTATGAGCAGCCGCGAGAA
GGTCCCCCACATCTTGCGTCACCTTGAAGCGGAACGACTTTCGCCCCGCACGGCCGCATCATTGGTCGAG
ATCGACCGCACGGTGTCGACCTGGCCCCAGCTCGCGTCGGACGTCGTCCTCGGTGCCGCG
>paratb_22130
TCAACGGGTCGCCGGTGCGCGCCACTCTGAACCTGAGTGATGGCACCGACCCCTGGCTCGCGGATCTCTA
TCAGTCGATGATCCGGCGCGAGACAAATCGCCATCACGGAAGCCCGCGAGCGGTCGACGCCGCGACCATC
GAGGCGCTCGGCGACGCGGCAAACCGCGAGTGCGCGCGACTGCACCTGATCACCGGCCGT
>Contig16_22133
TCTTGTACGCCCACAACCGGGCAGAGTTCGACCAGCTGTCACCCCAATTCGCCGACGAGCTAATGCAATT
GGAGCGCAACTTCCGAGCACTGGCGGAGATAACCAAAGACGAAGCCGCGGTGCTGCTGCTCCGGTTCACC
GCCGCACCGCCGGCATCGGTGCCGAGCCGGCGCAGCGTCGAACGAACCCGGGTGCGCAAT
>Contig16_22134
TGAGCGGCTGGCTGCTCGCACACTGCATATCGATTGTGAGTCCGGCGCTCGGCCGGATTCGTGACTCCGG
GCACATTGCCCGCCCCGTTCCCCGTTGAAGCTACGGTAATGGAAATGTCGGGCACGTTGGACTACCTGG
TCACCGCCGCTGCCGCCGAATTGATGGCGGCGACGGCGGCGGACTCGGCCGCGATCAGCC
>Contig16_22143
GAAGGAGTCGAAACGGTGGCCGCCGCCCAAACGCTGCTCAGCTTGGGTTGTCATCGCGCCCAAGGGTTTC
TGCTATCGCGGCCGCTGGACAGCGCCGCGATGGAGTCGCTTCTCGCCCAGCGCGTCGTCCCCATGAATTT
CTCCGAGACCGGGCCAGCGGTCTAGATCCGCCAAGAGCGCAGTACCCCCACGCTCACGGG
>paratb_22144
CGGCGTTGAAATAGGTAGTAATACGTCGGGGTCTTGTCGTCGAGCGCCCGCTCCTGGCCAGTGGACAACA
GCGTCCAACCCGCGGTGAACCGCCGTTCGATTTCGGCGCGATCGATGCCCGGCACGCCGAACCGGCCCCC
GGGAGGAAACGCGACGATGAACAGCCGTGCGTCGGGCGCCGCAACGGCGCTGACCTCCCG
>Contig16_22146
AGCCGTGCTGAGCGAGGTAAACAGCGCAATCCCCCGTGCCGCACCCCAAGTCGAGGGCCGAGCCCGTGGG
CAGCGCCTGCGTGCCAGCGGCCCCTTCAACCAGATCCCGCAGACCCTGCCCGATCGGATGCCCTTCCCAG
GGGGTGAAGCCGACCCGGTAGAAGAACCGGAATCGTGCGCGCCGTGAAGCCATAGCCGCA
>paratb_22147
```

Figure 6-100

```
ATGATGGCATTCACCGCAGCCGGAGCGTCGCCCGCCCCCGGCGACGAGCGAGGCCAAGCACGACAGCGT
CAGCGCCGTCGTCTCACCATGGCCCTGATCGGCGCCGCCGCGACCATGGTGAAGGGCACGGCCAGCGGGA
AATCGTCGGACAGGGACTCGATTTCGACGCGGCGAACGATGGTTGCCAACGCGAGCGTAG
>Contig16_22154
GCAATCCGGCGATGTCACGCTTGGGTTCGGCGACCGACACGATTCGACCCTAGAACACTTTCGCATCGGG
CACGCGGAACTTGCGACCTCGGACCGACATCGCCTATGCCGATAGGCGGCTGAGGATTTCGGTGTTCTCG
GCGCACATCAACTTGAATTGCGCCGGATCGGCATGGGCGGCGAGGGTGCGGCGGTCCCAC
>Contig16_22222
GGACAACGTCTCTCCCAAACTCGCTAGCGCATCCGCTAGCAAGTTTGAAACTCACCTCATGGTGTCCGGA
GACCCGGCACCCCGAGGCGGCAATAGGTGAGGCGCCCGGAGACGGCGCCCGGAGTCGAGGCGCCAAAAGA
CAACTACCCAGCGGGACGCGTCCACGTGCGGGTGACCGGATCGCACTGCAGCAGGTAGCC
>Contig16_22236
CTCCGGGCCGCCGACCCTGACCTGGACCGCGATCACCGAGCAGACCAACCCGACGCGCCCGACGCGGCGC
CCGGTGCCGCCCCGCCGGCCGGCCCGACCGCCGAGCACACCGCCGGAGGAACGCACCGTCATCGTCCCCG
GCTCGCCGGCCCGATCGCGCGTCGCCCCGGCGAGCGCTCCGGCCGGGCCACCGCGGACAT
>paratb_22301
CGCTGGAATCGACTCCGCTGTCCAGGCGGGGAACGCTGTGGAGCTACACCGAGAACCGCTATGCCCCGCC
CCCGCCCTACCCGTCCCCGGACCCGTTCGAGCCGTTCGCCGTCGCCGCCGTGGAGTTGGCGAAGGAGGGT
CTGATCGTGCTGGGCAAGGTGGTCGAGGGCACGCTGGCCGCCGACCTGAAGGTCGGCATG
>paratb_22479
AAGTCCTGGCAGGGAGCGGTAGATGTCGGCGTCCGGGTGTGTCTCAAAATGTGTTGCCAGTTCGGCCTCA
AGGTCGGTGATCTGGCGGTTCAGTTCAGCGATGATGCCGACCGTGGCGCGGGTGGTTGCGCCGAACGCGG
CGGTGACCGCGGCAGGGGCGGCGAGCTGCTCAGCGCGTAAAGCGGTTTGAATGTCCTGGG
>paratb_22481
TTGCGGGTCCAGATCAGATTCTGATGTGCCCGGGCCAGCACTTTGACCGCCTCGGTATCAGCGGAGTCAC
CGGCGACGCGGCGGTGATTGTGGCGATCGGTGCGCACCAGATCCGCCAAGAGCTTGGCGTCCCCGGCATC
GGATTTGGCCCCCGACACATGGTGGCGGTCGCGGTAGCGGGCGGCCGCCATCGGGTTGAT
>paratb_22482
CGCATACACCTGGTAATCGGCCGCGGTGAGCGCCTCGACCCACAAACCACGGTCGGTTTCGATTCCAATC
ACGACCTGGTCGGGCTCTTCGGCATGGCGGGCCAAAAGCTGATGGAACTCGCCGATGCCGGCAAGTCCCT
CCGGTAACCGACGCGAGGCCAGCCGGGCCCCGGATTCATCCATCAGGTGGACGTCGTGAT
>paratb_22483
GATCCTCCGCCCAATCGTCGCCGACAAATATCACGTAGCGCCTCCTCGGTGGTCATCGAACATGTTCGAG
CCCAAGGGCACCCGGCGACAAGCTAATGGATCAGTGCTCAACGGCACGACACCCCATCAGTGCTACAGGA
ACCCTCACCAACCGGCCGGGGCGTGATCTAGCCTTAGAAGTCGGCCATCGCTTCAGCTGG
>Contig16_22616
GTCGGCGGACAGCGCGGCCCGGGCGTACTCCCCAGCGCCGGCGAGATGGCCGGCTCGCCGTAGAGGACC
GCGCGGCCGGAGGCCGGGCGGGCCGGCGCGGCGGCGGCGAGGGGTAACAGGGCGGGGTGCGGGTTGCCGG
TCGACAGGTCACGCACGCCGGCGGGGACGTCGAGCCCGAGCAGCGATCGCGGGGTGGTCG
>Contig16_22619
GCGGACGCCCGGTGGTGTTGCCGACGACGCACGCGCGCCGGGGCGAGACGCTGTACCTGCACGGTTCGAC
GGGCGGCGGGCCGGTGCTGGCGGCCAGGGCGGCCGCGGCCGCGGGGCGGGACTGCCGGTCTGCGTCACC
GTCACGCTGGTCGACGCCCTGGTGCTGGCGCGCGCCGCGATGCACCACTCGGTGAACTTC
>Contig16_22663
CATCGTGCGGGTGCAGCCCATGTGACCGCCGGCGGCGCGGCGAGCGCGGCGGCCCCGCGCCTGCCGCCCG
GCGGCCCCGCGCCTGCCGCCCGGCGGCCCCGCGCCTGGCCCGCGGCGGCCCCCGGCGAGCCCGCGCCTG
CCCCCGGCGAGCGTGAAATTAGCTTCACGGTCGCGGCCGAGCGTGAAACTAACTTCACGC
>Contig16_22956
```

Figure 6-101

```
GGTTCGTTGATCGCGGGAGCGCTCGGGGTGGCCGCGGCGGGCTTCGGCGCCGCGGTGGCGAGCGCGGATC
CCCCGCCACCGCCGCCGGGCCCGGGGCAGCCGTGGGGGCCGGGCGGCCCGGGCGGGCCGGGTGGACCGGG
TGGACCGCCCCGCCGCCGGGTGGACCGCTGGGCCCGCCACCGGGCGGGCCGGGCGGGCC
>paratb_23136
GCCGTGCTGATCACGCTGTCGTCGCAGGTGAAGCTGCCGTCGCTGCTGGCACTGGGCTTCGTCACGATGG
CGCTGGCCTACCGGTGCGGGGGCAACCTGCGCGCGCTGCTGCTGGCCGGCGGCGGCATGGCGGCGCTGTC
GCTGGCGGTGATGGCGCTGGTCGGCTGGGCCAGCGGGCTCGGGTTCGGCTGGATCTACAC
>Contig16_23367
AGCCGCTGTATGCCCGGGTGATGCGCGCCGGCGACGGCGTGGTGCTGCAGTTCGCTCAACTGTCGGTGAG
CGCCGGATCCGACCACGAGGCCGCGATGCTGTTCCTGGCCGGCCGCGCCGAGCCGTTCCGGGTGGCCGAG
CTGCCCGGGCTGAGCGCCGCGCAGCAGGTCGGGCTGGCGCAGACGCTGATCCTGAACGGG
>paratb_23368
TTTCTGGCCCGACTGTCCGACGACTGACAGTCAGCTTCGCATTTCCGGTGAATGCGCCGGAATCTATCCG
TATCTGCGGATCTACTCGGGTTACGCTCCATTACCTACGGGTCGCCTCGTTCGTCGGGGAGGAGCGCGTC
ATGGCAGCAGGGTCCGCCGCGGGCAGGCGCCGATGACCATGCCGATCTGGGCCGCCTTCC
>paratb_23369
CGCCGGAGGTGCATTCGGCGGCGCTGTCCAGCGGACCCGGCCCCGGGTCGTTGCTCGCGGCCGAGCAGGC
CTGGCAGGCGCTGAGCGCCGAATACGCCTCGGCCGCCGCCGAACTCGGCGATCTGCTGGCGGCGGTGCAG
GCCGGCACCTGGCAGGGTCCCAGCGCCGAGGCGTTCGTGGCCGCGCACGTGCCATATCTG
>paratb_23371
TCTGCAGATGTGGCTGCAGGCGGCCACCACGATGGCGATCTACGAGGCGGTGTCGGAGACCGCGATGACG
TGGAAACCGCCCACCGCGCCGCCGCCGCAGATCCAGAAAACCGGCGTCGCCAACCAGGACGCCGGCGGCG
GCCCCACCCAGCTGAGCTGGTGGGTGACGCGGGTGCAGGAGGTGGCCAGGGCCATCAGCG
>paratb_23372
GCGACCTGAGCCAGTCGCCGTCGAACCCGTCCGCGACGTTGTCGGACCTGATGAGCGATCCGCTGCTGGC
CACCGAGGTGCCGCACTGGGCGGGCGAGTCGCTGCTGTACTTCACCCCGCAGGTGCCGCAGTTGACCCAG
CTCTCGTTCGGTCTGATCGCGCCCTTCATCCCCGCCGCGGGGCGCCGGGGGTGGCCGGG
>paratb_23373
CTGGCCGGACTCGCCGGGTTGGCCGGGGGCGCCCCCGCGCCCGTCCTGCCCGGGGTGGCGGCCGCGCCCT
CCGGCGGTGGAGCCGCTGCCGTGCTGGCCCCCGGCCCGGGCGCCTCCGCCGCGACCGTGTCGCCGGCCCC
GGCGCCCGCGGGCATGCCGGCCACCGCACCGGCCCCGGTCGGACCACCCACGCCGCCGCC
>Contig16_23375
TACCGCCACGAATACCTCGACACCGACCCCGGCGGGGGCCCCGCGTCCGTGACCGCCTCGGACCGGGGCG
CCGGCCCCGATCGGGTTCGCCGGCACCACCGGCGCGACCGGTTCGGCACCCGTGGGGTTGACCACAGTCGC
CGGTGATGCGCTGGACGACGGCCCGCGAATGCCGCTGCTGCCAGGCAGCTGGAGCGCCGA
>paratb_23461
GGCGCTCGAACGGGCGTGCCGTGCTCGCCTTGCTCGCCGAGCGTGAAGTTAAGTTCACGCTCGGCGCCGA
GCGTGAAGCTAGCTTCACGCTCGGCACGACGCGGCGGCGCGACGCGGCGCGACTCGGCGGAAGCTCGAGA
CGGGTCAGACGGCGCGCTTGAGCTCGTCGACCTTGTTCAGCTGCTCCCAGGGCAGTTCGA
>Contig16_23540
CGGCTCGCCGGCCCACCGGGTCAGGGCGAGCACCGCGGCCTTGCGCACGTCCAGGTGCGCGTCGCCCAGC
GCCTCGCCCAGCAGCGGCACCGCGACCTCGGCGGCCGCACCGGCCAGCGCCCGCGCCGCGCCTTCGCGCA
CCTGCCACGCCGACGCGCGCAGCGCCTGCGTGATGGCCCCGTAATCGTCTGGGCCGCAGC
>Contig16_23733
TAAGTCGAGCCGGCGGAAATCCAACAGCAAGGACGGACATGAGCCAGCCCCCGAATATCCAGGCACGCC
GCCCGAGCCGCCGCCGGGGTACGGCCCGCCACCGGGCTACGGCACGCCGCCGGGCTACGGCACGCCACCC
CCGCCGCCGCCGGGCTATGGCCCGCCGCCCGGCTACGGGGCACCCCCGCCCGGCTACGGC
>Contig16_23842
```

Figure 6-102

```
AGCAGCGCCACCGCCTCCGGCGTGGACCGCGACGCCACCACATACTCGAACATGTGTTCGACCATAGCAT
CGTCCACCGACGCATGCTTTTTGGCAGTTCGCGACGTGTGGATAACTGCGGCAGCTGAATGGGTAAGGAG
ATGCGTCGGTCGCGGATTCCGGCCGAGGAGAAAACCCACCGTGCCCACCCCGTTTTGCGA
>Contig16_23868
GACCGCAGCTCACGACCGCATCACAGCCCCAACCGCACGCCCACGCGCACCGAGCGGCGCATCATCAAAG
TCCGGGTGATCCGCCGGTGGGGACCAGCGCGCATCGGGTATCTGCTGGGGATACATCCCTCGACGGTCCA
TCGGGTATTGACCCGCTACGCGCTGGCCAAACTGCGCTGGCTGGACCGATCTACTGGCCG
>Contig16_23869
GATTATCCGGCGGATGGAACCGGCTGGGTGCGGGGATCTAGTGCACGTCGATGTCAAGAAGCTCGGCAAA
ATCCCTGCCGGCGGCGGCTGGCGGATGCTGGGACGCGCGATTGGCGGCCACAACTCCAACGCGGACAAGA
GCAGCGGGGTGTTCAGCAAGCACCGCAACCCAATACGGGGATATCACTATCTCCACACCG
>Contig16_23870
CCATCGATGGATATTCCCGGCTGGCCTACAGCGAGGTACTCGACGATGAGATCAAAGAAACCGCCGCCGA
GTTCTGGACACGCGCTAATGCCTGGTTCGCCGAATGTGGGATCAGCGTGCGGAAAGTGTTGACCGACAAC
GGGTCCTGCTACCGATCGCGCGTTTTTGCCCAGGCCCTGGGCGATATCGAACACCGCCGC
>paratb_23908
CGGGCTGGGCGACGGCGGCGGGTCCTGCGGGTAGGGCCGCGGCTGAGCGGGTGCGGCGCCCGGCTGGGCG
GGCGCAGGTACGGGCTGGCCGGGGGCCGGCTGCCCCGGCGCGGGCGCGGGCTGGCCCGGTGCGGGTGCGG
GCTGGCCCGGTGCGGGCTGGCCGGGCGCGGGTTGCGCGGGCTGGCGCGGCGCGGGCTTGG
>paratb_23978
CATGATCAACCTGGCGGCGGCGGCCGTGGTGGCGATTTTCCTGCTGCGGCAAGTGGTTTCGGCGAGGCAA
CTGGCGCTGGCGCTGTGCGCGCTGGCCGCCGCGCTGGCGCTGCTGGCCGGCCTGCTGCTGCGCTCGGCGG
ACGTCGAAACCACCAGCAGGCAAAGGCTTTACGCCGACCCGATCATCGCCTACCGGCACA
>paratb_24003
CTCGGCGATCAGCCCGGCCGGCAGCGACGCCGGGTCGACGGCGGCCAGCGCGGCCGACAGCTCGTTCTCA
CGCGCCTCGCGGGCGGCCCGGGGCGCGGCCTCGGCGGCGTCGGCCAGCGCCGCCAGCCGGCGCCCCTCGG
AGGCACCGCCGTAGGCGTCGATCGCCACGGCGCGCGCCACCACCGCGCGCCGGGCCAGCG
>Contig16_24155
CGCAGCCGCCAGGTGCGCAGCAGGATCCGGACCGCGAACAGCGCACCGGCCAGCGGCACCGCAGGGGAT
```

Figure 6-103

MYCOBACTERIAL DIAGNOSTICS

CROSS REFERENCE TO RELATED APPLICATIONS

This application is a continuation and claims benefit of priority to International Application No. PCT/IB2003/006509, having an International Filing Date of Mar. 6, 2003, which claims benefit of priority to U.S. application Ser. No. 10/137,113, filed Apr. 30, 2002, now U.S. Pat. No. 7,074,559 issued Jul. 11, 2006, which claims benefit under 35 U.S.C. §119(e) of U.S. application Ser. No. 60/362,396, filed Mar. 6, 2002.

FEDERALLY SPONSORED RESEARCH

The U.S. Government may have certain rights in this invention pursuant to Grant Nos. 00-35201-9200, 58-3625-0-137, and 00-02215 awarded by the U.S. Department of Agriculture.

INCORPORATION-BY-REFERENCE

The material on the accompanying compact disc is hereby incorporated by reference into this application. The accompanying compact disc contains three files, Table10.txt, Table8.txt, and Table9.txt, which were created on Sep. 3, 2004. The file named Table10.txt is 1,651 KB, the file named Table8.txt is 4,907 KB, and the file named Table9.txt is 611 MB. The files can be accessed using Microsoft Word on a computer that uses Windows OS.

The Sequence Listing for this application is provided on CD-ROM. The CD-ROM containing the Sequence Listing is hereby incorporated by reference into this application. The CD-ROM containing the Sequence Listing contains one file, 60256371.TXT, which was created on Jun. 7, 2005. The file named 60256371.TXT is 17,837 MB. The file can be accessed using Microsoft Word on a computer that uses Windows OS.

TECHNICAL FIELD

This invention relates to detection of bacteria, and more particularly to detection of *Mycobacterium avium* subsp. *paratuberculosis*.

BACKGROUND

The disorder known as Johne's disease was first described in 1895. Today, *Mycobacterium avium* subsp. *paratuberculosis* (*M. paratuberculosis*), the causative agent of Johne's disease, is widely distributed both nationally and internationally in domestic ruminants such as cattle, sheep, goats, as well as wildlife such as rabbits, deer, antelopes, and bison. In 1996, the National Animal Health Monitoring System conducted a survey of dairy farms using serological analysis to determine the prevalence of Johne's disease in the U.S. The results of that study showed an estimated 20-40% of surveyed herds have some level of *M. paratuberculosis*. Furthermore, it is estimated that annual losses in the U.S. from *M. paratuberculosis* in cattle herds may exceed $220 million.

The pathogenesis of *M. paratuberculosis* has been recently reviewed by Harris and Barletta (2001, *Clin. Microbiol. Rev.*, 14:489-512). Cattle become infected with *M. paratuberculosis* as calves but often do not develop clinical signs until 2 to 5 years of age. The primary route of infection is through ingestion of fecal material, milk or colostrum containing *M. paratuberculosis* microorganisms. Epithelial M cells likely serve as the port of entry for *M. paratuberculosis* into the lymphatic system similar to other intracellular pathogens such as salmonella. *M. paratuberculosis* survive and may even replicate within macrophages in the wall of the intestine and in regional lymph nodes. After an incubation period of several years, extensive granulomatous inflammation occurs in the terminal small intestine, which leads to malabsorption and protein-losing enteropathy. Cattle shed minimal amounts of *M. paratuberculosis* in their feces during the subclinical phase of infection, and yet over time, this shedding can lead to significant contamination of the environment and an insidious spread of infection throughout the herd before the animal is diagnosed. During the clinical phase of infection, fecal shedding of the pathogen is high and can exceed $10^{10}$ organisms/g of feces. The terminal clinical stage of disease is characterized by chronic diarrhea, rapid weight loss, diffuse edema, decreased milk production, and infertility. Although transmission of *M. paratuberculosis* occurs primarily through the fecal-oral route, it has also been isolated from reproductive organs of infected males and females.

SUMMARY

The present invention provides nucleic acid molecules unique to *M. paratuberculosis*. The invention also provides polypeptides encoded by the *M. paratuberculosis*-specific nucleic acid molecules of the invention, and antibodies having specific binding affinity for the polypeptides encoded by the *M. paratuberculosis*-specific nucleic acid molecules. The invention further provides for methods of detecting *M. paratuberculosis* in a sample using nucleic acid molecules, polypeptides, or antibodies of the invention. The invention additionally provides for methods of preventing a *M. paratuberculosis* infection in an animal.

In one aspect, the invention provides an isolated nucleic acid, wherein the nucleic acid comprises a nucleic acid molecule of 10 nucleotides to 969 nucleotides, the molecule having at least 75% sequence identity to SEQ ID NO:1 or to the complement of SEQ ID NO:1, wherein any such molecule that is 10 to 35 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Homo sapiens*, *Pseudomonas aeruginosa*, *Streptomyces viridochromogenes*, *Mus musculus*, *Felis catus*, and *Xanthomonas campestris* using an appropriate third nucleic acid molecule.

For example, a nucleic acid of the invention can have the sequence shown in SEQ ID NO:1. A nucleic acid of the invention can have at least 75% sequence identity to SEQ ID NO:1 (e.g., SEQ ID NO:102). A nucleic acid of the invention can have at least 80% sequence identity to SEQ ID NO:1 (e.g., SEQ ID NO:103). A nucleic acid of the invention can have at least 85% sequence identity to SEQ ID NO:1 (e.g., SEQ ID NO:104). A nucleic acid of the invention can have at least 90% sequence identity to SEQ ID NO:1 (e.g., SEQ ID NO:105). A nucleic acid of the invention can have at least 95% sequence identity to SEQ ID NO:1 (e.g., SEQ ID NO:106). A nucleic acid of the invention can have at least 99% sequence identity to SEQ ID NO:1 (e.g., SEQ ID NO:107).

In another aspect of the invention, there is provided an isolated nucleic acid, wherein the nucleic acid comprises a nucleic acid molecule of 10 nucleotides to 576 nucleotides, the molecule having at least 75% sequence identity to SEQ ID NO:2 or to the complement of SEQ ID NO:2, wherein any such molecule that is 10 to 35 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Thermotoga* sp., *Homo sapiens, Pseudomonas aeruginosa, Deinococcus radiodurans, Streptomyces coelicolor, Oryza sativa, Rhizobium leguminosarum, Frankia alni*, and *Mesorhizobium loti* using an appropriate third nucleic acid molecule.

In another aspect of the invention, there is provided an isolated nucleic acid, wherein the nucleic acid comprises a nucleic acid molecule of 10 nucleotides to 522 nucleotides, the molecule having at least 75% sequence identity to SEQ ID NO:3 or to the complement of SEQ ID NO:3, wherein any such molecule that is 10 to 35 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Halobacterium* NRC-1, *Oryza sativa, Glycine max, Streptomyces coelicolor*, and *Mus musculus* using an appropriate third nucleic acid molecule.

In another aspect of the invention, there is provided an isolated nucleic acid, wherein the nucleic acid comprises a nucleic acid molecule of 10 nucleotides to 582 nucleotides, the molecule having at least 75% sequence identity to SEQ ID NO:4 or to the complement of SEQ ID NO:4, wherein any such molecule that is 10 to 47 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Oryza sativa, Caenorhabditis elegans, Leishmania mexicana, Drosophila melangaster, Homo sapiens, Zea mays, Halobacterium* sp. NRC-1, *Pseudomonas aeruginosa, Ralstonia solanacearum*, and *Streptomyces coelicolor* using an appropriate third nucleic acid molecule.

In another aspect of the invention, there is provided an isolated nucleic acid, wherein the nucleic acid comprises a nucleic acid molecule of 10 nucleotides to 311 nucleotides, the molecule having at least 75% sequence identity to SEQ ID NO:5 or to the complement of SEQ ID NO:5, wherein any such molecule that is 10 to 36 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Homo sapiens, Streptomyces coelicolor*, Ictalurid herpesvirus, *Mesorhizobium loti*, and *Oryza sativa* using an appropriate third nucleic acid molecule.

In another aspect of the invention, there is provided an isolated nucleic acid, wherein the nucleic acid comprises a nucleic acid molecule of 10 nucleotides to 576 nucleotides, the molecule having at least 75% sequence identity to SEQ ID NO:6 or to the complement of SEQ ID NO:6, wherein any such molecule that is 10 to 41 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Pseudomonas aeruginosa, Ralstonia solanacearum, Arabidopsis thaliana, Pseudomonas fluorescens, Homo sapiens*, and *Mesorhizobium loti* using an appropriate third nucleic acid molecule.

In another aspect of the invention, there is provided an isolated nucleic acid, wherein the nucleic acid comprises a nucleic acid molecule of 10 nucleotides to 474 nucleotides, the molecule having at least 75% sequence identity to SEQ ID NO:7 or to the complement of SEQ ID NO:7, wherein any such molecule that is 10 to 35 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Homo sapiens, Pantoea agglomerans, Rattus norvegicus, Erwinia uredovora, Erwinia ananas*, and *Pantoea ananatis* using an appropriate third nucleic acid molecule.

In another aspect of the invention, there is provided an isolated nucleic acid, wherein the nucleic acid comprises a nucleic acid molecule of 10 nucleotides to 558 nucleotides, the molecule having at least 75% sequence identity to SEQ ID NO:8 or to the complement of SEQ ID NO:8, wherein any such molecule that is 10 to 36 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Neisseria meningitidis, Homo sapiens, Streptomyces coelicolor, Arabidopsis thaliana, Escherichia coli, Pseudomonas aeruginosa, Streptomyces hygroscopicus* var. *ascomyceticus, Ralstonia solanacearum, Deinococcus radiodurans, Rhizobium meliloti, Rickettsia typhi, Streptomyces* sp., and *Mus musculus* using an appropriate third nucleic acid molecule.

In another aspect of the invention, there is provided an isolated nucleic acid, wherein the nucleic acid comprises a nucleic acid molecule of 10 nucleotides to 321 nucleotides, the molecule having at least 75% sequence identity to SEQ ID NO:9 or to the complement of SEQ ID NO:9, wherein any such molecule that is 10 to 36 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Mycobacterium tuberculosis, Homo sapiens, Streptomyces coelicolor, Drosophila melanogaster, Ralstonia solanacearum, Mesorhizobium loti*, and *Pseudomonas cruciviae* using an appropriate third nucleic acid molecule.

In another aspect of the invention, there is provided an isolated nucleic acid, wherein the nucleic acid comprises a nucleic acid molecule of 10 nucleotides to 2508 nucleotides, the molecule having at least 75% sequence identity to SEQ ID NO:10 or to the complement of SEQ ID NO:10, wherein any such molecule that is 10 to 44 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Sinorhizobium meliloti, Xanthomonas albilineans, Halobacterium* sp. NRC-1, *Ralstonia solanacearum, Deinococcus radiodurans, Halobacterium salinarium, Micromonospora griseorubida, Pseudomonas paucimobilis*, and *Streptomyces lividans* using an appropriate third nucleic acid molecule.

In another aspect of the invention, there is provided an isolated nucleic acid, wherein the nucleic acid comprises a nucleic acid molecule of 10 nucleotides to 264 nucleotides, the molecule having at least 75% sequence identity to SEQ ID NO:11 or to the complement of SEQ ID NO:11, wherein any such molecule that is 10 to 36 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Caulobacter crescentus, Brucella melitensis, Pyrobaculum aerophilum, Mycobacterium tuberculosis, Sinorhizobium meliloti,* and *Mycobacterium leprae* using an appropriate third nucleic acid molecule.

In another aspect of the invention, there is provided an isolated nucleic acid, wherein the nucleic acid comprises a nucleic acid molecule of 10 nucleotides to 1110 nucleotides, the molecule having at least 75% sequence identity to SEQ ID NO:12 or to the complement of SEQ ID NO:12, wherein any such molecule that is 10 to 39 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Mesorhizobium loti, Bacillus halodurans, Ralstonia solanacearum, Homo sapiens, Drosophila melanogaster,* and *Rhizobium meliloti* using an appropriate third nucleic acid molecule.

In another aspect of the invention, there is provided an isolated nucleic acid, wherein the nucleic acid comprises a nucleic acid molecule of 10 nucleotides to 672 nucleotides, the molecule having at least 75% sequence identity to SEQ ID NO:13 or to the complement of SEQ ID NO:13, wherein any such molecule that is 10 to 30 nucleotides in length, under standard amplification conditions, generates an amplification product from *M. paratuberculosis* nucleic acid using an appropriate second nucleic acid molecule, but does not generate an amplification product from nucleic acid of *M. avium* subsp. *avium* using an appropriate third nucleic acid molecule.

In another aspect of the invention, there is provided an isolated nucleic acid, wherein the nucleic acid comprises a nucleic acid molecule of 10 nucleotides to 372 nucleotides, the molecule having at least 75% sequence identity to SEQ ID NO:14 or to the complement of SEQ ID NO:14, wherein any such molecule that is 10 to 30 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Brucella melitensis, Streptomyces coelicolor, Drosophila melanogaster, Mycobacterium tuberculosis, Trypanosoma rangeli, Trypanosoma minasense, Trypanosoma leeuwenhoeki,* and *Brassica napus* using an appropriate third nucleic acid molecule.

In another aspect of the invention, there is provided an isolated nucleic acid, wherein the nucleic acid comprises a nucleic acid molecule of 10 nucleotides to 600 nucleotides, the molecule having at least 75% sequence identity to SEQ ID NO:15 or to the complement of SEQ ID NO:15, wherein any such molecule that is 10 to 35 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Ralstonia solanacearum, Sinorhizobium meliloti, Homo sapiens, Mesorhizobium loti, Oryza sativa, Drosophila melanogaster, Rhizobium leguminosarum, Xylella fastidiosa, Deinococcus radiodurans, Achromobacter cycloclastes,* and *Candida cylindracea* using an appropriate third nucleic acid molecule.

In another aspect of the invention, there is provided an isolated nucleic acid, wherein the nucleic acid comprises a nucleic acid molecule of 10 nucleotides to 540 nucleotides, the molecule having at least 75% sequence identity to SEQ ID NO:16 or to the complement of SEQ ID NO:16, wherein any such molecule that is 10 to 45 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Streptomyces lavendulae, Xylella fastidiosa, Streptococcus pneumoniae, Mycobacterium tuberculosis, Pseudomonas aeruginosa, Ralstonia solanacearum, Sinorhizobium meliloti, Sus scrofa, Mycobacterium leprae,* and *Streptomyces coelicolor* using an appropriate third nucleic acid molecule.

In another aspect of the invention, there is provided an isolated nucleic acid, wherein the nucleic acid comprises a nucleic acid molecule of 10 nucleotides to 291 nucleotides, the molecule having at least 75% sequence identity to SEQ ID NO:17 or to the complement of SEQ ID NO:17, wherein any such molecule that is 10 to 37 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Pseudomonas* sp., *Homo sapiens, Pseudomonas aeruginosa, Thauera aromatica, Oryza sativa, Ralstonia solanacearum, Rhizobium leguminosarum, Streptomyces coelicolor, Brucella melitensis, Drosophila melanogaster, Deinococcus radiodurans, Streptomyces noursei, Rhizobium meliloti, Synechococcus elongates, Sinorhizobium meliloti,* and *Mesorhizobium loti* using an appropriate third nucleic acid molecule.

In another aspect of the invention, there is provided an isolated nucleic acid, wherein the nucleic acid comprises a nucleic acid molecule of 10 nucleotides to 225 nucleotides, the molecule having at least 75% sequence identity to SEQ ID NO:18 or to the complement of SEQ ID NO:18, wherein any such molecule that is 10 to 37 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Rhodobacter capsulatus, Agrobacterium tumefaciens, Mycobacterium smegmatis, Pseudomonas aeruginosa, Ralstonia solanacearum,* and *Drosophila virilis* using an appropriate third nucleic acid molecule.

In another aspect of the invention, there is provided an isolated nucleic acid, wherein the nucleic acid comprises a nucleic acid molecule of 10 nucleotides to 441 nucleotides, the molecule having at least 75% sequence identity to SEQ ID NO:19 or to the complement of SEQ ID NO:19, wherein any such molecule that is 10 to 30 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Homo sapiens, Mus musculus, Leishmania major, Pseudomonas aeruginosa,* and *Botrytis cinerea* using an appropriate third nucleic acid molecule.

In another aspect of the invention, there is provided an isolated nucleic acid, wherein the nucleic acid comprises a nucleic acid molecule of 10 nucleotides to 726 nucleotides, the molecule having at least 75% sequence identity to SEQ ID NO:20 or to the complement of SEQ ID NO:20, wherein any such molecule that is 10 to 41 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Oryza sativa, Caulobacter crescentus, Rhodobacter sphaeroides, Streptomyces coelicolor, Spermatozopsis similis, Homo sapiens, Sus scrofa*, and *Giardia intestinalis* using an appropriate third nucleic acid molecule.

In another aspect of the invention, there is provided an isolated nucleic acid, wherein the nucleic acid comprises a nucleic acid molecule of 10 nucleotides to 426 nucleotides, the molecule having at least 75% sequence identity to SEQ ID NO:21 or to the complement of SEQ ID NO:21, wherein any such molecule that is 10 to 44 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Streptomyces coelicolor, Homo sapiens, Triticum aestivum, Oryza sativa, Brucella melitensis, Caulobacter crescentus, Pseudomonas aeruginosa, Ralstonia solanacearum*, Bovine herpesvirus, and *Mesorhizobium loti* using an appropriate third nucleic acid molecule.

In another aspect of the invention, there is provided an isolated nucleic acid, wherein the nucleic acid comprises a nucleic acid molecule of 10 nucleotides to 279 nucleotides, the molecule having at least 75% sequence identity to SEQ ID NO:22 or to the complement of SEQ ID NO:22, wherein any such molecule that is 10 to 45 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Pseudomonas aeruginosa, Oryza sativa, Streptomyces* sp., *Streptomyces peucetius, Rhizobium* sp., *Mycobacterium tuberculosis, Caulobacter crescentus, Ralstonia solanacearum, Haloferax volcanii, Mycobacterium leprae*, and *Streptomyces coelicolor* using an appropriate third nucleic acid molecule.

In another aspect of the invention, there is provided an isolated nucleic acid, wherein the nucleic acid comprises a nucleic acid molecule of 10 nucleotides to 4415 nucleotides, the molecule having at least 75% sequence identity to SEQ ID NO:23 or to the complement of SEQ ID NO:23, wherein any such molecule that is 10 to 50 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Ralstonia solanacearum, Sinorhizobium meliloti, Homo sapiens, Mesorhizobium loti, Oryza sativa, Drosophila melanogaster, Rhizobium leguminosarum, Xylella fastidiosa, Deinococcus radiodurans, Achromobacter cycloclastes, Candida cylindracea, Streptomyces lavendulae, Streptococcus pneumoniae, Mycobacterium tuberculosis, Pseudomonas aeruginosa, Sus scrofa, Mycobacterium leprae, Streptomyces coelicolor, Pseudomonas* sp., *Thauera aromatica, Brucella melitensis, Streptomyces noursei, Rhizobium meliloti, Synechococcus elongates, Rhodobacter capsulatus, Agrobacterium tumefaciens, Mycobacterium smegmatis, Drosophila virilis, Mus musculus, Leishmania major, Botrytis cinerea, Caulobacter crescentus, Rhodobacter sphaeroides, Spermatozopsis similes, Giardia intestinalis, Triticum aestivum*, Bovine herpesvirus, *Streptomyces* sp., *Streptomyces peucetius, Rhizobium* sp., and *Haloferax volcanii* using an appropriate third nucleic acid molecule.

Generally, the invention provides an isolated nucleic acid, wherein the nucleic acid comprises a nucleic acid molecule of at least 10 nucleotides, the molecule having at least 75% sequence identity to a sequence selected from the group consisting of SEQ ID NOs:1-23 or to the complement of a sequence selected from the group consisting of SEQ ID NOs: 1-23, wherein any such molecule that is 10 to 30 nucleotides in length, under standard amplification conditions, generates an amplification product from *M. paratuberculosis* nucleic acid using an appropriate second nucleic acid molecule, but does not generate an amplification product from nucleic acid of any of the organisms selected from the group consisting of *Ralstonia solanacearum, Sinorhizobium meliloti, Homo sapiens, Mesorhizobium loti, Oryza sativa, Drosophila melanogaster, Rhizobium leguminosarum, Xylella fastidiosa, Deinococcus radiodurans, Achromobacter cycloclastes, Candida cylindracea, Streptomyces lavendulae, Streptococcus pneumoniae, Mycobacterium tuberculosis, Pseudomonas aeruginosa, Sus scrofa, Mycobacterium leprae, Streptomyces coelicolor, Pseudomonas* sp., *Thauera aromatica, Brucella melitensis, Streptomyces noursei, Rhizobium meliloti, Synechococcus elongates, Rhodobacter capsulatus, Agrobacterium tumefaciens, Mycobacterium smegmatis, Drosophila virilis, Mus musculus, Leishmania major, Botrytis cinerea, Caulobacter crescentus, Rhodobacter sphaeroides, Spermatozopsis similes, Giardia intestinalis, Triticum aestivum*, Bovine herpesvirus, *Streptomyces* sp., *Streptomyces peucetius, Rhizobium* sp., *Haloferax volcanii, Streptomyces viridochromogenes, Felis catus, Xanthomonas campestris, Thermotoga maritime, Thermotoga neapolitana, Frankia alni, Halobacterium* NRC-1, *Glycine max, Leishmania tarentolae, Neisseria meningitides, Escherichia coli, Caenorhabditis elegans, Leishmania mexicana, Zea mays*, Ictalurid herpesvirus, *Rattus norvegicus, Arabidopsis thaliana, Pseudomonasfluorescens, Pantoea agglomerans, Erwinia uredovora, Pantoea ananatis, Streptomyces hygroscopicus, Rickettsia typhi, Pseudomonas cruciviae, Xanthomonas albilineans, Halobacterium salinarium, Micromonospora griseorubida, Pseudomonas paucimobilis, Streptomyces lividans, Pyrobaculum aerophilum, Sinorhizobium meliloti, Mesorhizobium loti, Bacillus halodurans, Trypanosoma rangeli, Trypanosoma minasense, Trypanosoma leeuwenhoeki*, and *Brassica napus* using an appropriate third nucleic acid molecule.

The invention provides for an isolated nucleic acid comprising a nucleic acid molecule of 10 nucleotides to 200 nucleotides having at least 75% sequence identity to one of the sequences set out in SEQ ID NOs:110-1342 or to the complement of that sequence. Using Table 1 as a reference, any such molecule that is 10 to N nucleotides in length, under standard amplification conditions, generates an amplification product from *M. paratuberculosis* nucleic acid using an appropriate second nucleic acid molecule, but does not generate an amplification product from nucleic acid of any of the organisms shown in Table 1 corresponding to the respective SEQ ID NO, using an appropriate third nucleic acid molecule. For example, for SEQ ID NO:110 (segment 26), any such molecule that is 10 to 33 nucleotides in length, under standard amplification conditions, generates an amplification product from *M. paratuberculosis* nucleic acid using an appropriate second nucleic acid molecule, but does not generate an amplification product from nucleic acid of *Mus musculus* and *Rhodobacter sphaeroides*, using an appropriate third nucleic acid molecule.

TABLE 1

| Fragment Designation | SEQ ID NO: | N (nt) | Organisms |
|---|---|---|---|
| 26 | 110 | 33 | *Mus musculus*; *Rhodobacter sphaeroides* |
| 27 | 111 | 38 | *Novosphingobium aromaticivorans*; *Corynebacterium efficiens* |
| 28 | 112 | 30 | *Mycobacterium avium* subsp. *avium* |
| 29 | 113 | 30 | *Mycobacterium avium* subsp. *avium* |
| 30 | 114 | 32 | *Brucella melitensis*; *Brucella suis* |
| 31 | 115 | 30 | *Mycobacterium avium* subsp. *avium* |
| 32 | 116 | 32 | *Galleria mellonella* |
| 33 | 117 | 32 | *Oryctolagus cuniculus*; *Novosphingobium aromaticivorans* |
| 35 | 118 | 30 | *Mycobacterium avium* subsp. *avium* |
| 36 | 119 | 38 | *Oryza sativa*; *Burkholderia fungorum* |
| 37 | 120 | 30 | *Mycobacterium avium* subsp. *avium* |
| 38 | 121 | 30 | *Mycobacterium avium* subsp. *avium* |
| 39 | 122 | 39 | *Magnetospirillum magnetotacticum*; *Zea mays*; *Oryza sativa*; *Streptomyces coelicolor* |
| 40 | 123 | 32 | *Neurospora crassa* |
| 41 | 124 | 30 | *Mycobacterium avium* subsp. *avium* |
| 47 | 125 | 33 | *Ralstonia solanacearum* |
| 48 | 126 | 30 | *Mycobacterium avium* subsp. *avium* |
| 56 | 127 | 42 | *Halobacterium* sp. NRC-1; *Oryza sativa* |
| 57 | 128 | 32 | *Mus musculus*; *Arabidopsis thaliana* |
| 58 | 129 | 30 | *Mycobacterium avium* subsp. *avium* |
| 59 | 130 | 38 | *Ralstonia metallidurans*; *Magnetospirillum magnetotacticum* |
| 60 | 131 | 30 | *Mycobacterium avium* subsp. *avium* |
| 61 | 132 | 30 | *Mycobacterium avium* subsp. *avium* |
| 62 | 133 | 36 | *Ralstonia metallidurans* |
| 63 | 134 | 38 | *Leishmania donovani*; *Oryza sativa* |
| 67 | 135 | 32 | *Oryza sativa* |
| 68 | 136 | 30 | *Mycobacterium avium* subsp. *avium* |
| 69 | 137 | 33 | *Mus musculus*; *Archaeoglobus fulgidus* |
| 70 | 138 | 30 | *Mycobacterium avium* subsp. *avium* |
| 71 | 139 | 32 | *Corynebacterium efficiens* |
| 72 | 140 | 45 | *Pseudomonas aeruginosa* |
| 73 | 141 | 30 | *Mycobacterium avium* subsp. *avium* |
| 74 | 142 | 41 | *Rhodospirillum rubrum*; *Ralstonia eutropha* |
| 75 | 143 | 30 | *Mycobacterium avium* subsp. *avium* |
| 76 | 144 | 30 | *Mycobacterium avium* subsp. *avium* |
| 77 | 145 | 30 | *Mycobacterium avium* subsp. *avium* |
| 79 | 146 | 32 | *Actinosynnema pretiosum* subsp. *auranticum maytansino* |
| 80 | 147 | 44 | *Streptomyces coelicolor*; *Homo sapiens*; *Rhodopseudomonas palustris*; *Triticum aestivum* |
| 81 | 148 | 30 | *Mycobacterium avium* subsp. *avium* |
| 82 | 149 | 41 | *Oryza sativa*; *Spermatozopsis similis* |
| 83 | 150 | 32 | *Streptomyces coelicolor* |
| 85 | 151 | 30 | *Mycobacterium avium* subsp. *avium* |
| 86 | 152 | 30 | *Mycobacterium avium* subsp. *avium* |
| 87 | 153 | 30 | *Mycobacterium avium* subsp. *avium* |
| 88 | 154 | 32 | *Ralstonia solanacearum* |
| 89 | 155 | 30 | *Mycobacterium avium* subsp. *avium* |
| 90 | 156 | 33 | *Pseudomonas* sp.; *Chlorobium tepidum*; *Pseudomonas aeruginosa* |
| 91 | 157 | 38 | *Homo sapiens*; *Lentinus edodes*; *Geobacter metallireducens*; *Thauera aromatica*; *Oryza sativa* |
| 92 | 158 | 30 | *Mycobacterium avium* subsp. *avium* |
| 93 | 159 | 32 | *Chlamydomonas geitleri* |
| 94 | 160 | 45 | *Streptomyces lavendulae* |
| 95 | 161 | 30 | *Mycobacterium avium* subsp. *avium* |
| 96 | 162 | 32 | *Xanthomonas campestris*; *Xanthomonas axonopodis* |
| 97 | 163 | 32 | *Homo sapiens* |
| 98 | 164 | 30 | *Mycobacterium avium* subsp. *avium* |
| 99 | 165 | 32 | *Ralstonia solanacearum* |
| 100 | 166 | 30 | *Mycobacterium avium* subsp. *avium* |
| 101 | 167 | 47 | *Mus musculus*; *Mycobacterium avium*; *Homo sapiens*; *Pseudomonas pseudoalcaligenes* |
| 102 | 168 | 30 | *Mycobacterium avium* subsp. *avium* |
| 103 | 169 | 32 | *Oryctolagus cuniculus* |
| 104 | 170 | 30 | *Mycobacterium avium* subsp. *avium* |
| 105 | 171 | 30 | *Mycobacterium avium* subsp. *avium* |
| 106 | 172 | 30 | *Mycobacterium avium* subsp. *avium* |
| 107 | 173 | 38 | *Corynebacterium efficiens* |
| 108 | 174 | 30 | *Mycobacterium avium* subsp. *avium* |
| 109 | 175 | 30 | *Mycobacterium avium* subsp. *avium* |
| 110 | 176 | 33 | *Homo sapiens* |
| 112 | 177 | 30 | *Mycobacterium avium* subsp. *avium* |

TABLE 1-continued

| Fragment Designation | SEQ ID NO: | N (nt) | Organisms |
|---|---|---|---|
| 236 | 178 | 56 | *Mycobacterium tuberculosis*; Shrimp white spot syndrome virus; *Mus* sp.; *Rattus norvegicus*; *Drosophila melanogaster*; *Eimeria tenella*; *Chlamydomonas reinhardtii*; *Bos taurus*; *Saccharomyces cerevisiae*; *Homo sapiens*; *Gallus gallus* |
| 257 | 179 | 50 | *Mycobacterium tuberculosis*; *Oryza sativa*; *Azotobacter vinelandii*; Pseudorabies virus; *Homo sapiens*; *Mus musculus*; *Desulfitobacterium hafniense*; *Triticum aestivum*; *Streptomyces coelicolor* |
| 280 | 180 | 45 | *Mycobacterium tuberculosis*; *Oryza sativa*; *Rhodobacter sphaeroides*; *Burkholderia fungorum*; *Desulfitobacterium hafniense* |
| 330 | 181 | 74 | *Mycobacterium tuberculosis* |
| 354 | 182 | 116 | *Mycobacterium tuberculosis*; *Rhodococcus fascians*; *Magnetospirillum magnetotacticum*; *Mycobacterium leprae*; *Deinococcus radiodurans*; *Xanthomonas campestris*; *Homo Sapiens*; *Rhodospirillum rubrum*; *Oryza sativa*; *Streptomyces coelicolor*; *Penaeus vannamei*; *Mus musculus*; *Caulobacter crescentus* |
| 518 | 183 | 102 | *Mycobacterium tuberculosis*; *Mycobacterium leprae*; *Rhodobacter sphaeroides*; *Rhodospirillum rubrum*; *Burkholderia fungorum*; *Xanthomonas oryzae* |
| 584 | 184 | 66 | *Mycobacterium tuberculosis*; *Ralstonia metallidurans*; *Homo sapiens*; *Azotobacter vinelandii* |
| 585 | 185 | 95 | *Mesorhizobium loti* |
| 586 | 186 | 45 | *Sinorhizobium meliloti*; *Xanthomonas campestris*; *Rhodopseudomonas palustris*; *Actinomyces naeslundii*; *Streptomyces coelicolor* |
| 587 | 187 | 45 | *Pseudomonas fluorescens*; *Mesorhizobium loti*; *Azotobacter vinelandii*; *Streptomyces coelicolor*; *Oryza sativa*; *Macaca mulatto* rhadinovirus; *Pseudomonas aeruginosa* |
| 588 | 188 | 42 | *Rhodobacter sphaeroides*; *Halobacterium* sp. NRC-1; |
| 589 | 189 | 70 | *Mycobacterium leprae* |
| 609 | 190 | 44 | *Magnetospirillum magnetotacticum*; *Rhodopseudomonas palustris*; *Homo sapiens*; *Amycolatopsis mediterranei*; *Streptomyces coelicolor* |
| 744 | 191 | 44 | *Oryza sativa*; *Homo sapiens*; *Mus musculus* |
| 811 | 192 | 99 | *Mycobacterium tuberculosis*; *Hordeum vulgare*; *Streptomyces coelicolor*; *Oryza sativa*; *Desulfitobacterium hafniense*; *Haloferax mediterranei*; *Pseudomonas aeruginosa*; *Mus musculus*; *Haloferax volcanii*; *Homo sapiens*; *Pseudomonas fluorescens*; *Azotobacter vinelandii*; *Sorghum vulgare*; *Zea mays* |
| 813 | 193 | 38 | *Ralstonia metallidurans*; *Frankia* sp.; *Homo sapiens*; *Streptomyces coelicolor*; *Oryza sativa* |
| 935 | 194 | 66 | *Mycobacterium tuberculosis*; Mycobacterium phage Ms6; *Ralstonia solanacearum*; *Oryza sativa*; *Rhodobacter sphaeroides*; *Rhodopseudomonas palustris*; *Caulobacter crescentus*; *Actinosynnema pretiosum*; *Homo sapiens*; *Thermobifida fusca*; *Streptomyces noursei*; *Mesorhizobium loti*; *Bifidobacterium longum*; *Streptomyces coelicolor* |
| 1001 | 195 | 86 | *Mycobacterium tuberculosis*; *Pseudomonas fluorescens*; *Rhodospirillum rubrum*; *Ralstonia solanacearum*; *Amycolatopsis orientalis*; *Pseudomonas syringae*; *Desulfitobacterium hafniense*; *Deinococcus radiodurans*; *Myxococcus xanthus* |
| 1007 | 196 | 135 | *Mycobacterium tuberculosis*; *Streptomyces coelicolor* |
| 1027 | 197 | 45 | *Ralstonia metallidurans*; *Azorhizobium caulinodans*; *Pseudomonas aeruginosa*; *Canis familiaris*; *Sus scrofa*; *Neurospora crassa*; *Rhodobacter sphaeroides*; *Rhodospirillum rubrum*; *Oryza sativa*; *Streptomyces coelicolor*; *Caulobacter crescentus*; *Papio anubis* |
| 1104 | 198 | 30 | *Mycobacterium avium* subsp. *avium* |
| 1105 | 199 | 30 | *Mycobacterium avium* subsp. *avium* |
| 1106 | 200 | 32 | *Rhizobium meliloti*; *Sinorhizobium meliloti* |
| 1107 | 201 | 32 | *Nocardioides* sp.; *Thermobifida fusca* |
| 1108 | 202 | 30 | *Mycobacterium avium* subsp. *avium* |
| 1109 | 203 | 30 | *Mycobacterium avium* subsp. *avium* |
| 1110 | 204 | 35 | *Desulfovibrio desulfuricans*; *Drosophila melanogaster* |
| 1111 | 205 | 30 | *Mycobacterium avium* subsp. *avium* |
| 1112 | 206 | 30 | *Mycobacterium avium* subsp. *avium* |
| 1113 | 207 | 30 | *Mycobacterium avium* subsp. *avium* |
| 1114 | 208 | 30 | *Mycobacterium avium* subsp. *avium* |
| 1115 | 209 | 30 | *Mycobacterium avium* subsp. *avium* |

TABLE 1-continued

| Fragment Designation | SEQ ID NO: | N (nt) | Organisms |
|---|---|---|---|
| 1116 | 210 | 30 | *Mycobacterium avium* subsp. *avium* |
| 1117 | 211 | 30 | *Mycobacterium avium* subsp. *avium* |
| 1118 | 212 | 30 | *Mycobacterium avium* subsp. *avium* |
| 1119 | 213 | 30 | *Mycobacterium avium* subsp. *avium* |
| 1120 | 214 | 32 | *Drosophila melanogaster* |
| 1121 | 215 | 39 | *Cordyceps pseudomilitaris; Oryza sativa* |
| 1122 | 216 | 35 | *Pseudomonas aeruginosa* |
| 1123 | 217 | 30 | *Mycobacterium avium* subsp. *avium* |
| 1130 | 218 | 44 | *Mycobacterium tuberculosis; Oryza sativa; Magnetospirillum magnetotacticum; Sinorhizobium meliloti; Burkholderia fungorum; Caulobacter crescentus; Ralstonia metallidurans; Rhodobacter capsulatus; Corynebacterium efficiens; Homo sapiens; Mus musculus* |
| 1549 | 219 | 98 | *Mycobacterium leprae; Mycobacterium tuberculosis; Oryza sativa; Xanthomonas axonopodis* |
| 1733 | 220 | 30 | *Mycobacterium avium* subsp. *avium* |
| 1735 | 221 | 33 | *Homo Sapiens; Escherichia coli* |
| 1873 | 222 | 105 | *Mycobacterium tuberculosis; Streptomyces coelicolor; Oryza Sativa; Pseudomonas aeruginosa; Micromonospora chersina; Halobacterium* sp. NRC-1; *Homo sapiens Deinococcus radiodurans; Zea mays* |
| 1904 | 223 | 30 | *Mycobacterium avium* subsp. *avium* |
| 1905 | 224 | 30 | *Mycobacterium avium* subsp. *avium* |
| 1906 | 225 | 38 | *Burkholderia fungorum* |
| 2459 | 226 | 39 | *Magnetospirillum magnetotacticum; Mesorhizobium loti; Propionibacterium freudenreichii; Streptomyces coelicolor; Xanthomonas campestris* |
| 2476 | 227 | 51 | *Mycobacterium tuberculosis; Streptomyces coelicolor; Oryza sativa; Homo sapiens; Spodoptera frugiperda; Rhodospirillum rubrum; Thermobifida fusca; Streptomyces lividans; Corynebacterium efficiens* |
| 2634 | 228 | 78 | *Mycobacterium kansasii; Burkholderia fungorum; Ralstonia solanacearum; Halobacterium* sp.; *Sinorhizobium meliloti* |
| 2842 | 229 | 44 | *Gallus gallus; Ralstonia solanacearum; Mycobacterium avium; Streptomyces avermitilis; Streptomyces* sp. |
| 2863 | 230 | 32 | *Thermobifida fusca* |
| 2865 | 231 | 77 | *Mycobacterium tuberculosis; Streptomyces coelicolor; Micromonospora megalomicea* subsp. *nigra megalomicin* |
| 2932 | 232 | 80 | *Mycobacterium leprae; Mycobacterium tuberculosis; Amycolatopsis* sp.; *Oryza sativa; Ralstonia solanacearum; Streptomyces coelicolor* |
| 3034 | 233 | 32 | *Mycobacterium leprae; Corynebacterium efficiens; Oryza sativa* |
| 3156 | 234 | 32 | *Mus musculus* |
| 3254 | 235 | 30 | *Mycobacterium avium* subsp. *avium* |
| 3255 | 236 | 30 | *Mycobacterium avium* subsp. *avium* |
| 3256 | 237 | 30 | *Mycobacterium avium* subsp. *avium* |
| 3257 | 238 | 30 | *Mycobacterium avium* subsp. *avium* |
| 3258 | 239 | 32 | *Mesorhizobium loti; Ralstonia solanacearum* |
| 3260 | 240 | 33 | *Mesorhizobium loti* |
| 3261 | 241 | 39 | *Bacillus halodurans* |
| 3262 | 242 | 30 | *Mycobacterium avium* subsp. *avium* |
| 3358 | 243 | 74 | *Mycobacterium tuberculosis; Mycobacterium leprae; Oryza sativa; Desulfitobacterium hafniense; Xanthomonas campestris; Bovine herpesvirus; Rhodopseudomonas palustris; Magnetospirillum magnetotacticum* |
| 3614 | 244 | 45 | *Homo sapiens; Klebsiella aerogenes; Enterobacter aerogenes; Pseudomonas* sp.; *Ralstonia metallidurans; Magnetospirillum magnetotacticum; Streptomyces coelicolor; Pseudomonas putida; Bos taurus; Rhodobacter sphaeroides; Mus musculus* |
| 3681 | 245 | 45 | *Neurospora crassa; Streptomyces avermitilis; Rubrivivax gelatinosus; Pseudomonas putida; Hordeum vulgare; Pseuodmonas stutzeri; Halobacterium* sp. NCR-1; *Thermus thermophilus; Caenorhabditis elegans* |
| 3695 | 246 | 30 | *Mycobacterium avium* subsp. *avium* |
| 3696 | 247 | 30 | *Mycobacterium avium* subsp. *avium* |
| 3697 | 248 | 30 | *Mycobacterium avium* subsp. *avium* |
| 3698 | 249 | 30 | *Mycobacterium avium* subsp. *avium* |
| 3699 | 250 | 30 | *Mycobacterium avium* subsp. *avium* |
| 3700 | 251 | 30 | *Mycobacterium avium* subsp. *avium* |
| 3701 | 252 | 32 | *Homo sapiens* |
| 3702 | 253 | 38 | *Streptomyces coelicolor; Caulobacter crescentus* |
| 3703 | 254 | 30 | *Mycobacterium avium* subsp. *avium* |

TABLE 1-continued

| Fragment Designation | SEQ ID NO: | N (nt) | Organisms |
|---|---|---|---|
| 3704 | 255 | 33 | *Rhodobacter sphaeroides* |
| 3705 | 256 | 75 | *Mycobacterium tuberculosis* |
| 3852 | 257 | 44 | *Streptomyces coelicolor; Homo sapiens; Novosphingobium aromaticivorans; Pan troglodytes; Mus musculus; Apteronotus albifrons; Ralstonia solanacearum; Sus scofa; Gallus gallus; Oryza sativa* |
| 3876 | 258 | 30 | *Mycobacterium avium* subsp. *avium* |
| 3877 | 259 | 30 | *Mycobacterium avium* subsp. *avium* |
| 3878 | 260 | 30 | *Mycobacterium avium* subsp. *avium* |
| 3880 | 261 | 32 | *Mesorhizobium loti; Rhodopseudomonas palustris; Ralstonia solanacearum* |
| 3881 | 262 | 33 | *Mesorhizobium loti; Rhodobacter sphaeroides* |
| 3882 | 263 | 30 | *Mycobacterium avium* subsp. *avium* |
| 3883 | 264 | 39 | *Bacillus halodurans* |
| 3884 | 265 | 30 | *Mycobacterium avium* subsp. *avium* |
| 4008 | 266 | 42 | *Streptomyces coelicolor; Mycobacterium tuberculosis; Mycobacterium leprae; Deinococcus radiodurans; Agrobacterium tumefaciens; Caulobacter crescentus* |
| 4412 | 267 | 32 | *Mycobacterium tuberculosis; Homo sapiens; Desulfitobacterium hafniense;* |
| 4769 | 268 | 44 | *Mycobacterium tuberculosis; Novosphingobium aromaticivorans; Homo sapiens; Cricetulus griseus;* Suid herpesvirus; *Oryza sativa; Streptomyces bambergiensis; Mus musculus; Caenorhabditis elegans* |
| 4769 | 269 | 30 | *Mycobacterium avium* subsp. *avium* |
| 4824 | 270 | 44 | *Mycobacterium tuberculosis; Gallus gallus; Oryza sativa; Caulobacter crescentus* |
| 4976 | 271 | 54 | *Mycobacterium tuberculosis; Oryza sativa; Mycobacterium bovis; Homo sapiens; Novosphingobiuum aromaticivorans; Mus musculus; Streptomyces coelicolor; Deinococcus radiodurans; Chlamydomonas reinhardtii* |
| 5008 | 272 | 32 | *Escherichia coli* |
| 5010 | 273 | 44 | *Rhodococcus* sp.; *Mesorhizobium loti* |
| 5012 | 274 | 30 | *Mycobacterium avium* subsp. *avium* |
| 5103 | 275 | 51 | *Ralstonia solanacearum; Pseudomonas aeruginosa; Homo sapiens; Escherichia coli; Mesorhizobium loti; Deinococcus radiodurans; Rhodopseudomonas palusiris; Oryza sativa; Mycobacterium tuberculosis* |
| 5119 | 276 | 53 | *Mycobacterium tuberculosis; Mycobacterium leprae; Oryza sativa; Home sapiens; Drosophila melanogaster; Rhodobacter capsulatus; Alpha proteobacterium;* Arabis mosaic virus |
| 5186 | 277 | 54 | *Streptomyces coelicoler; Streptomyces galbus* |
| 5188 | 278 | 54 | *Mycobacterium tuberculosis; Streptomyces coelicolor; Homo sapiens; Rhodopseudomonas palustris; Desulfitobacterium hafniense; Mus musculus* |
| 5306 | 279 | 54 | *Mycobacterium tuberculosis* |
| 5316 | 280 | 30 | *Mycobacterium avium* subsp. *avium* |
| 5317 | 281 | 30 | *Mycobacterium avium* subsp. *avium* |
| 5326 | 282 | 30 | *Mycobacterium avium* subsp. *avium* |
| 5328 | 283 | 36 | *Pseudomonas putida; Magnetospirillum magnetotacticum; Mycobacterium tuberculosis; Oryza sativa* |
| 5340 | 284 | 30 | *Mycobacterium avium* subsp. *avium* |
| 5341 | 285 | 30 | *Mycobacterium avium* subsp. *avium* |
| 5342 | 286 | 30 | *Mycobacterium avium* subsp. *avium* |
| 5343 | 287 | 32 | *Homo sapiens* |
| 5344 | 288 | 30 | *Mycobacterium avium* subsp. *avium* |
| 5345 | 289 | 38 | *Mesorhizobium loti; Mycobacterium tuberculosis* |
| 5346 | 290 | 50 | *Mycobacterium tuberculosis; Xanthomonas axonopodis; Mycobacterium leprae; Xanthomonas campestris* |
| 5348 | 291 | 45 | *Home sapiens* |
| 5349 | 292 | 38 | *Home sapiens; Caulobacter crescentus* |
| 5350 | 293 | 30 | *Mycobacterium avium* subsp. *avium* |
| 5351 | 294 | 53 | *Mycobacterium marinum; Mycobacterium ulcerans; Leishmania infantum; Desulfitobacterium hafniense; Rhizobium meliloti; Oryza sativa* |
| 5352 | 295 | 50 | *Homo sapiens;* Bovine herpesvirus; *Oryza sativa; Mus musculus; Burkholderia pseudomallei; Zea mays* |
| 5353 | 296 | 39 | *Anopheles gambiae; Ralstonia solanacearum; Drosophila melanogaster; Poncirus trifoliata* |
| 5354 | 297 | 38 | *Rhodobacter sphaeroides* |
| 5355 | 298 | 50 | *Pseudomonas syringae* |
| 5356 | 299 | 39 | *Streptomyces coelicolor; Magnetospirillum magnetotacticum* |
| 5357 | 300 | 38 | *Homo sapiens* |

TABLE 1-continued

| Fragment Designation | SEQ ID NO: | N (nt) | Organisms |
|---|---|---|---|
| 5358 | 301 | 32 | Desulfitobacterium hafniense; Rhizobium meliloti |
| 5360 | 302 | 44 | Drosophila melanogasler; Ralstonia solanacearum |
| 5361 | 303 | 62 | Bifidobacterium longum; Azotobacter vinelandii; Rhodospirillum rubrum; Ralstonia solanacearum; Sinorhizobium meliloti; Streptomyces lincolnensis; Oryza sativa; Xanthomonas axonopodis; Caulobacter crescentus; Pseudomonas putida; Mycobacterium phage DS6A; Pseudomonas fluorescens; Burkholderia fungorum; Pseudomonas syringae; Mycobacterium tuberculosis; Streptomyces coelicolor; Pseudomonas aeruginosa |
| 5362 | 304 | 50 | Ralstonia solanacearum |
| 5363 | 305 | 38 | Azotobacter vinelandii; Pseudomonas putida |
| 5364 | 306 | 32 | Corynebacterium efficiens |
| 5365 | 307 | 38 | Pseudomonas aeruginosa; Synechococcus sp. |
| 5366 | 308 | 33 | Corynebacterium glutamicum |
| 5367 | 309 | 30 | Mycobacterium avium subsp. avium |
| 5368 | 310 | 32 | Nitrosomonas europaea |
| 5369 | 311 | 30 | Mycobacterium avium subsp. avium |
| 5370 | 312 | 32 | Pan troglodytes; Homo sapiens |
| 5371 | 313 | 30 | Mycobacterium avium subsp. avium |
| 5372 | 314 | 38 | Gluconacetobacter xylinus |
| 5390 | 315 | 30 | Mycobacterium avium subsp. avium |
| 5391 | 316 | 30 | Mycobacterium avium subsp. avium |
| 5417 | 317 | 30 | Mycobacterium avium subsp. avium |
| 5418 | 318 | 32 | Homo sapiens |
| 5419 | 319 | 38 | Rhodopseudomonas palustris; Homo sapiens; Streptomyces noursei; Streptomyces coelicolor; Oryza sativa |
| 5420 | 320 | 32 | Streptomyces coelicolor; Streptomyces lividans |
| 5421 | 321 | 30 | Mycobacterium avium subsp. avium |
| 5422 | 322 | 32 | Rhodopseudomonas palustris |
| 5423 | 323 | 35 | Synechococcus sp. |
| 5424 | 324 | 30 | Mycobacterium avium subsp. avium |
| 5425 | 325 | 30 | Mus musculus |
| 5426 | 326 | 30 | Mycobacterium avium subsp. avium |
| 5427 | 327 | 30 | Mycobacterium avium subsp. avium |
| 5428 | 328 | 35 | Homo Sapiens; Comamonas sp. |
| 5429 | 329 | 30 | Mycobacterium avium subsp. avium |
| 5430 | 330 | 50 | Corynebacterium glutamicum; Burkholderia fungorum |
| 5431 | 331 | 30 | Mus musculus |
| 5432 | 332 | 50 | Streptomyces maritimus; Streptomyces clavuligerus; Streptomyces lavendulae; Streptomyces roseofulvus |
| 5433 | 333 | 30 | Homo sapiens |
| 5434 | 334 | 30 | Mycobacterium avium subsp. avium |
| 5435 | 335 | 35 | Streptomyces clavuligerus |
| 5436 | 336 | 45 | Ralstonia eutropha |
| 5437 | 337 | 40 | Rhodobacter sphaeroides; Thermobifida fusca |
| 5438 | 338 | 30 | Mycobacterium avium subsp. avium |
| 5439 | 339 | 30 | Mycobacterium avium subsp. avium |
| 5440 | 340 | 30 | Mycobacterium avium subsp. avium |
| 5441 | 341 | 45 | Oryza sativa; Zea mays |
| 5442 | 342 | 30 | Mycobacterium avium subsp. avium |
| 5443 | 343 | 30 | Mycobacterium avium subsp. avium |
| 5444 | 344 | 36 | Haloferax volcanii; Burkholderia fungorum |
| 5445 | 345 | 40 | Streptomyces coelicolor; Ralstonia solanacearum |
| 5446 | 346 | 30 | Mycobacterium avium subsp. avium |
| 5447 | 347 | 45 | Ralstonia solanacearum |
| 5448 | 348 | 45 | Felis catus |
| 5449 | 349 | 30 | Mycobacterium avium subsp. avium |
| 5450 | 350 | 30 | Mycobacterium avium subsp. avium |
| 5451 | 351 | 35 | Burkholderia fungorum |
| 5452 | 352 | 30 | Mycobacterium avium subsp. avium |
| 5453 | 353 | 92 | Desulfitobacterium hafniense; Streptomyces coelicolor; Pseudomonas syringae pv. syringae; Streptomyces verticillus; Streptomyces avermitilis; Lysobacter sp. (ATCC 53042); Mycobacterium smegmatis; Ralstonia solanacearum; Streptomyces chrysomallus; Stigmatella aurantiaca; Streptomyces lavendulae; Streptomcyes toyocaensis; Mesorhizobium loti; Saccharothrix mutabilis subsp. capreolus nonribosoma; Pseudomonas aeruginosa; Synechococcus sp. |
| 5454 | 354 | 30 | Mycobacterium avium subsp. avium |
| 5455 | 355 | 33 | Halo ferax mediterranei |

TABLE 1-continued

| Fragment Designation | SEQ ID NO: | N (nt) | Organisms |
|---|---|---|---|
| 5456 | 356 | 65 | *Ralstonia solanacearum*; *Streptomyces verticillus*; *Streptomyces coelicolor*; *Desulfitobacterium hafniense*; *Streptomyces noursei* |
| 5457 | 357 | 30 | *Mycobacterium avium* subsp. *avium* |
| 5458 | 358 | 57 | *Streptomyces verticillus*; *Streptomyces chrysomallus*; *Streptomyces avermitilis*; *Pseudomonas syringae* pv. *syringae*; *Streptomyces coelicolor*; *Streptomyces lavendulae*; *Azotobacter vinelandii*; *Pseudomonas fluorescens*; *Magnetospirillum magnetotacticum*; *Thermobifida fusca*; *Desulfitobacterium hafniense*; *Ralstonia solanacearum* |
| 5459 | 359 | 30 | *Mycobacterium avium* subsp. *avium* |
| 5460 | 360 | 30 | *Mycobacterium avium* subsp. *avium* |
| 5461 | 361 | 30 | *Mycobacterium avium* subsp. *avium* |
| 5462 | 362 | 32 | *Leishmania major* |
| 5463 | 363 | 37 | *Burkholderia fungorum*; *Nitrosomonas europaea*; *Pseudomonas* sp. |
| 5464 | 364 | 41 | *Pseudomonas putida*; *Sinorhizobium meliloti* |
| 5465 | 365 | 32 | *Rhodobacter capsulatus*; Rat cytomegalovirus |
| 5466 | 366 | 37 | *Pseudomonas fluorescens*; *Rhodopseudomonas palustris* |
| 5467 | 367 | 30 | *Mycobacterium avium* subsp. *avium* |
| 5468 | 368 | 33 | *Rhodobacter sphaeroides* |
| 5469 | 369 | 37 | *Rhodobacter sphaeroides*; *Oryza sativa*; *Homo sapiens* |
| 5470 | 370 | 40 | *Bifidobacterium longum*; *Caulobacter maris*; *Xanthomonas axonopodis pv. citri* |
| 5471 | 371 | 33 | *Burkholderia fungorum*; *Streptomyces avermitilis* |
| 5472 | 372 | 50 | *Streptomyces coelicolor* |
| 5473 | 373 | 39 | *Rhodobacter sphaeroides*; *Mycobacterium tuberculosis*; *Pseudomonas aeruginosa* |
| 5474 | 374 | 45 | *Pseudomonas aeruginosa* |
| 5475 | 375 | 30 | *Mycobacterium avium* subsp. *avium* |
| 5476 | 376 | 45 | *Xanthomonas campestris pv. Campestris* (ATCC 3391) |
| 5477 | 377 | 44 | *Mesorhizobium loti*; *Azotobacter vinelandii*; *Salmonella enterica serovar typhi* |
| 5478 | 378 | 30 | *Mycobacterium avium* subsp. *avium* |
| 5479 | 379 | 37 | *Zea mays* |
| 5480 | 380 | 30 | *Mycobacterium avium* subsp. *avium* |
| 5481 | 381 | 30 | *Mycobacterium avium* subsp. *avium* |
| 5482 | 382 | 30 | *Mycobacterium avium* subsp. *avium* |
| 5483 | 383 | 33 | *Leishmania major* |
| 5484 | 384 | 32 | *Homo sapiens*; *Ralstonia solanacearum* |
| 5485 | 385 | 30 | *Mycobacterium avium* subsp. *avium* |
| 5486 | 386 | 30 | *Mycobacterium avium* subsp. *avium* |
| 5487 | 387 | 32 | *Caulobacter crescentus pv. citri* |
| 5488 | 388 | 32 | *Xanthomonas axonopodis* |
| 5489 | 389 | 35 | *Sinorhizobium meliloti* |
| 5490 | 390 | 50 | *Pseudomonas syringae pv. syringae*; *Xanthomonas axonopodis pv. citri*; *Shigella flexneri* |
| 5491 | 391 | 32 | *Leishmania major* |
| 5492 | 392 | 74 | *Pseudomonas fluorescens*; *Pseudomonas aeruginosa*; *Sorangium cellulosum*; *Drosophila melanogaster* |
| 5493 | 393 | 83 | *Yersinia enterocolitica*; *Yersinia pestis*; *Azotobacter vinelandii*; *Escherichia coli*; *Ralstonia solanacearum*; *Streptomyces avermitilis*; *Pseudomonas fluorescens*; *Mycobacterium smegmatis*; *Streptomyces verticillus*; *Streptomyces atroolivaceus* |
| 5494 | 394 | 50 | *Mesorhizobium loti*; *Oryza sativa*; *Novosphingobium aromaticivorans*; *Halobacterium* sp. NRC-1; *Torrubiella arachnophilus* |
| 5495 | 395 | 33 | *Agrobacterium tumefaciens* |
| 5496 | 396 | 30 | *Mycobacterium avium* subsp. *avium* |
| 5497 | 397 | 32 | *Streptomyces coelicolor* |
| 5498 | 398 | 30 | *Mycobacterium avium* subsp. *avium* |
| 5499 | 399 | 30 | *Mycobacterium avium* subsp. *avium* |
| 5501 | 400 | 44 | *Oryza sativa* |
| 5502 | 401 | 35 | *Xanthomonas campestris pv. campestris* (ATCC 3391) |
| 5503 | 402 | 33 | *Corynebacterium efficiens* |
| 5504 | 403 | 30 | *Mycobacterium avium* subsp. *avium* |
| 5505 | 404 | 30 | *Mycobacterium avium* subsp. *avium* |
| 5506 | 405 | 30 | *Mycobacterium avium* subsp. *avium* |
| 5507 | 406 | 30 | *Mycobacterium avium* subsp. *avium* |
| 5508 | 407 | 30 | *Mycobacterium avium* subsp. *avium* |
| 5509 | 408 | 37 | *Mus musculus*; *Homo sapiens* |
| 5510 | 409 | 30 | *Mycobacterium avium* subsp. *avium* |
| 5511 | 410 | 30 | *Mycobacterium avium* subsp. *avium* |

TABLE 1-continued

| Fragment Designation | SEQ ID NO: | N (nt) | Organisms |
|---|---|---|---|
| 5512 | 411 | 37 | Pseudomonas fluorescens |
| 5513 | 412 | 44 | Rhodospirillum rubrum; Xanthomonas axonopodis pv. citri |
| 5514 | 413 | 37 | Plasmodium vivax |
| 5515 | 414 | 32 | Pseudomonas putida |
| 5516 | 415 | 32 | Ralstonia solanacearum |
| 5517 | 416 | 30 | Mycobacterium avium subsp. avium |
| 5518 | 417 | 37 | Streptomyces coelicolor |
| 5519 | 418 | 30 | Mycobacterium avium subsp. avium |
| 5520 | 419 | 49 | Anopheles stephensi; Drosophila melanogaster |
| 5524 | 420 | 30 | Mycobacterium avium subsp. avium |
| 5525 | 421 | 30 | Mycobacterium avium subsp. avium |
| 5526 | 422 | 30 | Mycobacterium avium subsp. avium |
| 5527 | 423 | 37 | Mus musculus |
| 5528 | 424 | 30 | Mycobacterium avium subsp. avium |
| 5529 | 425 | 32 | Ralstonia solanacearum |
| 5530 | 426 | 30 | Mycobacterium avium subsp. avium |
| 5531 | 427 | 37 | Azotobacter vinelandii |
| 5532 | 428 | 32 | Schizosaccharomyces pombe |
| 5533 | 429 | 33 | Streptomyces fradiae |
| 5535 | 430 | 105 | Mycobacterium avium; Desulfitobacterium hafniense |
| 5538 | 431 | 119 | Streptomyces fradiae; Mycobacterium avium subsp. avium; Homo sapiens; Synechococcus sp. |
| 5539 | 432 | 80 | Mycobacterium avium |
| 5541 | 433 | 71 | Mycobacterium avium; Sinorhizobium meliloti |
| 5542 | 434 | 30 | Mycobacterium avium subsp. avium |
| 5543 | 435 | 30 | Mycobacterium avium subsp. avium |
| 5544 | 436 | 37 | Triglochin maritima |
| 5545 | 437 | 30 | Mycobacterium avium subsp. avium |
| 5546 | 438 | 32 | Pseudomonas syringae pv. syringae |
| 5547 | 439 | 37 | Mycobacterium tuberculosis |
| 5548 | 440 | 37 | Mycobacterium leprae |
| 5550 | 441 | 146 | Mycobacterium tuberculosis; Mycobacterium smegmatis; Mycobacterium avium (strain 2151) |
| 5551 | 442 | 54 | Mycobacterium tuberculosis |
| 5553 | 443 | 111 | Mycobacterium tuberculosis; Mycobacterium leprae, Mycobacterium avium (strain 2151) |
| 5555 | 444 | 101 | Mycobacterium tuberculosis |
| 5556 | 445 | 30 | Mycobacterium avium subsp. avium |
| 5558 | 446 | 77 | Mycobacterium avium (strain 2151); Mycobacterium tuberculosis; Plasmodium falciparum; Thermobifida fusca; Mus musculus; Xanthomonas campestris pv. Campestris (ATCC 3391); Mycobacterium smegmatis; Medicago truncatula |
| 5559 | 447 | 108 | Mycobacterium tuberculosis |
| 5567 | 448 | 53 | Mycobacterium tuberculosis |
| 5568 | 449 | 30 | Mycobacterium avium subsp. avium |
| 5569 | 450 | 77 | Mycobacterium tuberculosis |
| 5570 | 451 | 71 | Mycobacterium leprae |
| 5571 | 452 | 30 | Mycobacterium avium subsp. avium |
| 5572 | 453 | 102 | Mycobacterium tuberculosis; Mycobacterium bovis |
| 5573 | 454 | 30 | Mycobacterium avium subsp. avium |
| 5574 | 455 | 32 | Rattus norvegicus |
| 5575 | 456 | 30 | Mycobacterium avium subsp. avium |
| 5576 | 457 | 30 | Mycobacterium avium subsp. avium |
| 5577 | 458 | 30 | Mycobacterium avium subsp. avium |
| 5578 | 459 | 32 | Bacteroides thetaiotaomicron |
| 5579 | 460 | 30 | Mycobacterium avium subsp. avium |
| 5580 | 461 | 30 | Mycobacterium avium subsp. avium |
| 5581 | 462 | 30 | Mycobacterium avium subsp. avium |
| 5582 | 463 | 35 | Pseudomonas aeruginosa |
| 5583 | 464 | 37 | Mycobacterium tuberculosis |
| 5584 | 465 | 30 | Mycobacterium avium subsp. avium |
| 5585 | 466 | 32 | Homo sapiens |
| 5586 | 467 | 44 | Salmonella enterica serovar typhi; Salmonella typhimurium |
| 5587 | 468 | 30 | Caenorhabditis elegans |
| 5588 | 469 | 30 | Mycobacterium avium subsp. avium |
| 5589 | 470 | 75 | Streptomyces lavendulae; Mycobacterium tuberculosis; Homo sapiens; Mus musculus |
| 5590 | 471 | 30 | Mycobacterium avium subsp. avium |
| 5591 | 472 | 30 | Mycobacterium avium subsp. avium |
| 5592 | 473 | 30 | Mycobacterium avium subsp. avium |
| 5593 | 474 | 30 | Homo sapiens |
| 5594 | 475 | 30 | Homo sapiens |

TABLE 1-continued

| Fragment Designation | SEQ ID NO: | N (nt) | Organisms |
|---|---|---|---|
| 5595 | 476 | 30 | Mycobacterium avium subsp. avium |
| 5596 | 477 | 30 | Mycobacterium avium subsp. avium |
| 5597 | 478 | 30 | Mycobacterium avium subsp. avium |
| 5598 | 479 | 36 | Burkholderia fungorum |
| 5599 | 480 | 30 | Homo sapiens |
| 5600 | 481 | 30 | Mycobacterium avium subsp. avium |
| 5601 | 482 | 65 | Mycobacterium tuberculosis |
| 5609 | 483 | 100 | Mycobacterium tuberculosis |
| 5610 | 484 | 55 | Mycobacterium tuberculosis |
| 5611 | 485 | 30 | Mus musculus |
| 5612 | 486 | 30 | Danio rerio |
| 5613 | 487 | 30 | Mycobacterium avium subsp. avium |
| 5614 | 488 | 36 | Salmonella enteritidis |
| 5615 | 489 | 30 | Mycobacterium avium subsp. avium |
| 5616 | 490 | 110 | Mycobacterium tuberculosis; Mycobacterium avium; Mycobacterium leprae; Nocardia brasiliensis; Streptomyces antibioticus; Streptomyces galilaeus; Streptomyces avermitilis; Agrobacterium tumefaciens; Streptomyces narbonensis |
| 5617 | 491 | 75 | Mycobacterium tuberculosis; Mycobacterium leprae; Xanthomonas axonopodis |
| 5618 | 492 | 50 | Mycobacterium avium |
| 5619 | 493 | 30 | Mycobacterium avium subsp. avium |
| 5620 | 494 | 30 | Mycobacterium avium subsp. avium |
| 5621 | 495 | 30 | Mycobacterium avium subsp. avium |
| 5622 | 496 | 30 | Nostoc sp. |
| 5623 | 497 | 30 | Mycobacterium avium subsp. avium |
| 5624 | 498 | 30 | Mycobacterium avium subsp. avium |
| 5625 | 499 | 60 | Mycobacterium tuberculosis; Xanthomonas axonopodis |
| 5626 | 500 | 30 | Mycobacterium avium subsp. avium |
| 5627 | 501 | 75 | Mycobacterium tuberculosis |
| 5628 | 502 | 30 | Mycobacterium avium subsp. avium |
| 5629 | 503 | 30 | Burkholderia fungorum |
| 5630 | 504 | 80 | Mycobacterium tuberculosis |
| 5631 | 505 | 110 | Mycobacterium tuberculosis |
| 5633 | 506 | 65 | Mycobacterium tuberculosis |
| 5634 | 507 | 80 | Mycobacterium tuberculosis; Mycobacterium bovis |
| 5635 | 508 | 110 | Mycobacterium tuberculosis; Mycobacterium leprae; Mycobacterium bovis |
| 5639 | 509 | 55 | Mycobacterium tuberculosis; Homo sapiens; Pseudomonas fluorescens; Oryza sativa |
| 5640 | 510 | 60 | Rhodospirillum rubrum; Mycobacterium bovis; Mycobacterium tuberculosis |
| 5641 | 511 | 30 | Mycobacterium avium subsp. avium |
| 5642 | 512 | 30 | Mycobacterium avium subsp. avium |
| 5643 | 513 | 45 | Mycobacterium bovis; Mycobacterium tuberculosis; Mus musculus |
| 5644 | 514 | 45 | Sorangium cellulosum |
| 5645 | 515 | 30 | Mycobacterium avium subsp. avium |
| 5646 | 516 | 65 | Mycobacterium tuberculosis; Myxococcus xanthus |
| 5647 | 517 | 37 | Azotobacter vinelandii; Mycobacterium tuberculosis |
| 5648 | 518 | 75 | Mycobacterium leprae; Mycobacterium bovis; Mycobacterium tuberculosis; Azotobacter vinelandii; Streptomyces sp.; Mus musculus |
| 5649 | 519 | 120 | Mycobacterium tuberculosis; Mycobacterium bovis; Stigmatella aurantiaca; Micromonospora megalomicea; Streptomyces hygroscopicus |
| 5650 | 520 | 110 | Mycobacterium tuberculosis; Mycobacterium bovis; Bovine herpesvirus; Pseudomonas aeruginosa |
| 5652 | 521 | 70 | Mycobacterium tuberculosis; Mycobacterium leprae; Streptomyces avermitilis |
| 5653 | 522 | 50 | Mycobacterium tuberculosis |
| 5654 | 523 | 95 | Saccharopolyspora erythraea; Mycobacterium leprae; Mycobacterium tuberculosis; Homo sapiens; Caulobacter crescentus; Mus musculus; Streptomyces nodosus |
| 5657 | 524 | 55 | Mesorhizobium loti; Mycobacterium tuberculosis |
| 5658 | 525 | 55 | Mycobacterium bovis; Mycobacterium tuberculosis; Streptomyces sp. |
| 5660 | 526 | 75 | Mycobacterium tuberculosis |
| 5661 | 527 | 30 | Sinorhizobium meliloti |
| 5662 | 528 | 75 | Mycobacterium tuberculosis; Amycolatopsis orientalis |
| 5663 | 529 | 75 | Mycobacterium tuberculosis |
| 5665 | 530 | 30 | Gallus gallus |
| 5667 | 531 | 45 | Desulfitobacterium hafniense; Ralstonia solanacearum; Streptomyces coelicolor; Oryza sativa; Zea mays |

TABLE 1-continued

| Fragment Designation | SEQ ID NO: | N (nt) | Organisms |
|---|---|---|---|
| 5669 | 532 | 60 | *Mycobacterium tuberculosis*; *Desulfitobacterium hafniense*; *Oryza sativa* |
| 5679 | 533 | 30 | *Mycobacterium avium* subsp. *avium* |
| 5681 | 534 | 30 | *Mycobacterium avium* subsp. *avium* |
| 5682 | 535 | 30 | *Mycobacterium avium* subsp. *avium* |
| 5686 | 536 | 45 | *Mycobacterium avium* |
| 5688 | 537 | 30 | *Myxococcus xanthus*; *Ralstonia metallidurans* |
| 5690 | 538 | 30 | *Mycobacterium avium* subsp. *avium* |
| 5691 | 539 | 48 | *Corynebacterium efficiens*; *Novosphingobium aromaticivorans*; *Escherichia coli* |
| 5692 | 540 | 30 | *Mycobacterium avium* subsp. *avium* |
| 5693 | 541 | 30 | *Mycobacterium avium* subsp. *avium* |
| 5694 | 542 | 30 | *Mycobacterium avium* subsp. *avium* |
| 5695 | 543 | 33 | *Amycolatopsis orientalis* |
| 5697 | 544 | 55 | *Magnetospirillum magnetotacticum*; *Ralstonia solanacearum*; *Caulobacter crescentus* |
| 5700 | 545 | 32 | *Enterococcus saccharolyticus* |
| 5701 | 546 | 30 | *Mycobacterium avium* subsp. *avium* |
| 5702 | 547 | 32 | *Oryza sativa* |
| 5703 | 548 | 30 | *Mycobacterium avium* subsp. *avium* |
| 5704 | 549 | 30 | *Mycobacterium avium* subsp. *avium* |
| 5705 | 550 | 32 | *Magnetospirillum magnetotacticum* |
| 5707 | 551 | 30 | *Mycobacterium avium* subsp. *avium* |
| 5708 | 552 | 30 | *Mycobacterium avium* subsp. *avium* |
| 5709 | 553 | 62 | *Mycobacterium tuberculosis*; *Bifidobacterium longum*; *Neisseria meningitides*; *Bifidobacterium longum*; *Streptomyces avermitilis*; *Mesorhizobium loti*; *Chloroflexus aurantiacus*; *Xylella fastidiosa*; *Pseudomonas syringae* pv. *syringae*; *Corynebacterium efficiens*; *Agrobacterium tumefaciens*; *Nitrosomonas europaea*; *Rhodobacter capsulatus*; *Ralstonia solanacearum*; *Sinorhizobium meliloti*; *Halobacterium* sp. |
| 5710 | 554 | 70 | *Rhodospirillum rubrum*; *Pseudomonas resinovorans* |
| 5711 | 555 | 30 | *Mycobacterium avium* subsp. *avium* |
| 5712 | 556 | 30 | *Mycobacterium avium* subsp. *avium* |
| 5713 | 557 | 39 | *Pseudomonas aeruginosa*; *Ralstonia metallidurans*; *Xanthomonas campestris*; *Xanthomonas axonopodis* |
| 5714 | 558 | 30 | *Mycobacterium avium* subsp. *avium* |
| 5715 | 559 | 32 | *Pseudomonas aeruginosa* |
| 5716 | 560 | 30 | *Mycobacterium avium* subsp. *avium* |
| 5746 | 561 | 138 | *Mycobacterium leprae*; *Mycobacterium tuberculosis*; *Homo sapiens*; *Streptomyces coelicolor*; *Oryza sativa* |
| 5767 | 562 | 42 | *Oryza sativa*; *Triticum aestivum*; *Ralstonia solanacearum*; *Agrobacterium tumefaciens*; *Drosophila melanogaster*; *Hordeum vulgare* |
| 5859 | 563 | 44 | *Homo sapiens*; *Festuca arundinacea*; *Oryza sativa*; *Rhodospirillum rubrum*; *Magnetospirillum magnetotacticum*; *Lolium perenne*; *Mesorhizobium loti*; *Xanthomonas axonopodis*; *Caulobacter crescentus*; *Chlamydomonas reinhardtii* |
| 5860 | 564 | 48 | *Homo sapiens*; *Rhodospirillum rubrum*; *Ralstonia solanacearum*; *Mus musculus*; *Mycobacterium tuberculosis*; *Oryza sativa*; *Streptomyces coelicolor* |
| 5922 | 565 | 30 | *Mycobacterium avium* subsp. *avium* |
| 5923 | 566 | 86 | *Mycobacterium leprae*; *Pseudomonas aeruginosa* |
| 5925 | 567 | 39 | *Mycobacterium leprae* |
| 5926 | 568 | 39 | *Mycobacterium leprae*; *Streptomyces nodosus*; *Rhodospirillum rubrum*; *Magnetospirillum magnetotacticum*; *Novosphingobium aromaticivorans* |
| 5929 | 569 | 30 | *Mycobacterium avium* subsp. *avium* |
| 5933 | 570 | 32 | *Homo sapiens* |
| 5934 | 571 | 30 | *Mycobacterium avium* subsp. *avium* |
| 5935 | 572 | 30 | *Mycobacterium avium* subsp. *avium* |
| 5936 | 573 | 30 | *Mycobacterium avium* subsp. *avium* |
| 5937 | 574 | 30 | *Mycobacterium avium* subsp. *avium* |
| 5938 | 575 | 30 | *Mycobacterium avium* subsp. *avium* |
| 5939 | 576 | 30 | *Mycobacterium avium* subsp. *avium* |
| 5940 | 577 | 30 | *Mycobacterium avium* subsp. *avium* |
| 5941 | 578 | 32 | *Pseudomonas putida* |
| 5942 | 579 | 30 | *Mycobacterium avium* subsp. *avium* |
| 5943 | 580 | 30 | *Mycobacterium avium* subsp. *avium* |
| 5944 | 581 | 32 | *Saccharomyces cerevisiae* |
| 5945 | 582 | 30 | *Mycobacterium avium* subsp. *avium* |
| 5946 | 583 | 33 | *Mus musculus* |
| 5947 | 584 | 30 | *Mycobacterium avium* subsp. *avium* |

TABLE 1-continued

| Fragment Designation | SEQ ID NO: | N (nt) | Organisms |
|---|---|---|---|
| 5948 | 585 | 30 | *Mycobacterium avium* subsp. *avium* |
| 5949 | 586 | 30 | *Mycobacterium avium* subsp. *avium* |
| 5950 | 587 | 32 | *Brucella melitensis*; *Brucella suis* |
| 5951 | 588 | 32 | *Desulfitobacterium hafniense* |
| 5952 | 589 | 30 | *Mycobacterium avium* subsp. *avium* |
| 5953 | 590 | 51 | *Rhodopseudomonas palustris* |
| 5954 | 591 | 30 | *Mycobacterium avium* subsp. *avium* |
| 5955 | 592 | 74 | *Mycobacterium leprae*; *Mycobacterium tuberculosis*; *Thermobifida fusca*; *Pseudomonas* sp.; *Streptomyces coelicolor*; *Mycobacterium bovis*; *Pseudomonas fluorescens*; *Bifidobacterium longum*; *Corynebacterium efficiens*; *Rhodospirillum rubrum*; *Corynebacterium glutamicum*; *Agrobacterium tumefaciens*; *Shewanella oneidensis*; *Rhodobacter capsulatus*; *Methanosarcina barkeri*; *Methanosarcina acetivorans* |
| 5969 | 593 | 44 | *Pseudomonas denitrificans*; *Mus musculus*; *Mycobacterium tuberculosis*; Tupaia herpesvirus |
| 5973 | 594 | 50 | *Streptomyces coelicolor*; *Merxmuellera davyi*; *Gallus gallus*; *Magnetospirillum magnetotacticum*; *Rhodobacter capsulatus*; *Deinococcus radiodurans*; *Mus musculus* |
| 5981 | 595 | 41 | *Ralstonia solanacearum*; *Homo sapiens*; *Sus scrofa*; *Oryza sativa*; *Mus musculus* |
| 5995 | 596 | 48 | *Homo sapiens*; *Frankia* sp.; *Phleum pretense*; *Oryza sativa*; *Streptomyces plicatus*; *Mus musculus*; *Canis familiaris*; *Streptomyces violaceoruber*; *Streptomyces coelicolor* |
| 6028 | 597 | 81 | *Mycobacterium tuberculosis*; *Xanthomonas axonopodis*; *Leishmania major* |
| 6053 | 598 | 102 | *Trypanosoma cruzi*; *Crematogaster smithi*; *Salmonella typhimurium*; *Leishmania major*; *Xanthomonas campestris*; *Mus musculus*; *Nitrosomonas europaea*; *Drosophila melanogaster*; *Homo sapiens* |
| 6185 | 599 | 37 | *Streptomyces coelicolor*; *Streptomyces lividans*; *Xanthomonas campestris* |
| 6200 | 600 | 35 | *Acetobacter xylinus* |
| 6201 | 601 | 30 | *Mycobacterium avium* subsp. *avium* |
| 6202 | 602 | 30 | *Mycobacterium avium* subsp. *avium* |
| 6203 | 603 | 33 | *Chlamydomonas reinhardtii* |
| 6204 | 604 | 86 | *Mycobacterium tuberculosis*; *Burkholderia fungorum*; *Corynebacterium efficiens* |
| 6206 | 605 | 38 | *Mycobacterium tuberculosis* |
| 6210 | 606 | 84 | *Mycobacterium tuberculosis*; *Mycobacterium bovis*; *Mycobacterium leprae*; *Polycentropus flavomaculatus*; *Caulobacter crescentus*; *Homo sapiens*; *Burkholderia fungorum*; *Oryza sativa*; *Cowdria ruminantium*; *Pseudomonas aeruginosa* |
| 6230 | 607 | 51 | *Rhodopseudomonas palustris*; *Homo sapiens*; *Oryza sativa*; *Leishmania major*; *Mycobacterium tuberculosis*; *Mesorhizobium loti*; *Ralstonia solanacearum*; *Streptomyces pristinaespiralis*; *Frankia* sp. |
| 6396 | 608 | 33 | *Desulfitobacterium hafniense*; *Mycobacterium tuberculosis* |
| 6400 | 609 | 50 | *Mus musculus*; *Burkholderia fungorum*; *Drosophila melanogaster* |
| 6633 | 610 | 45 | *Ralstonia solanacearum*; *Homo sapiens*; *Caulobacter crescentus*; *Gluconacetobacter xylinus*; *Rhodobacter sphaeroides*; *Rhodospirillum rubrum*; *Mycobacterium leprae*; *Oryza sativa*; *Pseudomonas aeruginosa*; *Pseudomonas putida* |
| 6695 | 611 | 74 | *Homo sapiens*; *Rattus norvegicus*; *Mus musculus* |
| 6773 | 612 | 56 | *Homo sapiens*; *Mus musculus*; *Streptomyces coelicolor*; *Hormoconis resinae*; *Drosophila melanogaster*; *Oryza sativa*; *Gallus gallus* |
| 6892 | 613 | 56 | *Homo sapiens*; *Papio anubis* |
| 6893 | 614 | 30 | *Mycobacterium avium* subsp. *avium* |
| 6894 | 615 | 30 | *Mycobacterium avium* subsp. *avium* |
| 6895 | 616 | 30 | *Mycobacterium avium* subsp. *avium* |
| 6896 | 617 | 32 | *Mesorhizobium loti*; *Mus musculus*; *Rhodopseudomonas palustris* |
| 6897 | 618 | 30 | *Mycobacterium avium* subsp. *avium* |
| 6899 | 619 | 30 | *Mycobacterium avium* subsp. *avium* |
| 6900 | 620 | 30 | *Mycobacterium avium* subsp. *avium* |
| 6901 | 621 | 32 | *Burkholderia fungorum* |
| 6902 | 622 | 32 | *Caenorhabditis elegans* |
| 6903 | 623 | 30 | *Mycobacterium avium* subsp. *avium* |

TABLE 1-continued

| Fragment Designation | SEQ ID NO: | N (nt) | Organisms |
|---|---|---|---|
| 6904 | 624 | 30 | *Mycobacterium avium* subsp. *avium* |
| 6905 | 625 | 33 | *Homo sapiens* |
| 6910 | 626 | 30 | *Mycobacterium avium* subsp. *avium* |
| 6911 | 627 | 32 | *Magnetospirillum magnetotacticum* |
| 6912 | 628 | 33 | *Oryza sativa*; *Rhodobacter sphaeroides*; *Halobacterium* sp. NRC-1 |
| 6987 | 629 | 44 | *Klebsiella pneumoniae*; *Burkholderia fungorum*; *Streptomyces coelicolor*; *Oryza sativa*; *Ralstonia metallidurans*; *Halobacterium* sp. NRC-1 |
| 7088 | 630 | 90 | *Mycobacterium tuberculosis*; *Ralstonia solanacearum*; *Rhodobacter sphaeroides*; *Ralstonia metallidurans*; *Novosphingobium aromaticivorans*; *Desulfitobacterium hafniense*; Bovine herpesvirus type 1 |
| 7089 | 631 | 39 | *Mesorhizobium loti*; *Streptomyces coelicolor*; *Burkholderia fungorum*; *Desulfitobacterium hafniense*; *Oryza sativa*; *Methylovorus* sp. |
| 7113 | 632 | 75 | *Pseudopleyronectes americanus*; *Mycobacterium tuberculosis*; *Mus musculus*; *Urochloa panicoides*; *Oryza sativa*; *Streptomyces coelicolor* |
| 7181 | 633 | 30 | *Mycobacterium avium* subsp. *avium* |
| 7254 | 634 | 30 | *Mycobacterium avium* subsp. *avium* |
| 7363 | 635 | 36 | *Pseudomonas aeruginosa* |
| 7364 | 636 | 36 | *Ralstonia solanacearum* |
| 7365 | 637 | 32 | *Streptomyces coelicolor* |
| 7366 | 638 | 35 | *Zantedeschia aethiopica*; *Streptomyces coelicolor* |
| 7367 | 639 | 32 | *Paucimonas lemoignei* |
| 7562 | 640 | 102 | *Mycobacterium tuberculosis*; *Mus musculus*; *Homo sapiens*; *Desulfitobacterium hafniense*; *Ralstonia solanacearum*; *Salmonella typhimurium* |
| 7592 | 641 | 137 | *Mycobacterium tuberculosis*; *Streptomyces atroolivaceus*; *Ralstonia solanacearum*; *Lysobacter enzymogenes*; *Leishmania major*; *Cupiennius salei*; *Oryza sativa*; *Streptomyces coelicolor*; *Pseudomonas aeruginosa*; Cercopithicine herpesvirus 15 |
| 7731 | 642 | 57 | *Magnetospirillum magnetotacticum*; *Oryza sativa*; *Mycobacterium tuberculosis*; *Desulfitobacterium hafniense*; *Rhodopseudomonas palustris*; *Pseudomonas aeruginosa*; *Homo sapiens* |
| 7762 | 643 | 99 | *Mycobacterium tuberculosis*; *Streptomyces coelicolor*; *Desulfitobacterium hafniense*; *Oryza sativa*; *Streptomyces avermitilis* |
| 7974 | 644 | 38 | *Desulfitobacterium hafniense*; *Oryza sativa*; *Mycobacterium tuberculosis*; *Salmonella typhimurium*; *Pseudomonas fluorescens*; *Azotobacter vinelandii*; *Spermatozopsis similis* |
| 8146 | 645 | 39 | *Oryza sativa*; *Homo sapiens* |
| 8196 | 646 | 119 | *Mycobacterium tuberculosis*; *Mycobacterium leprae*; *Magnetospirillum magnetotacticum*; *Oryza sativa* |
| 8208 | 647 | 57 | *Xanthomonas campestris*; *Mycobacterium tuberculosis*; *Deinococcus radiodurans* |
| 8240 | 648 | 44 | *Chlamydomonas reinhardtii* |
| 8291 | 649 | 93 | *Mycobacterium tuberculosis* |
| 8292 | 650 | 30 | *Mycobacterium avium* subsp. *avium* |
| 8293 | 651 | 30 | *Mycobacterium avium* subsp. *avium* |
| 8294 | 652 | 30 | *Mycobacterium avium* subsp. *avium* |
| 8295 | 653 | 32 | *Mycobacterium tuberculosis* |
| 8296 | 654 | 45 | *Xanthomonas campestris*; *Streptomyces nigrifaciens*; *Streptomyces phaeochromogenes*; *Streptomyces noursei* |
| 8297 | 655 | 30 | *Mycobacterium avium* subsp. *avium* |
| 8298 | 656 | 50 | *Desulfitobacterium hafniense* |
| 8299 | 657 | 30 | *Mycobacterium avium* subsp. *avium* |
| 8300 | 658 | 30 | *Mycobacterium avium* subsp. *avium* |
| 8301 | 659 | 30 | *Mycobacterium avium* subsp. *avium* |
| 8302 | 660 | 30 | *Mycobacterium avium* subsp. *avium* |
| 8303 | 661 | 30 | *Mycobacterium avium* subsp. *avium* |
| 8304 | 662 | 30 | *Mycobacterium avium* subsp. *avium* |
| 8305 | 663 | 30 | *Mycobacterium avium* subsp. *avium* |
| 8306 | 664 | 36 | *Arabidopsis thaliana* |
| 8307 | 665 | 33 | *Xanthomonas axonopodis* |
| 8308 | 666 | 30 | *Mycobacterium avium* subsp. *avium* |
| 8309 | 667 | 37 | *Pseudomonas putida*; *Mycobacterium smegmatis* |
| 8461 | 668 | 37 | *Oryza sativa*; *Homo sapiens* |
| 8619 | 669 | 53 | *Oryza sativa*; *Homo sapiens*; *Rhodospirillum rubrum*; *Rhizobium meliloti* (*Sinorhizobium meliloti*) |
| 8628 | 670 | 32 | *Homo sapiens* |

TABLE 1-continued

| Fragment Designation | SEQ ID NO: | N (nt) | Organisms |
|---|---|---|---|
| 8632 | 671 | 30 | *Mycobacterium avium* subsp. *avium* |
| 8633 | 672 | 30 | *Mycobacterium avium* subsp. *avium* |
| 8634 | 673 | 30 | *Mycobacterium avium* subsp. *avium* |
| 8635 | 674 | 32 | *Homo sapiens*; *Pseudomonas fluorescens* |
| 8636 | 675 | 45 | *Drosophila melanogaster* |
| 8667 | 676 | 30 | *Mycobacterium avium* subsp. *avium* |
| 8668 | 677 | 30 | *Mycobacterium avium* subsp. *avium* |
| 8669 | 678 | 30 | *Mycobacterium avium* subsp. *avium* |
| 8670 | 679 | 30 | *Mycobacterium avium* subsp. *avium* |
| 8671 | 680 | 33 | *Ralstonia metallidurans*; *Pseudomonas syringae* pv. *syringae*; *Homo sapiens* |
| 8672 | 681 | 30 | *Mycobacterium avium* subsp. *avium* |
| 8673 | 682 | 32 | *Rhodospirillum rubrum*; *Caenorhabditis elegans* |
| 8744 | 683 | 44 | *Novosphingobium aromaticivorans*; *Oryza sativa*; *Rhodopseudomonas palustris*; *Magnetospirillum magnetotacticum*; *Corynebacterium glutamicum*; *Listeria innocua*; *Streptomyces coelicolor* |
| 8860 | 684 | 144 | *Mycobacterium tuberculosis*; *Streptomyces coelicolor*; *Halobacterium* sp. NRC-1; *Mycobacterium leprae*; *Pseudomonas aeruginosa* |
| 8927 | 685 | 30 | *Mycobacterium avium* subsp. *avium* |
| 8935 | 686 | 47 | *Mycobacterium avium* (strain 2151); *Mus musculus* |
| 8936 | 687 | 30 | *Mycobacterium avium* subsp. *avium* |
| 8937 | 688 | 30 | *Mycobacterium avium* subsp. *avium* |
| 8938 | 689 | 30 | *Mycobacterium avium* subsp. *avium* |
| 8939 | 690 | 30 | *Mycobacterium avium* subsp. *avium* |
| 8940 | 691 | 32 | *Triticum aestivum* |
| 9022 | 692 | 60 | *Streptomyces coelicolor*; *Ralstonia solanacearum*; *Microbulbifer degradans*; *Streptomyces seoulensis*; *Caulobacter crescentus*; *Pseudomonas aeruginosa*; *Burkholderia fungorum*; *Corynebacterium efficiens* |
| 9126 | 693 | 102 | *Mycobacterium smegmatis*; *Mycobacterium leprae*; *Saccharopolyspora erythraea* |
| 9156 | 694 | 57 | *Mycobacterium avium* (ATCC 35712); *Mycobacterium intracellulare* |
| 9247 | 695 | 30 | *Mycobacterium avium* subsp. *avium* |
| 9248 | 696 | 39 | *Corynebacterium efficiens*; *Deinococcus radiodurans* |
| 9249 | 697 | 30 | *Mycobacterium avium* subsp. *avium* |
| 9250 | 698 | 30 | *Mycobacterium avium* subsp. *avium* |
| 9272 | 699 | 30 | *Mycobacterium avium* subsp. *avium* |
| 9273 | 700 | 44 | *Streptomyces avermitilis*; *Magnetospirillum magnetotacticum*; *Caulobacter crescentus*; *Corynebacterium striatum* |
| 9274 | 701 | 32 | *Homo sapiens*; *Halobacterium* sp. NRC-1 |
| 9275 | 702 | 39 | *Caenorhabditis elegans*; *Pseudomonas fluorescens*; *Streptomyces coelicolor*; *Deinococcus radiodurans* |
| 9276 | 703 | 30 | *Mycobacterium avium* subsp. *avium* |
| 9277 | 704 | 37 | *Desulfitobacterium hafniense*; *Ralstonia solanacearum* |
| 9278 | 705 | 30 | *Mycobacterium avium* subsp. *avium* |
| 9279 | 706 | 37 | *Agrobacterium tumefaciens*; *Oryza sativa* |
| 9280 | 707 | 99 | *Mycobacterium tuberculosis* |
| 9283 | 708 | 32 | *Oryza sativa* |
| 9284 | 709 | 30 | *Mycobacterium avium* subsp. *avium* |
| 9285 | 710 | 89 | *Mycobacterium tuberculosis* |
| 9286 | 711 | 30 | *Mycobacterium avium* subsp. *avium* |
| 9287 | 712 | 63 | *Mycobacterium tuberculosis*; *Novosphingobium aromaticivorans* |
| 9288 | 713 | 36 | *Alcaligenes eutrophus* |
| 9289 | 714 | 30 | *Mycobacterium avium* subsp. *avium* |
| 9290 | 715 | 41 | *Ictalurid herpesvirus* 1 (channel catfish virus) |
| 9291 | 716 | 32 | *Rhodobacter sphaeroides* |
| 9292 | 717 | 30 | *Mycobacterium avium* subsp. *avium* |
| 9293 | 718 | 30 | *Mycobacterium avium* subsp. *avium* |
| 9294 | 719 | 32 | *Drosophila melanogaster* |
| 9295 | 720 | 30 | *Mycobacterium avium* subsp. *avium* |
| 9296 | 721 | 32 | *Glycine max* |
| 9297 | 722 | 30 | *Mycobacterium avium* subsp. *avium* |
| 9298 | 723 | 30 | *Mycobacterium avium* subsp. *avium* |
| 9299 | 724 | 32 | *Homo sapiens* |
| 9300 | 725 | 30 | *Mycobacterium avium* subsp. *avium* |
| 9301 | 726 | 30 | *Mycobacterium avium* subsp. *avium* |
| 9302 | 727 | 30 | *Mycobacterium avium* subsp. *avium* |
| 9303 | 728 | 30 | *Mycobacterium avium* subsp. *avium* |
| 9304 | 729 | 30 | *Mycobacterium avium* subsp. *avium* |
| 9305 | 730 | 32 | *Homo sapiens* |

TABLE 1-continued

| Fragment Designation | SEQ ID NO: | N (nt) | Organisms |
|---|---|---|---|
| 9306 | 731 | 32 | Zea mays |
| 9307 | 732 | 30 | Mycobacterium avium subsp. avium |
| 9308 | 733 | 30 | Mycobacterium avium subsp. avium |
| 9309 | 734 | 30 | Mycobacterium avium subsp. avium |
| 9310 | 735 | 30 | Mycobacterium avium subsp. avium |
| 9311 | 736 | 30 | Mycobacterium avium subsp. avium |
| 9312 | 737 | 37 | Synechococcus sp. |
| 9313 | 738 | 41 | Pseudomonas aeruginosa |
| 9314 | 739 | 30 | Mycobacterium avium subsp. avium |
| 9315 | 740 | 45 | Pseudomonas fluorescens; Drosophila melanogaster; Homo sapiens |
| 9316 | 741 | 30 | Mycobacterium avium subsp. avium |
| 9317 | 742 | 30 | Mycobacterium avium subsp. avium |
| 9318 | 743 | 30 | Mycobacterium avium subsp. avium |
| 9326 | 744 | 42 | Mycobacterium avium; Homo sapiens |
| 9327 | 745 | 30 | Mycobacterium avium subsp. avium |
| 9328 | 746 | 30 | Mycobacterium avium subsp. avium |
| 9329 | 747 | 32 | Drosophila melanogaster |
| 9330 | 748 | 32 | Homo sapiens |
| 9331 | 749 | 30 | Mycobacterium avium subsp. avium |
| 9332 | 750 | 32 | Halobacterium salinarium |
| 9333 | 751 | 44 | Magnetospirillum magnetotacticum; Ralstonia solanacearum; Sinorhizobium meliloti |
| 9335 | 752 | 37 | Xanthomonas albilineans |
| 9336 | 753 | 37 | Micromonospora griseorubida |
| 9337 | 754 | 30 | Mycobacterium avium subsp. avium |
| 9338 | 755 | 30 | Mycobacterium avium subsp. avium |
| 9339 | 756 | 30 | Mycobacterium avium subsp. avium |
| 9340 | 757 | 30 | Mycobacterium avium subsp. avium |
| 9341 | 758 | 37 | Pseudomonas paucimobilis |
| 9342 | 759 | 30 | Mycobacterium avium subsp. avium |
| 9343 | 760 | 30 | Mycobacterium avium subsp. avium |
| 9344 | 761 | 30 | Mycobacterium avium subsp. avium |
| 9345 | 762 | 30 | Mycobacterium avium subsp. avium |
| 9346 | 763 | 47 | Streptomyces coelicolor |
| 9347 | 764 | 30 | Mycobacterium avium subsp. avium |
| 9348 | 765 | 32 | Magnetospirillum magnetotacticum |
| 9349 | 766 | 33 | Burkholderia fungorum |
| 9350 | 767 | 30 | Mycobacterium avium subsp. avium |
| 9351 | 768 | 33 | Homo sapiens; Mycobacterium bovis; Mycobacterium tuberculosis |
| 9360 | 769 | 42 | Oryza sativa; Triticum aestivum; Homo sapiens; Mus musculus; Magnetospirillum magnetotacticum; Hordeum vulgare; Streptomyces fradiae |
| 9604 | 770 | 71 | Sus scrofa; Desulfitobacterium hafniense; Mycobacterium tuberculosis; Mus musculus; Homo sapiens; Oryza sativa; Sinorhizobium meliloti |
| 9713 | 771 | 44 | Deinococcus radiodurans; Burkholderia fungorum; Desulfovibrio desulfuricans; Mycobacterium tuberculosis |
| 9737 | 772 | 75 | Mycobacterium tuberculosis; Mycobacterium leprae |
| 9760 | 773 | 141 | Mycobacterium tuberculosis; Mus musculus; Rhodopseudomonas palustris; Streptomyces coelicolor; Mycobacterium leprae; Rattus norvegicus; Alcaligenes faecalis; Homo sapiens; Leishmania major; Burkholderia fungorum; Azotobacter vinelandii; Oryza sativa; Xanthomonas axonopodis |
| 9769 | 774 | 63 | Streptomyces castaneoglobisporus; Mus musculus; Homo sapiens; Ralstonia metallidurans; Oryza sativa; Chlamydomonas reinhardtii; Mycobacterium tuberculosis; Deinococcus radiodurans |
| 9826 | 775 | 69 | Acidithiobacillus ferroxidans; Rhodobacter sphaeroides; Mycobacterium leprae; Rhodopseudomonas palustris; Oryza sativa |
| 9830 | 776 | 30 | Mycobacterium avium subsp. avium |
| 9928 | 777 | 37 | Homo sapiens; Magnetospirillum magnetotacticum; Oryza sativa; Caulobacter crescentus; Pan troglodytes |
| 9960 | 778 | 32 | Mycobacterium tuberculosis |
| 9961 | 779 | 39 | Pseudomonas aeruginosa |
| 9962 | 780 | 33 | Streptomyces noursei; Burkholderia fungorum; Oryza sativa; Azospirillum brasilense |
| 9963 | 781 | 32 | Burkholderia mallei |
| 9964 | 782 | 41 | Mycobacterium leprae; Bifidobacterium longum |
| 9965 | 783 | 30 | Mycobacterium avium subsp. avium |
| 9966 | 784 | 37 | Sphingobacterium multivorum; Rhodopseudomonas palustris; Synechococcus sp. |

TABLE 1-continued

| Fragment Designation | SEQ ID NO: | N (nt) | Organisms |
|---|---|---|---|
| 9967 | 785 | 35 | *Pseudomonas aeruginosa* |
| 9968 | 786 | 37 | *Rhizobium leguminosarum* pv. *viciae*; *Oryza sativa* |
| 9969 | 787 | 39 | *Streptomyces cinnamonensis*; *Homo sapiens* |
| 10259 | 788 | 30 | *Mycobacterium avium* subsp. *avium* |
| 10260 | 789 | 30 | *Mycobacterium avium* subsp. *avium* |
| 10261 | 790 | 30 | *Mycobacterium avium* subsp. *avium* |
| 10262 | 791 | 30 | *Mycobacterium avium* subsp. *avium* |
| 10263 | 792 | 30 | *Mycobacterium avium* subsp. *avium* |
| 10264 | 793 | 30 | *Mycobacterium avium* subsp. *avium* |
| 10265 | 794 | 30 | *Mycobacterium avium* subsp. *avium* |
| 10266 | 795 | 33 | *Pseudomonas putida* |
| 10268 | 796 | 30 | *Mycobacterium avium* subsp. *avium* |
| 10269 | 797 | 30 | *Mycobacterium avium* subsp. *avium* |
| 10270 | 798 | 30 | *Mycobacterium avium* subsp. *avium* |
| 10271 | 799 | 32 | *Pseudomonas aeruginosa* |
| 10275 | 800 | 30 | *Mycobacterium avium* subsp. *avium* |
| 10276 | 801 | 30 | *Mycobacterium avium* subsp. *avium* |
| 10277 | 802 | 33 | *Homo sapiens* |
| 10278 | 803 | 39 | *Magnetospirillum magnetotacticum*; *Geobacter metallireducens* |
| 10279 | 804 | 30 | *Mycobacterium avium* subsp. *avium* |
| 10515 | 805 | 33 | *Azotobacter vinelandii*; *Pseudomonas aeruginosa* |
| 10572 | 806 | 30 | *Mycobacterium avium* subsp. *avium* |
| 10573 | 807 | 30 | *Mycobacterium avium* subsp. *avium* |
| 10574 | 808 | 30 | *Mycobacterium avium* subsp. *avium* |
| 10576 | 809 | 30 | *Mycobacterium avium* subsp. *avium* |
| 10578 | 810 | 30 | *Mycobacterium avium* subsp. *avium* |
| 10579 | 811 | 30 | *Mycobacterium avium* subsp. *avium* |
| 10580 | 812 | 30 | *Mycobacterium avium* subsp. *avium* |
| 10608 | 813 | 30 | *Mycobacterium avium* subsp. *avium* |
| 10715 | 814 | 41 | *Magnetospirillum magnetotacticum*; *Oryza sativa*; *Homo sapiens*; *Zea mays*; *Mesorhizobium loti*; *Azotobacter vinelandii*; *Ralstonia solanacearum* |
| 10719 | 815 | 60 | *Desulfovibrio desulfuricans*; *Rubrivivax gelatinosus*; *Streptomyces coelicolor*; *Pseudomonas putida*; Hepatitis E; *Rhodobacter sphaeroides*; *Homo sapiens*; Chimpanzee cytomegalovirus |
| 10815 | 816 | 37 | *Azotobacter vinelandii* |
| 10816 | 817 | 30 | *Mycobacterium avium* subsp. *avium* |
| 10817 | 818 | 30 | *Mycobacterium avium* subsp. *avium* |
| 10818 | 819 | 33 | *Pseudomonas fluorescens*; *Bifidobacterium longum*; |
| 10819 | 820 | 30 | *Mycobacterium avium* subsp. *avium* |
| 10820 | 821 | 39 | *Pseudomonas aeruginosa* |
| 10821 | 822 | 129 | *Nostoc punctiforme*; *Novosphingobium aromaticivorans* |
| 10822 | 823 | 30 | *Mycobacterium avium* subsp. *avium* |
| 10823 | 824 | 47 | *Polyporaceae* sp. |
| 10824 | 825 | 30 | *Mycobacterium avium* subsp. *avium* |
| 10826 | 826 | 33 | *Pseudomonas aeruginosa* |
| 10828 | 827 | 30 | *Mycobacterium avium* subsp. *avium* |
| 11048 | 828 | 30 | *Mycobacterium avium* subsp. *avium* |
| 11166 | 829 | 68 | *Mycobacterium leprae*; *Oryza sativa*; *Mycobacterium tuberculosis*; *Rattus norvegicus* |
| 11303 | 830 | 41 | *Burkholderia cepacia*; *Halobacterium* sp. NRC-1; *Homo sapiens* |
| 11321 | 831 | 48 | *Rhodobacter sphaeroides*; *Homo sapiens*; *Desulfitobacterium hafniense*; *Streptomyces coelicolor*; *Deinococcus radiodurans*; *Oryza sativa*; *Streptomyces avermitilis*; *Mesorhizobium loti*; *Rhodopseudomonas palustris*; *Ralstonia metallidurans*; *Burkholderia fungorum*; *Mycobacterium avium* (strain GIRO); *Ralstonia solanacearum* |
| 11322 | 832 | 60 | *Oryza sativa*; *Homo sapiens*; *Mesorhizobium loti*; Bovine herpesvirus type 1; *Streptomyces coelicolor* |
| 11540 | 833 | 30 | *Mycobacterium avium* subsp. *avium* |
| 11660 | 834 | 44 | *Sus scrofa*; *Mycobacterium smegmatis*; *Homo sapiens*; *Frankia* sp.; *Streptomyces atroolivaceus* |
| 11824 | 835 | 39 | *Streptomyces coelicolor*; *Oryza sativa*; *Streptomyces atroolivaceus*; *Rhodobacter sphaeroides*; *Rhodospirillum rubrum*; *Halobacterium* sp. NRC-1 |
| 11827 | 836 | 37 | *Rhodopseudomonas palustris*; *Burkholderia fungorum* |
| 11840 | 837 | 30 | *Mycobacterium avium* subsp. *avium* |
| 11841 | 838 | 54 | *Thermobifida fusca* |
| 11844 | 839 | 30 | *Mycobacterium avium* subsp. *avium* |
| 11896 | 840 | 68 | *Mycobacterium tuberculosis*; *Pseudomonas aeruginosa*; *Magnetospirillum magnetotacticum*; *Mus musculus* |

TABLE 1-continued

| Fragment Designation | SEQ ID NO: | N (nt) | Organisms |
|---|---|---|---|
| 12183 | 841 | 33 | *Mus musculus* |
| 12399 | 842 | 41 | *Streptomyces griseus*; *Oryza sativa*; *Halobacterium* sp. NRC-1; *Pan troglodytes*; Chimpanzee cytomegalovirus; *Mesorhizobium loti*; *Pseudomonas fluorescens*; *Burkholderia fungorum*; *Desulfitobacterium hafniense*; |
| 12436 | 843 | 56 | *Azotobacter vinelandii*; *Streptomyces coelicolor*; *Rhodopseudomonas palustris*; *Mesorhizobium loti* |
| 12635 | 844 | 104 | *Mycobacterium tuberculosis*; *Burkholderia fungorum*; *Drosophila melanogaster*; *Azotobacter vinelandii*; *Ralstonia solanacearum*; *Sinorhizobium meliloti*; *Oryza sativa*; *Pseudomonas fluorescens*; *Magnetospirillum magnetotacticum*; *Zea mays*; Cervid herpesvirus |
| 13011 | 845 | 117 | *Mycobacterium avium* (strain 2151) |
| 13013 | 846 | 30 | *Mycobacterium avium* subsp. *avium* |
| 13015 | 847 | 116 | *Mycobacterium avium* (strain 2151); *Streptomyces coelicolor*; *Homo sapiens*; *Magnetospirillum magnetotacticum* |
| 13016 | 848 | 30 | *Mycobacterium avium* subsp. *avium* |
| 13017 | 849 | 68 | *Mycobacterium avium* (strain 2151) |
| 13129 | 850 | 30 | *Mycobacterium avium* subsp. *avium* |
| 13130 | 851 | 42 | *Thermobifida fusca* |
| 13137 | 852 | 37 | *Papio anubis*; *Streptomyces coelicolor* |
| 13138 | 853 | 30 | *Mycobacterium avium* subsp. *avium* |
| 13139 | 854 | 39 | *Rhodopseudomonas palustris*; *Burkholderia fungorum*; *Pseudomonas putida* |
| 13140 | 855 | 30 | *Mycobacterium avium* subsp. *avium* |
| 13141 | 856 | 33 | *Mycobacterium smegmatis* |
| 13142 | 857 | 32 | *Desulfitobacterium hafniense* |
| 13143 | 858 | 30 | *Mycobacterium avium* subsp. *avium* |
| 13144 | 859 | 32 | *Pseudomonas fluorescens* |
| 13147 | 860 | 37 | *Oryza sativa* |
| 13148 | 861 | 30 | *Mycobacterium avium* subsp. *avium* |
| 13149 | 862 | 30 | *Mycobacterium avium* subsp. *avium* |
| 13150 | 863 | 30 | *Mycobacterium avium* subsp. *avium* |
| 13151 | 864 | 30 | *Mycobacterium avium* subsp. *avium* |
| 13152 | 865 | 30 | *Mycobacterium avium* subsp. *avium* |
| 13153 | 866 | 37 | *Oryza sativa* |
| 13154 | 867 | 30 | *Mycobacterium avium* subsp. *avium* |
| 13155 | 868 | 30 | *Mycobacterium avium* subsp. *avium* |
| 13156 | 869 | 30 | *Mycobacterium avium* subsp. *avium* |
| 13157 | 870 | 32 | *Streptomyces coelicolor* |
| 13158 | 871 | 30 | *Mycobacterium avium* subsp. *avium* |
| 13159 | 872 | 30 | *Mycobacterium avium* subsp. *avium* |
| 13160 | 873 | 32 | *Streptomyces coelicolor* |
| 13161 | 874 | 30 | *Mycobacterium avium* subsp. *avium* |
| 13162 | 875 | 37 | *Myxococcus xanthus* |
| 13167 | 876 | 30 | *Mycobacterium avium* subsp. *avium* |
| 13168 | 877 | 30 | *Mycobacterium avium* subsp. *avium* |
| 13169 | 878 | 30 | *Mycobacterium avium* subsp. *avium* |
| 13170 | 879 | 30 | *Mycobacterium avium* subsp. *avium* |
| 13171 | 880 | 32 | *Mesorhizobium loti* |
| 13172 | 881 | 30 | *Mycobacterium avium* subsp. *avium* |
| 13175 | 882 | 36 | *Streptomyces coelicolor* |
| 13176 | 883 | 30 | *Mycobacterium avium* subsp. *avium* |
| 13177 | 884 | 30 | *Mycobacterium avium* subsp. *avium* |
| 13178 | 885 | 30 | *Mycobacterium avium* subsp. *avium* |
| 13179 | 886 | 30 | *Mycobacterium avium* subsp. *avium* |
| 13180 | 887 | 30 | *Mycobacterium avium* subsp. *avium* |
| 13181 | 888 | 32 | *Magnetospirillum magnetotacticum* |
| 13182 | 889 | 30 | *Mycobacterium avium* subsp. *avium* |
| 13183 | 890 | 30 | *Mycobacterium avium* subsp. *avium* |
| 13184 | 891 | 30 | *Mycobacterium avium* subsp. *avium* |
| 13188 | 892 | 30 | *Mycobacterium avium* subsp. *avium* |
| 13189 | 893 | 30 | *Mycobacterium avium* subsp. *avium* |
| 13190 | 894 | 39 | *Rhodopseudomonas palustris* |
| 13191 | 895 | 30 | *Mycobacterium avium* subsp. *avium* |
| 13192 | 896 | 30 | *Mycobacterium avium* subsp. *aviutn* |
| 13193 | 897 | 32 | *S. cerevisiae* |
| 13194 | 898 | 30 | *Mycobacterium avium* subsp. *avium* |
| 13195 | 899 | 30 | *Mycobacterium avium* subsp. *avium* |
| 13196 | 900 | 30 | *Mycobacterium avium* subsp. *avium* |
| 13197 | 901 | 30 | *Mycobacterium avium* subsp. *avium* |
| 13198 | 902 | 30 | *Mycobacterium avium* subsp. *avium* |
| 13202 | 903 | 32 | *Oryza sativa* |
| 13203 | 904 | 30 | *Mycobacterium avium* subsp. *avium* |

TABLE 1-continued

| Fragment Designation | SEQ ID NO: | N (nt) | Organisms |
|---|---|---|---|
| 13204 | 905 | 30 | *Mycobacterium avium* subsp. *avium* |
| 13205 | 906 | 30 | *Mycobacterium avium* subsp. *avium* |
| 13206 | 907 | 30 | *Mycobacterium avium* subsp. *avium* |
| 13207 | 908 | 32 | *Ralstonia solanacearum* |
| 13208 | 909 | 30 | *Mycobacterium avium* subsp. *avium* |
| 13212 | 910 | 30 | *Mycobacterium avium* subsp. *avium* |
| 13490 | 911 | 99 | *Mycobacterium tuberculosis; Mycobacterium bovis* |
| 13522 | 912 | 101 | *Mycobacterium tuberculosis; Mycobacterium leprae; Ralstonia solanacearum; Streptomyces coelicolor; Caulobacter crescentus; Homo sapiens; Pseudomonas fluorescens; Streptomyces caelestis; Amycolatopsis mediterranei; Zea mays* |
| 13563 | 913 | 80 | *Mycobacterium tuberculosis; Mycobacterium leprae; Thermobifida fusca; Chlorobium tepidum; Treponema medium; Spirochete; Treponema denticola; Chloroflexus aurantiacus; Clostridium thermocellum; Micrococcus luteus; Deinococcus radiodurans;* Mycobacterium phage Ms6; *Synechococcus* sp. |
| 13564 | 914 | 42 | *Chlorobium tepidum; Mesorhizobium loti; Sinorhizobium meliloti* |
| 13616 | 915 | 107 | *Mycobacterium leprae; Mycobacterium tuberculosis; Streptomyces coelicolor;* Bovine herpesvirus type 1; *Lymantria dispar;* |
| 13718 | 916 | 30 | *Mycobacterium avium* subsp. *avium* |
| 13719 | 917 | 30 | *Mycobacterium avium* subsp. *avium* |
| 13720 | 918 | 32 | *Homo sapiens; Azotobacter vinelandii* |
| 13721 | 919 | 44 | *Oryza sativa; Streptomyces coelicolor* |
| 13723 | 920 | 32 | *Mesorhizobium loti* |
| 13724 | 921 | 37 | *Escherichia coli; Klebsiella pneumoniae; Streptomyces coelicolor; Enterobacter aerogenes* |
| 13725 | 922 | 50 | *Streptomyces noursei* |
| 13726 | 923 | 39 | *Methylobacterium extorquens; Homo sapiens; Deinococcus radiodurans* |
| 13727 | 924 | 37 | *Burkholderia fungorum; Desulfitobacterium hafniense; Brucella abortus; Brucella melitensis; Brucella suis* |
| 13728 | 925 | 30 | *Mycobacterium avium* subsp. *avium* |
| 13729 | 926 | 44 | *Pseudomonas fluorescens;* |
| 13730 | 927 | 33 | *Streptomyces coelicolor* |
| 13731 | 928 | 32 | *Rhodopseudomonas palustris; Oryza sativa* |
| 13732 | 929 | 44 | *Thermosynechococcus elongatus* |
| 13733 | 930 | 37 | *Rhodospirillum rubrum; Ralstonia solanacearum; Amycolatopsis mediterranei* |
| 13735 | 931 | 30 | *Mycobacterium avium* subsp. *avium* |
| 13740 | 932 | 41 | *Desulfitobacterium hafniense; Azotobacter vinelandii; Magnetospirillum magnetotacticum; Caulobacter crescentus; Pseudomonas aeruginosa* |
| 13741 | 933 | 44 | *Homo sapiens* |
| 13743 | 934 | 36 | *Rhodopseudomonas palustris; Microbulbifer degradans; Deinococcus radiodurans* |
| 13744 | 935 | 39 | *Homo sapiens; Ralstonia metallidurans* |
| 13745 | 936 | 44 | *Chromobacterium violaceum; Thermobifida fusca; Sinorhizobium meliloti; Rhodospirillum rubrum; Pseudomonas syringae pv. syringae; Rhizobium meliloti (Sinorhizobium meliloti); Homo sapiens* |
| 13746 | 937 | 39 | *Ralstonia solanacearum; Xanthomonas axonopodis; Novosphingobium aromaticivorans* |
| 13747 | 938 | 32 | *Saccharomyces cerevisiae; Ralstonia solanacearum* |
| 13748 | 939 | 33 | *Mycobacterium tuberculosis; Amycolatopsis lactamdurans* |
| 13749 | 940 | 30 | *Mycobacterium avium* subsp. *avium* |
| 13750 | 941 | 37 | *Pseudomonas aeruginosa; Sinorhizobium meliloti;* |
| 13751 | 942 | 44 | *Streptomyces coelicolor;* Bovine herpesvirus type 1; *Deinococcus radiodurans* |
| 13752 | 943 | 50 | *Rhodobacter sphaeroides; Rhodopseudomonas palustris; Rhodospirillum rubrum; Azotobacter vinelandii; Micromonospora megalomicea* subsp. *nigra megalomicin; Agrobacterium tumefaciens; Homo sapiens* |
| 13753 | 944 | 30 | *Mycobacterium avium* subsp. *avium* |
| 13754 | 945 | 30 | *Mycobacterium avium* subsp. *avium* |
| 13755 | 946 | 38 | *Rubrivivax gelatinosus; Ralstonia eutropha* |
| 13756 | 947 | 30 | *Mycobacterium avium* subsp. *avium* |
| 13757 | 948 | 38 | *Homo sapiens* |
| 13758 | 949 | 31 | *Homo sapiens* |
| 13759 | 950 | 37 | *Pseudomonas fluorescens; Pseudomonas syringae; Pseudomonas aeruginosa* |
| 13760 | 951 | 30 | *Mycobacterium avium* subsp. *avium* |

TABLE 1-continued

| Fragment Designation | SEQ ID NO: | N (nt) | Organisms |
|---|---|---|---|
| 13762 | 952 | 77 | Streptomyces sp. ; Streptomyces coelicolor; Chloroflexus aurantiacus; Deinococcus radiodurans; Pseudomonas putida |
| 13763 | 953 | 33 | Rhodopseudomonas palustris; Desulfitobacterium hafniense |
| 13764 | 954 | 33 | Oryctolagus cuniculus |
| 13765 | 955 | 33 | Streptomyces hygroscopicus |
| 13766 | 956 | 37 | Magnetospirillum magnetotacticum; Streptomyces coelicolor; Homo sapiens |
| 13767 | 957 | 30 | Mycobacterium avium subsp. avium |
| 13768 | 958 | 30 | Mycobacterium avium subsp. avium |
| 13769 | 959 | 37 | Oryza sativa; Mesorhizobium loti; Magnetospirillum magnetotacticum |
| 13770 | 960 | 30 | Mycobacterium avium subsp. avium |
| 13771 | 961 | 30 | Mycobacterium avium subsp. avium |
| 13772 | 962 | 30 | Mycobacterium avium subsp. avium |
| 13773 | 963 | 45 | Streptomyces coelicolor; Amycolatopsis mediterranei; Rhodopseudomonas palustris; Rhodospirillum rubrum; Homo sapiens; Brucella melitensis; Papio anubis; Sus scrofa; Brucella suis |
| 13774 | 964 | 32 | Pseudomonas aeruginosa |
| 13776 | 965 | 54 | Mycobacterium tuberculosis; Homo sapiens; Bordetella bronchiseptica |
| 13777 | 966 | 44 | Oryza sativa; Homo sapiens; Streptomyces coelicolor; Triticum aestivum; Hordeum vulgare; Bos taurus; Mus musculus |
| 14004 | 967 | 47 | Desulfitobacterium hafniense; Oryza sativa; Homo sapiens; M. bovis; Streptomyces griseus; Streptomyces coelicolor; Chlamydomonas reinhardtii; Pseudomonas putida |
| 14278 | 968 | 30 | Mycobacterium avium subsp. avium |
| 14279 | 969 | 32 | Ralstonia metallidurans |
| 14280 | 970 | 30 | Mycobacterium avium subsp. avium |
| 14294 | 971 | 33 | Deinococcus radiodurans; Streptomyces spheroides; Ralstonia solanacearum; Streptomyces coelicolor |
| 14301 | 972 | 50 | Homo sapiens; Gallus gallus; Mycobacterium tuberculosis; Rhodospirillum rubrum; Magnetospirillum magnetotacticum; Geobacter metallireducens; Desulfitobacterium hafniense; Streptomyces coelicolor |
| 14546 | 973 | 68 | Mycobacterium tuberculosis; Homo sapiens; Erwinia chrysanthemi; Streptomyces coelicolor; Xanthomonas nopodis; Streptomyces avermitilis; Alcaligenes eutrophus; Desulfitobacterium hafniense; Oryza sativa; Salmonella enterica; Struthio camelus; Salmonella typhimurium |
| 14659 | 974 | 30 | Mycobacterium avium subsp. avium |
| 14661 | 975 | 33 | Home sapiens; Escherichia coli |
| 14757 | 976 | 59 | Oryza sativa; Chlamydomonas reinhardtii; Homo sapiens; Mesorhizobium loti; Magnetospirillum magnetotacticum; Mycobacterium xenopi; Neisseria meningitidis; Sinorhizobium meliloti; Streptomyces coelicolor; Myxococcus xanthus; |
| 14792 | 977 | 44 | Oryza sativa; Streptomyces coelicolor; Corynebacterium efficiens; Myxococcus xanthus; Pyrobaculum aerophilum |
| 14903 | 978 | 32 | Mus musculus |
| 14929 | 979 | 30 | Mycobacterium avium subsp. avium |
| 14930 | 980 | 30 | Mycobacterium avium subsp. avium |
| 14931 | 981 | 30 | Mycobacterium avium subsp. avium |
| 14934 | 982 | 33 | Mesorhizobium loti; Rhodobacter sphaeroides |
| 14935 | 983 | 30 | Mycobacterium avium subsp. avium |
| 14936 | 984 | 39 | Bacillus halodurans |
| 14979 | 985 | 44 | Mycobacterium tuberculosis; Caenorhabditis briggsae |
| 15007 | 986 | 41 | Oryza sativa; Home sapiens |
| 15025 | 987 | 50 | Oryza sativa; Streptomyces coelicolor; Caenorhabditis briggsae |
| 15056 | 988 | 65 | Mycobacterium tuberculosis; Xanthomonas campestris |
| 15057 | 989 | 30 | Mycobacterium avium subsp. avium |
| 15058 | 990 | 33 | Leishmania major |
| 15059 | 991 | 53 | Mycobacterium tuberculosis; Homo sapiens |
| 15109 | 992 | 38 | Mus musculus; Homo sapiens |
| 15132 | 993 | 98 | Mycobacterium tuberculosis; Mycobacterium leprae; Chlorobium tepidum; Halobacterium sp.; Rhodospirillum rubrum; Pseudomonas syringae; Streptomyces coelicolor; Pseudomonas putida; Leishmania major; Brucella melitensis; Brucella suis; Rhodobacter sphaeroides; |

TABLE 1-continued

| Fragment Designation | SEQ ID NO: | N (nt) | Organisms |
|---|---|---|---|
| | | | Sinorhizobium meliloti; Deinococcus radiodurans; Neurospora crassa |
| 15258 | 994 | 59 | Mycobacterium tuberculosis; Oryza sativa; Molluscum contagiosum; Rhodopseudomonas palustris; Mycobacterium bovis; Mus musculus; Magnetospirillum magnetotacticum |
| 15305 | 995 | 30 | Mycobacterium avium subsp. avium |
| 15306 | 996 | 30 | Mycobacterium avium subsp. avium |
| 15307 | 997 | 30 | Mycobacterium avium subsp. avium |
| 15308 | 998 | 30 | Mycobacterium avium subsp. avium |
| 15309 | 999 | 32 | Mesorhizobium loti; Rhodopseudomonas palustris; Ralstonia solanacearum |
| 15311 | 1000 | 33 | Mesorhizobium loti |
| 15312 | 1001 | 39 | Bacillus halodurans |
| 15313 | 1002 | 30 | Mycobacterium avium subsp. avium |
| 15343 | 1003 | 100 | Mycobacterium tuberculosis; Magnetospirillum magnetotacticum; Azotobacter vinelandii; Ralstonia solanacearum; Pseudomonas fluorescens; Ralstonia metallidurans; Magnetococcus sp.; Desulfovibrio desulfuricans; Brucella melitensis; Brucella suis |
| 15408 | 1004 | 47 | Azotobacter vinelandii; Mycobacterium tuberculosis |
| 15461 | 1005 | 33 | Oryza sativa; Desulfitobacterium hafniense; Streptomyces collinus; Aphis gossypii |
| 15682 | 1006 | 62 | Chlamydomonas reinhardtii; Homo sapiens; Mycobacterium tuberculosis; Mycobacterium leprae; Mus musculus; Magnetospirillum magnetotacticum; Sinorhizobium meliloti; Tetraodon nigroviridis |
| 15685 | 1007 | 113 | Mycobacterium tuberculosis; Streptomyces sp.; Oryza sativa; Streptomyces griseus; Halobacterium sp.; Homo sapiens; Pseudomonas fluorescens; Novosphingobium aromaticivorans; Synechococcus sp.; Drosophila melanogaster; Streptomyces coelicolor |
| 15783 | 1008 | 30 | Mycobacterium avium subsp. avium |
| 15784 | 1009 | 39 | Bacillus halodurans |
| 15785 | 1010 | 30 | Mycobacterium avium subsp. avium |
| 15787 | 1011 | 32 | Mesorhizobium loti; Rhodopseudomonas palustris; Ralstonia solanacearum |
| 15788 | 1012 | 30 | Mycobacterium avium subsp. avium |
| 15789 | 1013 | 30 | Mycobacterium avium subsp. avium |
| 15790 | 1014 | 30 | Mycobacterium avium subsp. avium |
| 15791 | 1015 | 30 | Mycobacterium avium subsp. avium |
| 15959 | 1016 | 32 | Sinorhizobium meliloti; Halobacterium sp. |
| 16477 | 1017 | 38 | Rhodobacter sphaeroides; Ralstonia solanacearum; Streptomyces coelicolor |
| 16614 | 1018 | 78 | Mycobacterium tuberculosis; Mycobacterium leprae; Xanthomonas campestris |
| 16697 | 1019 | 69 | Oryza sativa; Homo sapiens; Spermatozopsis similis; Pseudorabies virus; Magnetospirillum magnetotacticum; Triticum aestivum |
| 16838 | 1020 | 47 | Streptomyces verticillus; Frankia sp.; Streptomyces atroolivaceus; Ralstonia solanacearum; Mycobacterium tuberculosis; Oryza sativa; Desulfitobacterium hafniense; Streptomyces coelicolor; Halobacterium sp.; Xanthomonas campestris; Homo sapiens; Caulobacter crescentus; Rhodospirillum rubrum; Magnetospirillum magnetotacticum; Rattus norvegicus; Oryza sativa; Ralstonia solanacearum; Bovine adenovirus |
| 17028 | 1021 | 60 | Mycobacterium tuberculosis; Oryza sativa; Streptomyces coelicolor; Streptomyces avermitilis; Xanthomonas campestris; Drosophila melanogaster; Homo sapiens; Thermobifida fusca |
| 17153 | 1022 | 30 | Mycobacterium avium subsp. avium |
| 17154 | 1023 | 39 | Oryza sativa; Ralstonia metallidurans; Pseudomonas putida |
| 17155 | 1024 | 38 | Rhodobacter sphaeroides; Ralstonia metallidurans; Zea mays |
| 17156 | 1025 | 30 | Mycobacterium avium subsp. avium |
| 17157 | 1026 | 30 | Mycobacterium avium subsp. avium |
| 17158 | 1027 | 30 | Mycobacterium avium subsp. avium |
| 17159 | 1028 | 30 | Mycobacterium avium subsp. avium |
| 17160 | 1029 | 35 | Halobacterium sp.; Corynebacterium efficiens; Magnetospirillum magnetotacticum; Oryza sativa |
| 17161 | 1030 | 30 | Mycobacterium avium subsp. avium |
| 17162 | 1031 | 33 | Streptomyces avermitilis |
| 17163 | 1032 | 53 | Mycobacterium tuberculosis |

TABLE 1-continued

| Fragment Designation | SEQ ID NO: | N (nt) | Organisms |
|---|---|---|---|
| 17164 | 1033 | 86 | *Mycobacterium tuberculosis*; *Oryza sativa* |
| 17165 | 1034 | 32 | *Ralstonia solanacearum* |
| 17166 | 1035 | 30 | *Mycobacterium avium* subsp. *avium* |
| 17167 | 1036 | 30 | *Mycobacterium avium* subsp. *avium* |
| 17168 | 1037 | 30 | *Mycobacterium avium* subsp. *avium* |
| 17169 | 1038 | 33 | *Ralstonia solanacearum* |
| 17170 | 1039 | 38 | *Oryza sativa* |
| 17171 | 1040 | 44 | *Ralstonia metallidurans*; *Deinococcus radiodurans* |
| 17172 | 1041 | 32 | *Drosophila melanogaster* |
| 17173 | 1042 | 30 | *Mycobacterium avium* subsp. *avium* |
| 17174 | 1043 | 53 | *Mycobacterium tuberculosis* |
| 17175 | 1044 | 30 | *Mycobacterium avium* subsp. *avium* |
| 17176 | 1045 | 41 | *Arabidopsis thaliana*; *Xanthomonas campestris* |
| 17177 | 1046 | 30 | *Mycobacterium avium* subsp. *avium* |
| 17179 | 1047 | 38 | *Azotobacter vinelandii*; *Xanthomonas campestris* |
| 17181 | 1048 | 30 | *Mycobacterium avium* subsp. *avium* |
| 17182 | 1049 | 38 | *Triticum aestivum*; *Mus musculus* |
| 17183 | 1050 | 35 | *Methylobacterium extorquens* |
| 17184 | 1051 | 32 | *Oryza sativa* |
| 17185 | 1052 | 38 | *Mesorhizobium loti* |
| 17187 | 1053 | 47 | *Streptomycescoelicolor*; *Rhodopseudomonas palustris* |
| 17188 | 1054 | 30 | *Mycobacterium avium* subsp. *avium* |
| 17191 | 1055 | 36 | *Rhodobacter capsulatus* |
| 17192 | 1056 | 30 | *Mycobacterium avium* subsp. *avium* |
| 17193 | 1057 | 32 | *Burkholderia fungorum* |
| 17194 | 1058 | 32 | *Streptomyces coelicolor*; *Drosophila melanogaster* |
| 17195 | 1059 | 44 | *Burkholderia fungorum*; *S. erythraea*; *Xanthomonas axonopodis* |
| 17196 | 1060 | 30 | *Mycobacterium avium* subsp. *avium* |
| 17197 | 1061 | 32 | *Homo sapiens* |
| 17198 | 1062 | 39 | *Oryza sativa* |
| 17199 | 1063 | 45 | *Methanopyrus kandleri* |
| 17200 | 1064 | 38 | *Thermobifida fusca* |
| 17201 | 1065 | 44 | *Rhodopseudomonas palustris*; *Desulfonatronum lacustre* |
| 17202 | 1066 | 30 | *Mycobacterium avium* subsp. *avium* |
| 17203 | 1067 | 38 | *Rhodobacter sphaeroides*; *Homo sapiens*; *Sphingomonas paucimobilis*; *Caulobacter crescentus*; |
| 17204 | 1068 | 30 | *Mycobacterium avium* subsp. *avium* |
| 17205 | 1069 | 38 | *Oryza sativa*; *Novosphingobium aromaticivorans*; *Pseudomonas putida* |
| 17206 | 1070 | 30 | *Mycobacterium avium* subsp. *avium* |
| 17207 | 1071 | 30 | *Mycobacterium avium* subsp. *avium* |
| 17208 | 1072 | 32 | *Homo sapiens* |
| 17209 | 1073 | 62 | *Streptomyces coelicolor*; *Pseudomonas aeruginosa*; *Ralstonia metallidurans*; *Magnetospirillum magnetotacticum*; *Azoarcus evansii*; *Rhodobacter sphaeroides*; *Halobacterium* sp.; *Streptomyces collinus*; *Caulobacter crescentus* |
| 17210 | 1074 | 44 | *Rhodopseudomonas palustris*; *Mycobacterium leprae*; *Pseudomonas fluorescens*; *Sinorhizobium meliloti*; *Streptomyces coelicolor*; *Xanthomonas campestris*; *Micromonospora echinospora*; *H. salinarium*; *Mesorhizobium loti*; *Novosphingobium aromaticivorans*; *Mycobacterium tuberculosis*; *Agrobacterium tumefociens* |
| 17211 | 1075 | 32 | *Ralstonia solanacearum* |
| 17212 | 1076 | 68 | *Shigella flexneri*; *Escherichia coli*; *Prochlorococcus marinus*; *Magnetospirillum magnetotacticum*; *Rhodopseudomonas palustris*; *Burkholderia fungorum*; *Thermobifida fusca*; *Streptomyces coelicolor* |
| 17213 | 1077 | 59 | *Rhodopseudomonas palustris*; *Pseudomonas aeruginosa*; *Burkholderia fungorum*; *Novosphingobium aromaticivorans*; *Streptomyces* sp.; *Amycolatopsis mediterranei*; *Streptomyces coelicolor*; *Halobacterium* sp.; *Pseudomonas putida*; *Oryza sativa*; *Micromonospora megalomicea* (subsp. *nigra megalomicin*); *Zea mays* |
| 17214 | 1078 | 44 | *Novosphingobium aromaticivorans*; *Magnetospirillum magnetotacticum*; *Rhodopseudomonas palustris*; *Thermobifida fusca*; *Thauera aromatica*; *Caulobacter crescentus* |
| 17215 | 1079 | 32 | *Deinococcus radiodurans* |
| 17216 | 1080 | 30 | *Mycobacterium avium* subsp. *avium* |
| 17217 | 1081 | 51 | *Mesorhizobium loti*; *Burkholderia fungorum* |
| 17218 | 1082 | 44 | *Ralstonia solanacearum*; *Hordeum vulgare*; *Ralstonia metallidurans*; *Xanthomonas axonopodis*; *Caulobacter crescentus*; *Burkholderia fungorum*; *Streptomyces* |

TABLE 1-continued

| Fragment Designation | SEQ ID NO: | N (nt) | Organisms |
|---|---|---|---|
| | | | antibioticus; Corynebacterium efficiens; Xanthomonas campestris; Zea mays |
| 17219 | 1083 | 62 | Mesorhizobium loti; Ralstonia metallidurans; Desulfitobacterium hafniense; Agrobacterium tumefaciens |
| 17220 | 1084 | 30 | Mycobacterium avium subsp. avium |
| 17221 | 1085 | 60 | Chlorobium tepidum; Pseudomonas fluorescens; Ralstonia metallidurans; Burkholderia fungorum; Mycobacterium tuberculosis; Streptomyces lavendulae; Novosphingobium aromaticivorans; Ralstonia solanacearum; Streptomyces coelicolor; Oryza sativa; Xanthomonas axonopodis; Pseudomonas aeruginosa |
| 17222 | 1086 | 33 | Mycobacterium tuberculosis |
| 17223 | 1087 | 38 | Lymantria dispar nucleopolyhedrovirus |
| 17224 | 1088 | 30 | Mycobacterium avium subsp. avium |
| 17225 | 1089 | 30 | Mycobacterium avium subsp. avium |
| 17226 | 1090 | 50 | Streptomyces griseus |
| 17227 | 1091 | 35 | Ralstonia metallidurans |
| 17228 | 1092 | 60 | Mesorhizobium loti; Azotobacter vinelandii; Streptomyces coelicolor; Homo sapiens |
| 17229 | 1093 | 41 | Brucella melitensis; Brucella suis |
| 17230 | 1094 | 53 | Burkholderia fungorum; Ralstonia solanacearum |
| 17231 | 1095 | 47 | Thermobifida fusca; Oryza sativa |
| 17232 | 1096 | 45 | Novosphingobium aromaticivorans; Streptomyces coelicolor; Mesorhizobium loti; Sinorhizobium meliloti; Homo sapiens |
| 17233 | 1097 | 33 | |
| 17234 | 1098 | 30 | Mycobacterium avium subsp. avium |
| 17235 | 1099 | 62 | Caulobacter crescentus; Magnetospirillum magnetotacticum; Streptomyces coelicolor |
| 17236 | 1100 | 32 | Sinorhizobium meliloti |
| 17237 | 1101 | 38 | Saccharopolyspora erythraea |
| 17238 | 1102 | 32 | Leishmania major |
| 17241 | 1103 | 30 | Mycobacterium avium subsp. avium |
| 17242 | 1104 | 53 | Streptomyces coelicolor; Burkholderia fungorum |
| 17243 | 1105 | 36 | Ralstonia solanacearum; Thermobifida fusca |
| 17244 | 1106 | 50 | Oryza sativa |
| 17245 | 1107 | 32 | Sinorhizobium meliloti; Rhizobium sp. |
| 17246 | 1108 | 30 | Mycobacterium avium subsp. avium |
| 17247 | 1109 | 30 | Mycobacterium avium subsp. avium |
| 17248 | 1110 | 30 | Mycobacterium avium subsp. avium |
| 17249 | 1111 | 39 | Streptomyces coelicolor; Lactococcus lactis subsp. Lactis |
| 17264 | 1112 | 75 | Mycobacterium tuberculosis; Desulfitobacterium hafniense; Ralstonia solanacearum; Streptomyces coelicolor; Mesorhizobium loti; Homo sapiens; Rhodospirillum rubrum; Ralstonia metallidurans; Xylella fastidiosa; Azotobacter vinelandii; Prochlorococcus marinus; Oryza sativa; Sinorhizobium meliloti |
| 17284 | 1113 | 38 | Ralstonia solanacearum; Streptomyces coelicolor; Chimpanzee cytomegalovirus |
| 17366 | 1114 | 50 | Magnetospirillum magnetotacticum; Azotobacter vinelandii; Homo sapiens; Ralstonia solanacearum; Streptomyces coelicolor; Oryza sativa |
| 17403 | 1115 | 30 | Mycobacterium avium subsp. avium |
| 17404 | 1116 | 30 | Mycobacterium avium subsp. avium |
| 17406 | 1117 | 30 | Mycobacterium avium subsp. avium |
| 17407 | 1118 | 30 | Mycobacterium avium subsp. avium |
| 17408 | 1119 | 30 | Mycobacterium avium subsp. avium |
| 17409 | 1120 | 32 | Homo sapiens |
| 17410 | 1121 | 30 | Mycobacterium avium subsp. avium |
| 17419 | 1122 | 33 | Azotobacter vinelandii |
| 17420 | 1123 | 71 | Corynebacterium efficiens; Bifidobacterium longum; Mycobacterium avium (strain 2151) |
| 17421 | 1124 | 30 | Mycobacterium avium subsp. avium |
| 17422 | 1125 | 48 | Streptomyces lividans; Mycobacterium tuberculosis; Burkholderia fungorum; Zea mays |
| 17424 | 1126 | 56 | Renibacterium salmoninarum |
| 17425 | 1127 | 30 | Mycobacterium avium subsp. avium |
| 17426 | 1128 | 30 | Mycobacterium avium subsp. avium |
| 17427 | 1129 | 30 | Mycobacterium avium subsp. avium |
| 17428 | 1130 | 32 | Pseudomonas syringae; Desulfitobacterium hafniense |
| 17429 | 1131 | 38 | Rhodopseudomonas palustris |
| 17430 | 1132 | 30 | Mycobacterium avium subsp. avium |
| 17434 | 1133 | 38 | Thermus equiperdum |
| 17437 | 1134 | 30 | Mycobacterium avium subsp. avium |
| 17438 | 1135 | 32 | Desulfovibrio desulfuricans |
| 17439 | 1136 | 30 | Mycobacterium avium subsp. avium |

TABLE 1-continued

| Fragment Designation | SEQ ID NO: | N (nt) | Organisms |
|---|---|---|---|
| 17440 | 1137 | 30 | Mycobacterium avium subsp. avium |
| 17441 | 1138 | 32 | Homo sapiens |
| 17442 | 1139 | 38 | Neurospora crassa |
| 17443 | 1140 | 30 | Mycobacterium avium subsp. avium |
| 17444 | 1141 | 30 | Mycobacterium avium subsp. avium |
| 17445 | 1142 | 33 | Escherichia coli |
| 17449 | 1143 | 30 | Mycobacterium avium subsp. avium |
| 17457 | 1144 | 30 | Mycobacterium avium subsp. avium |
| 17458 | 1145 | 30 | Mycobacterium avium subsp. avium |
| 17459 | 1146 | 30 | Mycobacterium avium subsp. avium |
| 17460 | 1147 | 38 | Magnetospirillum magnetotacticum |
| 17461 | 1148 | 30 | Mycobacterium avium subsp. avium |
| 17462 | 1149 | 32 | Rhodopseudomonas palustris |
| 17463 | 1150 | 30 | Mycobacterium avium subsp. avium |
| 17464 | 1151 | 32 | Mastigamoeba balamuthi |
| 17465 | 1152 | 30 | Mycobacterium avium subsp. avium |
| 17466 | 1153 | 33 | Homo sapiens; Neurospora crassa; Bifidobacterium longum; Sinorhizobium meliloti |
| 17467 | 1154 | 30 | Mycobacterium avium subsp. avium |
| 17707 | 1155 | 45 | Halobacterium salinarium; Magnetospirillum magnetotacticum; Halobacterium sp.; Rhodopseudomonas palustris; Rhodospirillum rubrum; Streptomyces fradiae; Zea mays |
| 17835 | 1156 | 30 | Mycobacterium avium subsp. avium |
| 17837 | 1157 | 92 | Mycobacterium tuberculosis |
| 17882 | 1158 | 51 | Agaricus bisporus; Yersinia pestis |
| 17883 | 1159 | 33 | Oryza sativa |
| 17884 | 1160 | 39 | Streptomyces coelicolor |
| 17885 | 1161 | 30 | Mycobacterium avium subsp. avium |
| 17893 | 1162 | 30 | Mycobacterium avium subsp. avium |
| 17935 | 1163 | 75 | Mycobacterium tuberculosis; Burkholderia fungorum; Drosophila melanogaster; Thermobifida fusca; Streptomyces clavuligerus |
| 17946 | 1164 | 59 | Drosophila melanogaster; Mycobacterium tuberculosis; Streptomyces coelicolor |
| 17959 | 1165 | 38 | Oryza sativa; Deinococcus radiodurans; Ralstonia solanacearum; Streptomyces coelicolor |
| 18067 | 1166 | 84 | Mycobacterium avium (strain 2151) |
| 18069 | 1167 | 100 | Mycobacterium avium (strain 2151); Streptomyces coelicolor; Magnetospirillum magnetotacticum |
| 18070 | 1168 | 30 | Mycobacterium avium subsp. avium |
| 18071 | 1169 | 68 | Mycobacterium avium (strain 2151) |
| 18182 | 1170 | 50 | Mycobacterium avium; Pseudomonas fluorescens; Oryza sativa; Pseudomonas putida |
| 18183 | 1171 | 270 | Mycobacterium avium |
| 18189 | 1172 | 30 | Mycobacterium avium subsp. avium |
| 18190 | 1173 | 30 | Mycobacterium avium subsp. avium |
| 18191 | 1174 | 30 | Mycobacterium avium subsp. avium |
| 18192 | 1175 | 51 | Neurospora crassa |
| 18193 | 1176 | 36 | Drosophila melanogaster; Halobacterium sp. |
| 18194 | 1177 | 38 | Homo sapiens |
| 18195 | 1178 | 30 | Mycobacterium avium subsp. avium |
| 18258 | 1179 | 47 | Leishmania major; Oryza sativa; Pseudomonas fluorescens; Homo sapiens; Rhodobacter sphaeroides; Brucella melitensis; Brucella suis; Zea mays |
| 18562 | 1180 | 45 | Neisseria meningitidis; Streptomyces viridochromogenes |
| 18564 | 1181 | 65 | Mycobacterium tuberculosis; Mus musculus; Pseudorabies virus; Mycobacterium leprae; Caenorhabditis briggsae |
| 18590 | 1182 | 63 | Mycobacterium tuberculosis; Mycobacterium bovis |
| 18592 | 1183 | 30 | Mycobacterium avium subsp. avium |
| 18593 | 1184 | 30 | Mycobacterium avium subsp. avium |
| 18594 | 1185 | 77 | Mycobacterium tuberculosis; Streptomyces coelicolor; Micromonospora megalomicea subsp. nigra megalomicin |
| 18608 | 1186 | 44 | Mycobacterium leprae; Rhodopseudomonas palustris |
| 18700 | 1187 | 86 | Mycobacterium tuberculosis; Mycobacterium leprae; Oryza sativa; Rhodospirillum rubrum; Magnetospirillum magnetotacticum; Zea mays; Streptomyces griseus; Homo sapiens |
| 18728 | 1188 | 32 | Mus musculus |
| 18748 | 1189 | 50 | Homo sapiens; Magnetospirillum magnetotacticum; Rattus norvegicus; Oryctolagus cuniculus; Mycobacterium leprae; Oryza sativa; Mus musculus |
| 18833 | 1190 | 38 | Magnetospirillum magnetotacticum; Mus musculus; Homo sapiens; Rhodopseudomonas palustris; Caulobacter crescentus |

TABLE 1-continued

| Fragment Designation | SEQ ID NO: | N (nt) | Organisms |
|---|---|---|---|
| 19342 | 1191 | 30 | *Mycobacterium avium* subsp. *avium* |
| 19343 | 1192 | 35 | *Acetobacter xylinus* |
| 19344 | 1193 | 30 | *Mycobacterium avium* subsp. *avium* |
| 19345 | 1194 | 30 | *Mycobacterium avium* subsp. *avium* |
| 19346 | 1195 | 75 | *Mycobacterium tuberculosis*; *Chlamydomonas reinhardtii*; *Burkholderia fungorum*; *Corynebacterium efficiens* |
| 19348 | 1196 | 71 | *Ralstonia* sp.; *Ralstonia metallidurans*; *Bifidobacterium longum* |
| 19364 | 1197 | 33 | *Sus scrofa*; *Saimiri sciureus*; *Bos taurus* |
| 19367 | 1198 | 30 | *Mycobacterium avium* subsp. *avium* |
| 19368 | 1199 | 30 | *Mycobacterium avium* subsp. *avium* |
| 19369 | 1200 | 30 | *Mycobacterium avium* subsp. *avium* |
| 19370 | 1201 | 30 | *Mycobacterium avium* subsp. *avium* |
| 19499 | 1202 | 75 | *Mycobacterium tuberculosis*; *Burkholderia fungorum*; *Acetobacter vinelondii*; *Pseudomonas aeroginosa*; *Salmonella enterica*; *Salmonella typhi* |
| 19753 | 1203 | 33 | *Oryza sativa*; *Trichomonas vaginalis* |
| 19777 | 1204 | 45 | *Rhodospirillum rubrum* |
| 19892 | 1205 | 38 | *Streptomyces coelicolor* |
| 19893 | 1206 | 44 | *Magnetospirillum magnetotacticum*; *Homo sapiens*; *Rhodospirillum rubrum*; *Chloroflexus aurantiacus* |
| 19894 | 1207 | 38 | *Mesorhizobium loti*; *Pseudomonas syringae* |
| 19895 | 1208 | 45 | *Streptomyces virginiae* |
| 19896 | 1209 | 32 | *Mus musculus* |
| 19897 | 1210 | 30 | *Mycobacterium avium* subsp. *avium* |
| 19899 | 1211 | 30 | *Mycobacterium avium* subsp. *avium* |
| 19900 | 1212 | 33 | *Microbispora bispora* |
| 19901 | 1213 | 30 | *Mycobacterium avium* subsp. *avium* |
| 19902 | 1214 | 32 | *Burkholderia fungorum*; *Oryza sativa* |
| 19903 | 1215 | 30 | *Mycobacterium avium* subsp. *avium* |
| 19922 | 1216 | 44 | *Ralstonia solanacearum*; *Rhodobacter sphaeroides*; *Xanthomonas campestris*; *Streptomyces avermitilis*; *Sphingomonas paucimobilis*; *Streptomyces coelicolor* |
| 19923 | 1217 | 32 | *Homo sapiens* |
| 19924 | 1218 | 35 | *Streptomyces coelicolor* |
| 19925 | 1219 | 32 | Equine encephalosis virus 5 |
| 19926 | 1220 | 30 | *Mycobacterium avium* subsp. *avium* |
| 19927 | 1221 | 32 | *Triticum aestivum* |
| 19928 | 1222 | 30 | *Mycobacterium avium* subsp. *avium* |
| 19929 | 1223 | 30 | *Mycobacterium avium* subsp. *avium* |
| 19931 | 1224 | 30 | *Mycobacterium avium* subsp. *avium* |
| 19932 | 1225 | 38 | *Rhodobacter sphaeroides* |
| 19933 | 1226 | 30 | *Mycobacterium avium* subsp. *avium* |
| 19934 | 1227 | 32 | *Magnetospirillum magnetotacticum* |
| 19935 | 1228 | 44 | *Drosophila melanogaster* |
| 19936 | 1229 | 75 | *Desulfitobacterium hafniense*; *Azotobacter vinelandii*; *Pseudomonas fluorescens*; *Leishmania major* |
| 19937 | 1230 | 32 | *Neisseria meningitides* |
| 19938 | 1231 | 51 | *Desulfitobacterium hafniense*; *Burkholderia fungorum* |
| 19939 | 1232 | 30 | *Mycobacterium avium* subsp. *avium* |
| 19940 | 1233 | 33 | *Drosophila melanogaster* |
| 19941 | 1234 | 30 | *Mycobacterium avium* subsp. *avium* |
| 19958 | 1235 | 30 | *Mycobacterium avium* subsp. *avium* |
| 19959 | 1236 | 50 | *Brucella abortus*; *Brucella melitensis*; *Brucella suis*; *Caenorhabditis elegans* |
| 19960 | 1237 | 30 | *Mycobacterium avium* subsp. *avium* |
| 19961 | 1238 | 30 | *Mycobacterium avium* subsp. *avium* |
| 19962 | 1239 | 32 | *Salmonella enterica*; *Salmonella typhimurium* |
| 19963 | 1240 | 30 | *Mycobacterium avium* subsp. *avium* |
| 19964 | 1241 | 30 | *Mycobacterium avium* subsp. *avium* |
| 19965 | 1242 | 32 | *Novosphingobium aromaticivorans* |
| 19966 | 1243 | 32 | *Rhodobacter sphaeroides*; *Drosophila melanogaster* |
| 19967 | 1244 | 32 | *Amycolatopsis orientalis* |
| 19968 | 1245 | 38 | *Homo sapien* |
| 19969 | 1246 | 32 | *Rhodopseudomonas palustris* |
| 19970 | 1247 | 30 | *Mycobacterium avium* subsp. *avium* |
| 19971 | 1248 | 65 | *Desulfitobacterium hafniense*; *Streptomyces coelicolor*; *Hordeum vulgare*; *Thauera aromatica*; *Mesorhizobium loti*; *Ralstonia solanacearum*; *Xanthomonas campestris*; *Pseudomonas aeruginosa* |
| 19972 | 1249 | 44 | *Mesorhizobium loti*; *Rhodobacter sphaeroides* |
| 19973 | 1250 | 30 | *Mycobacterium avium* subsp. *avium* |
| 19974 | 1251 | 32 | *Desulfitobacterium hafniense* |
| 19975 | 1252 | 32 | *Caenorhabditis elegans* |
| 19976 | 1253 | 32 | *Halothiobacillus hydrothermalis* |

TABLE 1-continued

| Fragment Designation | SEQ ID NO: | N (nt) | Organisms |
|---|---|---|---|
| 20261 | 1254 | 47 | Azotobacter vinelandii; Streptomyces coelicolor; Magnetospirillum magnetotacticum; Pseudomonas aeruginosa; Streptomyces atroolivaceus |
| 20370 | 1255 | 60 | Homo sapiens; Streptomyces coelicolor; Oryza sativa; Zea mays; Aegilops tauschii; Gallus gallus; Mus musculus; Rhodobacter sphaeroides; Rhodospirillum rubrum |
| 20399 | 1256 | 30 | Mycobacterium avium subsp. avium |
| 20400 | 1257 | 30 | Mycobacterium avium subsp. avium |
| 20401 | 1258 | 30 | Mycobacterium avium subsp. avium |
| 20402 | 1259 | 30 | Mycobacterium avium subsp. avium |
| 20403 | 1260 | 100 | Mycobacterium avium subsp. avium |
| 20404 | 1261 | 30 | Mycobacterium avium subsp. avium |
| 20405 | 1262 | 32 | Streptomyces coelicolor |
| 20406 | 1263 | 30 | Mycobacterium avium subsp. avium |
| 20407 | 1264 | 30 | Mycobacterium avium subsp. avium |
| 20408 | 1265 | 35 | Homo sapiens |
| 20409 | 1266 | 30 | Mycobacterium avium subsp. avium |
| 20410 | 1267 | 30 | Mycobacterium avium subsp. avium |
| 20411 | 1268 | 30 | Mycobacterium avium subsp. avium |
| 20412 | 1269 | 30 | Mycobacterium avium subsp. avium |
| 20413 | 1270 | 30 | Mycobacterium avium subsp. avium |
| 20414 | 1271 | 30 | Mycobacterium avium subsp. avium |
| 20415 | 1272 | 30 | Mycobacterium avium subsp. avium |
| 20416 | 1273 | 32 | Chloroflexus aurantiacus |
| 20417 | 1274 | 30 | Mycobacterium avium subsp. avium |
| 20418 | 1275 | 30 | Mycobacterium avium subsp. avium |
| 20419 | 1276 | 30 | Mycobacterium avium subsp. avium |
| 20420 | 1277 | 30 | Mycobacterium avium subsp. avium |
| 20421 | 1278 | 33 | Homo sapiens |
| 20422 | 1279 | 30 | Mycobacterium avium subsp. avium |
| 20423 | 1280 | 30 | Mycobacterium avium subsp. avium |
| 20424 | 1281 | 30 | Mycobacterium avium subsp. avium |
| 20425 | 1282 | 39 | Azotobacter vinelandii; Coffea arabica |
| 20426 | 1283 | 33 | Homo sapiens |
| 20427 | 1284 | 44 | Agrobacterium tumefaciens |
| 20428 | 1285 | 30 | Mycobacterium avium subsp. avium |
| 20429 | 1286 | 32 | Mus musculus |
| 20430 | 1287 | 30 | Mycobacterium avium subsp. avium |
| 20431 | 1288 | 33 | Magnetospirillum magnetotacticum; Xanthomonas axonopodis; |
| 20432 | 1289 | 92 | Streptomyces coelicolor |
| 20433 | 1290 | 32 | Mycobacterium leprae |
| 20434 | 1291 | 30 | Mycobacterium avium subsp. avium |
| 20435 | 1292 | 30 | Mycobacterium avium subsp. avium |
| 20436 | 1293 | 32 | Serratia marcescens |
| 20958 | 1294 | 116 | Mycobacterium tuberculosis; Mycobacterium leprae; Deinococcus radiodurans; Xanthomonas campestris |
| 21004 | 1295 | 44 | Mus musculus; Streptomyces coelicolor |
| 21065 | 1296 | 39 | Rhodococcus opacus; Oryza sativa |
| 21164 | 1297 | 44 | Homo sapiens; Ralstonia metallidurans; Desulfovibrio desulfuricans; Azotobacter vinelandii; Desulfitobacterium hafniense; Streptomyces coelicolor |
| 21187 | 1298 | 57 | Mycobacterium tuberculosis; Pseudomonas syringae; Burkholderia fungorum; Lysobacter sp. |
| 21952 | 1299 | 58 | Pseudomonas aeruginosa; Mycobacterium tuberculosis; Leishmania major; Burkholderia fungorum; Amycolatopsis mediterranei; Streptomyces nodosus |
| 22117 | 1300 | 30 | Mycobacterium avium subsp. avium |
| 22118 | 1301 | 38 | Rhodospirillum rubrum; Thermobifida fusca; Ralstonia solanacearum |
| 22119 | 1302 | 30 | Mycobacterium avium subsp. avium |
| 22123 | 1303 | 32 | Thermobifida fusca |
| 22127 | 1304 | 59 | Mycobacterium leprae |
| 22130 | 1305 | 33 | Bifidobacterium longum |
| 22133 | 1306 | 38 | Pseudomonas putida; Desulfitobacterium hafniense |
| 22134 | 1307 | 32 | Homo sapiens |
| 22143 | 1308 | 30 | Mycobacterium avium subsp. avium |
| 22144 | 1309 | 32 | Rhodospirillum rubrum |
| 22146 | 1310 | 30 | Mycobacterium avium subsp. avium |
| 22147 | 1311 | 32 | Pseudomonas fluorescens |
| 22154 | 1312 | 32 | Rhodobacter sphaeroides; Bacillus stearothermophilus |
| 22222 | 1313 | 30 | Mycobacterium avium subsp. avium |
| 22236 | 1314 | 56 | Mycobacterium kansasii; Desulfitobacterium hafniense; Rhizobium meliloti; Gallus gallus |
| 22301 | 1315 | 100 | Mycobacterium tuberculosis; Azotobacter vinelandii |

TABLE 1-continued

| Fragment Designation | SEQ ID NO: | N (nt) | Organisms |
|---|---|---|---|
| 22479 | 1316 | 77 | *Mycobacterium avium* (strain 2151) |
| 22481 | 1317 | 100 | *Mycobacterium avium* (strain 2151); *Streptomyces coelicolor*; *Homo sapiens*; *Magnetospirillum magnetotacticum* |
| 22482 | 1318 | 30 | *Mycobacterium avium* subsp. *avium* |
| 22483 | 1319 | 72 | *Mycobacterium avium* (strain 2151) |
| 22616 | 1320 | 38 | *Hordeum vulgare*; *Amycolatopsis mediterranei*; *Lymantria dispar* nuclear polyhedrosis virus; *Oryza sativa*; Bovine herpesvirus; *Homo sapiens*; *Streptomyces hygroscopicus*; *Rhodospirillum rubrum*; *Triticum aestivum* |
| 22619 | 1321 | 50 | *Mesorhizobium loti*; *Ralstonia solanacearum*; *Thermobifida fusca*; *Mycobacterium tuberculosis*; *Caulobacter crescentus*; *Homo sapiens* |
| 22663 | 1322 | 57 | *Streptomyces coelicolor*; *Homo sapiens*; *Streptomyces avermitilis*; *Rhodobacter sphaeroides*; *Rhodospirillum rubrum*; *Desulfitobacterium hafniense*; *Oryza sativa* |
| 22956 | 1323 | 57 | *Burkholderia fungorum*; *Homo sapiens*; *Cavia porcellus*; *Azotobacter vinelandii* |
| 23136 | 1324 | 100 | *Mycobacterium tuberculosis*; *Mycobacterium leprae*; *Ralstonia solanacearum*; *Ralstonia metallidurans*; *Xylella fastidiosa*; *Streptomyces clavuligerus*; *Pseudomonas aeruginosa*; *Mesorhizobium loti*; *Myxococcus xanthus*; *Zea mays*; *Homo sapiens*; *Desulfovibrio desulfuricans* |
| 23367 | 1325 | 41 | *Xanthomonas axonopodis*; *Actinosynnema pretiosum* subsp. *auranticum* Maytansino; *Alcaligenes eutrophus*; *Azotobacter vinelandii*; *Ralstonia eutropha*; *Bifidobacterium longum*; *Pseudomonas stutzeri*; *Xanthomonas campestris*; |
| 23368 | 1326 | 30 | *Mycobacterium avium* subsp. *avium* |
| 23369 | 1327 | 57 | *Mesorhizobium loti*; *Magnetospirillum magnetotacticum*; *Mycobacterium tuberculosis*; *Bifidobacterium longum*; *Geobacter metallireducens*; *Klebsiella pneumoniae*; *Pseudomonas aeruginosa* |
| 23371 | 1328 | 51 | *Mycobacterium tuberculosis*; *Pseudomonas alcaligenes*; *Homo sapiens* |
| 23372 | 1329 | 47 | *Actinosynnema pretiosum* subsp. *auranticum maytansino* |
| 23373 | 1330 | 33 | *Homo sapiens*; *Sinorhizobium meliloti* |
| 23375 | 1331 | 35 | *Caulobacter crescentus*; *Ralstonia solanacearum*; *Deinococcus radiodurans* |
| 23461 | 1332 | 90 | *Mycobacterium leprae*; *Mycobacterium tuberculosis*; *Leishmania major* |
| 23540 | 1333 | 44 | *Ralstonia solanacearum*; *Leishmania major*; *Pseudomonas aeruginosa*; *Deinococcus radiodurans*; *Magnetospirillum magnetotacticum*; *Streptomyces coelicolor*; *Oryza sativa* |
| 23733 | 1334 | 57 | *Homo sapiens*; *Mycobacterium tuberculosis*; *Leishmania major*; *Mesorhizobium loti*; *Oryza sativa*; *Deinococcus radiodurans*; *Chlamydomonas reinhardtii* |
| 23842 | 1335 | 30 | *Mycobacterium avium* subsp. *avium* |
| 23868 | 1336 | 32 | *Escherichia coli* |
| 23869 | 1337 | 33 | *Bifidobacterium longum*; *Rattus norvegicus* |
| 23870 | 1338 | 42 | *Rhodococcus* sp.; *Mesorhizobium loti* |
| 23908 | 1339 | 63 | *Mycobacterium tuberculosis*; *Novosphingobium aromaticivorans*; *Caulobacter crescentus*; *Streptomyces coelicolor* |
| 23978 | 1340 | 56 | *Mycobacterium tuberculosis*; *Streptomyces coelicolor*; *Azotobacter vinelandii*; *Ralstonia solanacearum*; *Oryza sativa*; *Homo sapiens*; *Chloroflexus aurantiacus*; *Ralstonia metallidurans*; *Burkholderia fungorum*; *Desulfitobacterium hafniense*; *Zea mays*; *Mus musculus* |
| 24003 | 1341 | 75 | *Mycobacterium tuberculosis*; *Mycobacterium leprae*; *Giardia microti*; *Xanthomonas axonopodis*; *Paracoccus denitrificans*; *Streptomyces coelicolor*; *Caulobacter crescentus*; *Giardia lamblia*; *Magnetospirillum magnetotacticum*; *Pseudomonas syringae*; *Giardia intestinalis* |
| 24155 | 1342 | 30 | *Mycobacterium avium* subsp. *avium* |

With respect to the organisms identified in Table 1, some of them represent multiple species, subspecies, or strains. To test whether or not particular reagents distinguish between *M. paratuberculosis* and such species, subspecies, or strains, it may be desirable to test a representative number of species, subspecies, or strains, respectively. In cases where the genetic variation is minimal within the species, subspecies, or strains, it may not be necessary to test more than one or two species, subspecies, or strains, respectively. In other cases, multiple species, subspecies, or strains may need to be tested, although initial testing can focus on the most genetically distant species, subspecies, or strains, respectively.

In another aspect, the invention provides for vectors comprising a nucleic acid of the invention. Host cells comprising such a vector are further provided by the invention.

In yet another aspect, the invention provides for isolated polypeptides encoded by the nucleic acids of the invention. For example, the nucleic acid molecule having the sequence of SEQ ID NO:1 can encode a polypeptide having an amino acid sequence of SEQ ID NO:24; the nucleic acid molecule having the sequence of SEQ ID NO:2 can encode a polypeptide having an amino acid sequence of SEQ ID NO:25; the nucleic acid molecule having the sequence of SEQ ID NO:3 can encode a polypeptide having an amino acid sequence of SEQ ID NO:26; the nucleic acid molecule having the sequence of SEQ ID NO:4 can encode a polypeptide having an amino acid sequence of SEQ ID NO:27; the nucleic acid molecule having the sequence of SEQ ID NO:5 can encode a polypeptide having an amino acid sequence of SEQ ID NO:28; the nucleic acid molecule having the sequence of SEQ ID NO:6 can encode a polypeptide having an amino acid sequence of SEQ ID NO:29; the nucleic acid molecule having the sequence of SEQ ID NO:7 can encode a polypeptide having an amino acid sequence of SEQ ID NO:30; the nucleic acid molecule having the sequence of SEQ ID NO:8 can encode a polypeptide having an amino acid sequence of SEQ ID NO:31; the nucleic acid molecule having the sequence of SEQ ID NO:9 can encode a polypeptide having an amino acid sequence of SEQ ID NO:32; the nucleic acid molecule having the sequence of SEQ ID NO:10 can encode a polypeptide having an amino acid sequence of SEQ ID NO:33; the nucleic acid molecule having the sequence of SEQ ID NO:11 can encode a polypeptide having an amino acid sequence of SEQ ID NO:34; the nucleic acid molecule having the sequence of SEQ ID NO:12 can encode a polypeptide having an amino acid sequence of SEQ ID NO:35; the nucleic acid molecule having the sequence of SEQ ID NO:13 can encode a polypeptide having an amino acid sequence of SEQ ID NO:36; the nucleic acid molecule having the sequence of SEQ ID NO:14 can encode a polypeptide having an amino acid sequence of SEQ ID NO:37; the nucleic acid molecule having the sequence of SEQ ID NO:15 can encode a polypeptide having an amino acid sequence of SEQ ID NO:38; the nucleic acid molecule having the sequence of SEQ ID NO:16 can encode a polypeptide having an amino acid sequence of SEQ ID NO:39; the nucleic acid molecule having the sequence of SEQ ID NO:17 can encode a polypeptide having an amino acid sequence of SEQ ID NO:40; the nucleic acid molecule having the sequence of SEQ ID NO:18 can encode a polypeptide having an amino acid sequence of SEQ ID NO:41; the nucleic acid molecule having the sequence of SEQ ID NO:19 can encode a polypeptide having an amino acid sequence of SEQ ID NO:42; the nucleic acid molecule having the sequence of SEQ ID NO:20 can encode a polypeptide having an amino acid sequence of SEQ ID NO:43; the nucleic acid molecule having the sequence of SEQ ID NO:21 can encode a polypeptide having an amino acid sequence of SEQ ID NO:44; and the nucleic acid molecule having the sequence of SEQ ID NO:22 can encode a polypeptide having an amino acid sequence of SEQ ID NO:45.

In another aspect, the invention provides articles of manufacture that include one or more polypeptides of the invention. In still another aspect of the invention, there are provided antibodies that have specific binding affinity for a polypeptide of the invention.

In another aspect, the invention provides for methods for detecting the presence or absence of *M. paratuberculosis* in a biological sample. Such methods include contacting the biological sample with one or more of the nucleic acids of the invention (e.g., SEQ ID NOs:1-23 and 110-1342) under standard amplification conditions, wherein an amplification product is produced if *M. paratuberculosis* nucleic acid is present in the biological sample; and detecting the presence or absence of the amplification product. Generally, the presence of the amplification product indicates the presence of *M. paratuberculosis* in the biological sample, and the absence of the amplification product indicates the absence of *M. paratuberculosis* in the biological sample. Representative animals from which the biological sample can be derived include a cow, a sheep, a goat, a rabbit, a deer, an antelope, a bison, or a human. Representative biological samples include a fecal sample and a milk sample. Further, representative nucleic acids that can be used in the above-described methods include those having the sequence of SEQ ID NO:46-101 and 1343-1354.

In another aspect, the invention provides methods for detecting the presence or absence of *M. paratuberculosis* in a biological sample. Such methods include contacting the biological sample with one or more of the nucleic acids of the invention (e.g., SEQ ID NOs:1-23 and 110-1342) under hybridization conditions, wherein a hybridization complex is produced if *M. paratuberculosis* nucleic acid molecules are present in the biological sample; and detecting the presence or absence of the hybridization complex. Generally, the presence of the hybridization complex indicates the presence of *M. paratuberculosis* in the biological sample, and the absence of the hybridization complex indicates the absence of *M. paratuberculosis* in the biological sample. Typically, nucleic acids present in the biological sample are electrophoretically separated. Such electrophoretically separated nucleic acids can be attached to a solid support. Representative solid supports include nylon membranes and nitrocellulose membranes. Further, one or more nucleic acids can be labeled. Representative biological samples include a fecal sample, a milk sample, and a blood sample.

In another aspect, the invention provides methods for detecting the presence or absence of *M. paratuberculosis* in a biological sample. Such methods include contacting the biological sample with a polypeptide of the invention (e.g., SEQ ID NOs:24-45), wherein a polypeptide-antibody complex is produced if an antibody having specific binding affinity for the polypeptide is present in the sample; and detecting the presence or absence of the polypeptide-antibody complex. Typically, the presence of the polypeptide-antibody complex indicates the presence of *M. paratuberculosis* in the biological sample, and the absence of the polypeptide-antibody complex indicates the absence of *M. paratuberculosis* in the biological sample. Polypeptides used in the above-described method can be attached to a solid support. Further, representative biological samples include a blood sample and a milk sample.

In yet another aspect, the invention provides for methods for detecting the presence or absence of *M. paratuberculosis* in a biological sample. Such methods include contacting the biological sample with an antibody of the invention (e.g., an antibody having specific binding affinity for a polypeptide having an amino acid sequence of SEQ ID NOs:24-45), wherein an antibody-polypeptide complex is produced if a polypeptide is present in the biological sample for which the antibody has specific binding affinity, and detecting the presence or absence of the antibody-polypeptide complex. Generally, the presence of the antibody-polypeptide complex indicates the presence of *M. paratuberculosis* in the biological sample, and the absence of the antibody-polypeptide complex indicates the absence of *M. paratuberculosis* in the biological sample. Antibodies used in the above-described methods can be bound to a solid support. Representative biological samples that can be used in the above-described methods include a blood sample and a milk sample.

In still another aspect of the invention, there are provided methods of preventing infection by *M. paratuberculosis* in an animal. Such methods include administering a compound to the animal, wherein the compound comprises a polypeptide of the invention (e.g., SEQ ID NOs:24-45). Alternatively, such methods include administering a compound to the animal, wherein the compound comprises a nucleic acid of the invention (e.g., a nucleic acid comprising a nucleic acid molecule having at least 75% sequence identity to SEQ ID NOs: 1-23, 110-1341, or 1342). Typically, the compound immunizes the animal against *M. paratuberculosis*.

In another aspect of the invention, there is provided a composition comprising a first oligonucleotide primer and a second oligonucleotide primer, wherein the first oligonucleotide primer and the second oligonucleotide primer are each 10 to 50 nucleotides in length, and wherein the first and second oligonucleotide primers, in the presence of *M. paratuberculosis* nucleic acid, generate an amplification product under standard amplification conditions, but do not generate an amplification product in the presence of *M. avium* subsp. *avium* nucleic acid. The invention further provides for an article of manufacture comprising such a composition.

In yet another aspect of the invention, there is provided an isolated nucleic acid, wherein the nucleic acid comprises a nucleic acid molecule greater than 10 nucleotides in length. Such a molecule has at least 75% sequence identity to SEQ ID NO:1355 or to the complement of SEQ ID NO:1355, and hybridizes under stringent conditions with *M. paratuberculosis* nucleic acid but does not hybridize with *M. avium* subsp. *avium* nucleic acid under the same hybridization conditions. Any of the sequences disclosed herein (e.g., SEQ ID NOs:1-23, 110-1341, or 1342) can be used to design one or more oligonucleotide primers.

In still another aspect of the invention, there is provided articles of manufacture. Articles of manufacture of the invention can include one or more isolated nucleic acids of the invention.

In yet another aspect of the invention, the reagents and methods disclosed herein are used by a diagnostic service provider (e.g., a diagnostic testing laboratory) to obtain and report test results. For example, a provider could send out, or otherwise provide, a collection vial or other container to a customer (recipient) desiring the provider's diagnostic testing services. The container can be part of a collection kit including sterile plastic ware components, for example. The collection kit further can include instructions for collecting a biological sample (e.g., feces, or milk), and for returning the container, with the sample, to the provider. Upon return to the provider, the provider can perform a diagnostic assay on the sample using the reagents and methods disclosed herein. Following completion of the assay, the provider can send or otherwise communicate results of the assay to the recipient.

Unless otherwise defined, all technical and scientific terms used herein have the same meaning as commonly understood by one of ordinary skill in the art to which this invention pertains. Although methods and materials similar or equivalent to those described herein can be used in the practice or testing of the present invention, suitable methods and materials are described below. In addition, the materials, methods, and examples are illustrative only and not intended to be limiting. All publications, patent applications, patents, and other references mentioned herein are incorporated by reference in their entirety. In case of conflict, the present specification, including definitions, will control.

The details of one or more embodiments of the invention are set forth in the accompanying drawings and the description below. Other features, objects, and advantages of the invention will be apparent from the drawings and detailed description, and from the claims.

DESCRIPTION OF DRAWINGS

FIG. 2 shows the sequences of *M. paratuberculosis*-specific nucleic acid molecules (SEQ ID NOs: 1-23).

FIG. 3 shows the polypeptide sequences (SEQ ID NOs:24-45) encoded by *M. paratuberculosis*-specific nucleic acids. An * indicates a stop codon.

FIG. 4 shows representative nucleic acid molecules having 75%, 80%, 85%, 90%, 95%, and 99% sequence identity to SEQ ID NO:1 (SEQ ID NOs:102-107, respectively).

FIG. 5 is a map of the *M. paratuberculosis* genome, showing the relative positions of novel sequences.

FIG. 6 shows the sequences of *M. paratuberculosis*-specific nucleic acid molecules (SEQ ID NOs:110-1342).

DETAILED DESCRIPTION

Figure 1:
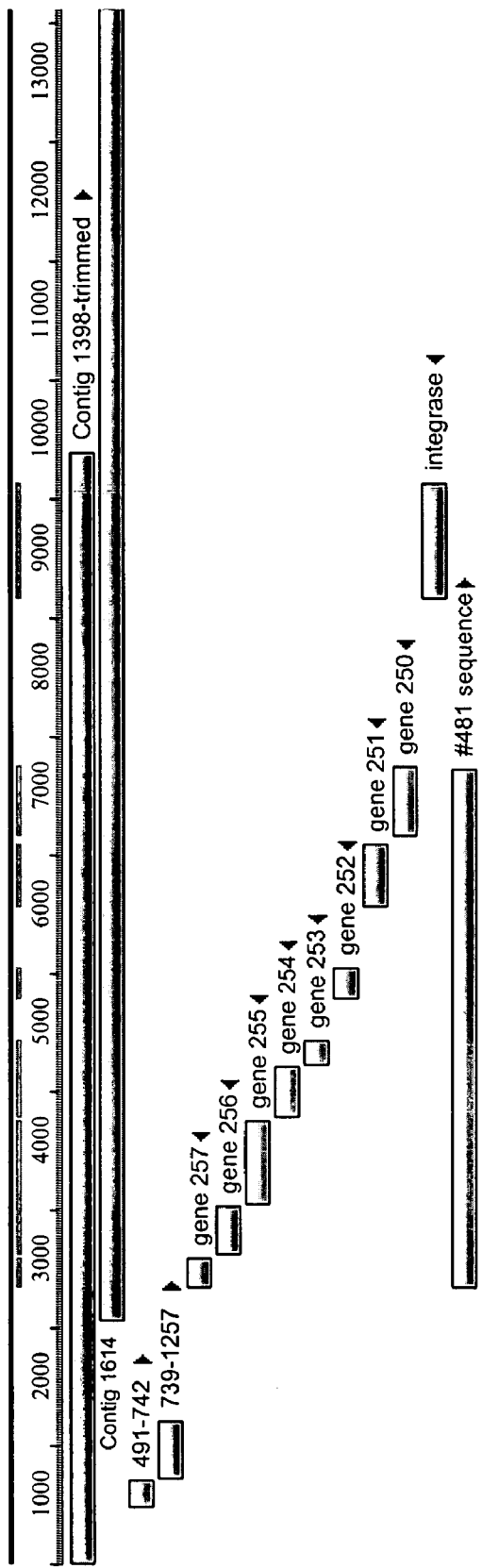
FIG. 1 is a sequence alignment schematic showing positions of predicted coding sequences relative to assembled contig fragments. Alignments of contig 1614 and a trimmed fragment of the 94-kb contig 1398 are shown along with each predicted coding sequence listed in Table 4. Note that the core region of genes 250 to 257 is well separated from neighboring coding regions. The integrase gene upstream of gene 250 is also designated gene 249.

The close genetic relationship between *M. paratuberculosis* and *M. avium* has made difficult the identification of nucleic acids and polypeptides specific to *M. paratuberculosis* that can be used with high sensitivity and specificity to detect *M. paratuberculosis*. The present invention provides nucleic acid molecules that are unique to *M. paratuberculosis*. The invention also provides the *M. paratuberculosis*-specific polypeptides encoded by the nucleic acid molecules of the invention, and antibodies having specific binding affinity for the *M. paratuberculosis*-specific polypeptides. The nucleic acid molecules, polypeptides, and antibodies of the invention can be used in methods of the invention to detect *M. paratuberculosis* in a sample. The invention additionally provides methods of preventing a *M. paratuberculosis* infection in an animal.

Isolated *M. paratuberculosis*-Specific Nucleic Acid Molecules

The present invention is based, in part, on the identification of nucleic acid molecules that are unique to *M. paratuberculosis*. These nucleic acid molecules are herein referred to as "*M. paratuberculosis*-specific" nucleic acid molecules. Particular nucleic acid molecules of the invention include the sequences shown in SEQ ID NOs:1-23 and 110-1342. As used herein, the term "nucleic acid molecule" can include DNA molecules and RNA molecules and analogs of the DNA or RNA molecule generated using nucleotide analogs. A nucleic acid molecule of the invention can be single-stranded or double-stranded, and the strandedness will depend upon its intended use.

The invention further encompasses nucleic acid molecules that differ from the nucleotide sequence of SEQ ID NOs:1-23 and 110-1342. Nucleic acid molecules of the invention include molecules that are at least 10 nucleotides in length and that have at least 75% sequence identity (e.g., at least 80%, 85%, 90%, 95%, or 99% sequence identity) to any of SEQ ID NOs:1-23 and 110-1342. The full-length sizes of each of the novel *M. paratuberculosis*-specific nucleic acid molecules having the sequences shown in SEQ ID NOs:1-23 are indicated in Table 2. Nucleic acid molecules that differ in sequence from the nucleic acid sequences shown in SEQ ID NOs:1-23 and 110-1342 can be generated by standard techniques, such as site-directed mutagenesis or PCR-mediated mutagenesis. In addition, nucleotide changes can be introduced randomly along all or part of the *M. paratuberculosis*-specific nucleic acid molecule, such as by saturation mutagenesis. Alternatively, nucleotide changes can be introduced into a sequence by chemically synthesizing a nucleic acid molecule having such changes.

TABLE 2

Sizes of *M. paratuberculosis*-specific nucleic acid molecules and polypeptides

| Gene | Nucleic Acid (bp) | SEQ ID NO: | Polypeptide (amino acids) | SEQ ID NO: |
|------|-------------------|------------|---------------------------|------------|
| 10   | 969               | 1          | 322                       | 24         |
| 11   | 576               | 2          | 191                       | 25         |
| 38   | 522               | 3          | 173                       | 26         |
| 56   | 582               | 4          | 193                       | 27         |
| 57   | 311               | 5          | 103                       | 28         |
| 128  | 576               | 6          | 191                       | 29         |
| 135  | 474               | 7          | 157                       | 30         |
| 159  | 558               | 8          | 185                       | 31         |
| 217  | 321               | 9          | 106                       | 32         |
| 218  | 2508              | 10         | 835                       | 33         |
| 219  | 264               | 11         | 87                        | 34         |
| 228  | 1110              | 12         | 369                       | 35         |
| 240  | 672               | 13         | 223                       | 36         |
| 241  | 372               | 14         | 123                       | 37         |
| 250  | 600               | 15         | 199                       | 38         |
| 251  | 540               | 16         | 179                       | 39         |
| 252  | 291               | 17         | 96                        | 40         |
| 253  | 225               | 18         | 74                        | 41         |
| 254  | 441               | 19         | 146                       | 42         |
| 255  | 726               | 20         | 241                       | 43         |
| 256  | 426               | 21         | 141                       | 44         |
| 257  | 279               | 22         | 87                        | 45         |

In calculating percent sequence identity, two sequences are aligned and the number of identical matches of nucleotides or amino acid residues between the two sequences is determined. The number of identical matches is divided by the length of the aligned region (i.e., the number of aligned nucleotides or amino acid residues) and multiplied by 100 to arrive at a percent sequence identity value. It will be appreciated that the length of the aligned region can be a portion of one or both sequences up to the full-length size of the shortest sequence. It will be appreciated that a single sequence can align differently with other sequences and hence, can have different percent sequence identity values over each aligned region. It is noted that the percent identity value is usually rounded to the nearest integer. For example, 78.1%, 78.2%, 78.3%, and 78.4% are rounded down to 78%, while 78.5%, 78.6%, 78.7%, 78.8%, and 78.9% are rounded up to 79%. It is also noted that the length of the aligned region is always an integer.

The alignment of two or more sequences to determine percent sequence identity is performed using the algorithm described by Altschul et al. (1997, *Nucleic Acids Res.*, 25:3389-3402) as incorporated into BLAST (basic local alignment search tool) programs, available at ncbi.nlm.nih.gov on the World Wide Web. BLAST searches can be performed to determine percent sequence identity between a *M. paratuberculosis*-specific nucleic acid molecule of the invention and any other sequence or portion thereof aligned using the Altschul et al. algorithm. BLASTN is the program used to align and compare the identity between nucleic acid sequences, while BLASTP is the program used to align and compare the identity between amino acid sequences. When utilizing BLAST programs to calculate the percent identity between a sequence of the invention and another sequence, the default parameters of the respective programs are used. Sequence analysis of the *M. paratuberculosis*-specific nucleic acid sequences as performed herein used BLAST version 2.2.2 (updated on Dec. 14, 2001).

The sequences of representative nucleic acids of the invention having 75%, 80%, 85%, 90%, 95%, and 99% sequence identity to SEQ ID NO:1 are shown in FIG. 4 (SEQ ID NOs:102-107, respectively). Such sequences can be generated using a computer or by hand. The nucleic acid sequences shown in SEQ ID NOs:102-107 were generated by hand by randomly changing 25 nucleotides out of every 100 nucleotides of SEQ ID NO:1, 2 out of every 10, 15 out of every 100, 1 out of every 10, 5 out of every 100, or 1 nucleotide out of every 100 nucleotides of SEQ ID NO:1, respectively. By "changing," it is meant that the nucleotide at a particular position is replaced randomly with one of the other three nucleotides. It is apparent to those of ordinary skill in the art that any nucleic acid molecule within the scope of the invention can be generated using the same method described herein (i.e., by similarly changing nucleotides within the sequence of SEQ ID NOs:1-23 or 110-1342).

Nucleic acid molecules of the invention between about 10 and about 30 nucleotides in length will, under standard amplification conditions, generate an amplification product in the presence of *M. paratuberculosis* nucleic acid using an appropriate second nucleic acid molecule (e.g., an oligonucleotide primer that specifically anneals to *M. paratuberculosis* nucleic acid) but will not generate an amplification product in the presence of nucleic acid from an organism other than *M. paratuberculosis* using an appropriate third nucleic acid molecule (e.g., an oligonucleotide primer that specifically anneals to nucleic acid from the other organism). As used herein, "standard amplification conditions" refer to the basic components of an amplification reaction mix, and cycling conditions that include multiple cycles of denaturing the template nucleic acid, annealing the oligonucleotide primers to the template nucleic acid, and extension of the primers by the polymerase to produce an amplification product (see, for example, U.S. Pat. Nos. 4,683,195; 4,683,202; 4,800,159; and 4,965,188). The basic components of an amplification reaction mix generally include, for example, about 10-25 nmole of each of the four deoxynucleoside triphosphates, (e.g., dATP, dCTP, dTTP, and dGTP, or analogs thereof), 10-100 pmol of primers, template nucleic acid, and a polymerase enzyme. The reaction components are generally suspended in a buffered aqueous solution having a pH of between about 7 and about 9. The aqueous buffer can further include one or more co-factors (e.g., $Mg^{2+}$, $K^+$) required by the polymerase. Additional components such as DMSO are optional. Template nucleic acid is typically denatured at a temperature of at least about 90° C., and extension from primers is typically performed at a temperature of at least about 72° C.

The annealing temperature can be used to control the specificity of amplification. The temperature at which primers anneal to template nucleic acid must be below the Tm of each of the primers, but high enough to avoid non-specific annealing of primers to the template nucleic acid. The Tm is the temperature at which half of the DNA duplexes have separated into single strands, and can be predicted for an oligonucleotide primer using the formula provided in section 11.46 of Sambrook et al. (1989, *Molecular Cloning: A Laboratory Manual*, 2nd Ed., Cold Spring Harbor Laboratory Press, Cold Spring Harbor, N.Y.). Non-specific amplification products are detected as bands on a gel that are not the size expected for the correct amplification product. The annealing temperature used in amplification reactions described herein to demonstrate that the claimed nucleic acid molecules are *M. paratuberculosis*-specific was 55° C. and 60° C. for nucleic acids isolated from bacteria or from a biological sample, respectively. It can be appreciated by those of skill in the art that appropriate positive and negative controls should be performed with every set of amplification reactions to avoid uncertainties related to contamination and/or non-specific annealing of oligonucleotide primers and extension therefrom.

An appropriate second nucleic acid molecule is generally an oligonucleotide primer that specifically anneals to *M. paratuberculosis* nucleic acid, and that can act in combination with a nucleic acid molecule of the invention, specifically for example a 10- to 30-, or 40-, or 50-nucleotide-long nucleic acid molecule of the invention, under appropriate amplification conditions to generate an amplification product in the presence of *M. paratuberculosis* nucleic acid. In order for a second nucleic acid molecule to act in combination with a nucleic acid molecule of the invention to generate an amplification product, the two molecules must anneal to opposite strands of the template nucleic acid, and should be an appropriate distance from one another such that the polymerase can effectively polymerize across the region and such that the amplification product can be readily detected using, for example, electrophoresis. Oligonucleotide primers can be designed using, for example, a computer program such as OLIGO (Molecular Biology Insights Inc., Cascade, Colo.) to assist in designing primers that have similar melting temperatures. Typically, oligonucleotide primers are 10 to 30 or 40 or 50 nucleotides in length (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length), but can be longer or shorter if appropriate amplification conditions are used.

Representative pairs of oligonucleotide primers that were used to amplify each of the *M. paratuberculosis*-specific nucleic acid molecules of the invention are shown in Tables 3, 6, and 12 (SEQ ID NOs:46-101 and 1343-1354). Alternatively, the nucleic acid molecules having the sequences shown in SEQ ID NOs:1-23 and 110-1342 can be used to design a pair of oligonucleotide primers. Oligonucleotides of the invention can be obtained by restriction enzyme digestion of *M. paratuberculosis*-specific nucleic acid molecules or can be prepared by standard chemical synthesis and other known techniques.

As used herein, an organism other than *M. paratuberculosis* refers to any organism that is not *M. paratuberculosis*. Generally, only relevant organisms are used in amplification reactions to examine the specificity of a 10 or more nucleotide-long nucleic acid molecule of the invention. Particularly relevant organisms include, without limitation, *Ralstonia solanacearum, Sinorhizobium meliloti, Homo sapiens, Mesorhizobium loti, Oryza sativa, Drosophila melanogaster, Rhizobium leguminosarum, Xylella fastidiosa, Deinococcus radiodurans, Achromobacter cycloclastes, Candida cylindracea, Streptomyces lavendulae, Streptococcus pneumoniae, Mycobacterium tuberculosis, Pseudomonas aeruginosa, Sus scrofa, Mycobacterium leprae, Streptomyces coelicolor, Pseudomonas* sp. (e.g., strain CA-10), *Thauera aromatica, Brucella melitensis, Streptomyces noursei, Rhizobium meliloti, Synechococcus elongates, Rhodobacter capsulatus, Agrobacterium tumefaciens, Mycobacterium smegmatis, Drosophila virilis, Mus musculus, Leishmania major, Botrytis cinerea, Caulobacter crescentus, Rhodobacter sphaeroides, Spermatozopsis similes, Giardia intestinalis, Triticum aestivum*, Bovine herpesvirus, *Streptomyces* sp. (e.g., strain MA-6548), *Streptomyces peucetius, Rhizobium* sp. (e.g., strain NGR-234), *Haloferax volcanii, Streptomyces viridochromogenes, Felis catus, Xanthomonas campestris, Thermotoga maritime, Thermotoga neapolitana, Frankia alni, Halobacterium* NRC-1 (ATCC Accession No. 700922), *Glycine max, Leishmania tarentolae, Neisseria meningitides, Escherichia coli, Caenorhabditis elegans, Leishmania mexicana, Zea mays*, Ictalurid herpesvirus, *Rattus norvegicus, Arabidopsis thaliana, Pseudomonas fluorescens, Pantoea agglomerans, Erwinia uredovora, Pantoea ananatis, Streptomyces hygroscopicus, Rickettsia typhi, Pseudomonas cruciviae, Xanthomonas albilineans, Halobacterium salinarium, Micromonospora griseorubida, Pseudomonas paucimobilis, Streptomyces lividans, Pyrobaculum aerophilum, Sinorhizobium meliloti, Mesorhizobium loti, Bacillus halodurans, Trypanosoma rangeli, Trypanosoma minasense, Trypanosoma leeuwenhoeki*, and *Brassica napus*. A 10 or more nucleotide-long nucleic acid molecule of the invention in combination with an appropriate third nucleic acid molecule (e.g., a third oligonucleotide primer) will not generate an amplification product from nucleic acid of one or more of these other organisms.

As used herein, an "isolated" nucleic acid molecule is a nucleic acid molecule that is separated from other nucleic acid molecules that are usually associated with the isolated nucleic acid molecule. Thus, an "isolated" nucleic acid molecule includes, without limitation, a nucleic acid molecule that is free of sequences that naturally flank one or both ends of the nucleic acid in the genome of the organism from which the isolated nucleic acid is derived (e.g., a cDNA or genomic DNA fragment produced by PCR or restriction endonuclease digestion). Such an isolated nucleic acid molecule is generally introduced into a vector (e.g., a cloning vector, or an expression vector) for convenience of manipulation or to generate a fusion nucleic acid molecule. In addition, an isolated nucleic acid molecule can include an engineered nucleic acid molecule such as a recombinant or a synthetic nucleic acid molecule. A nucleic acid molecule existing among hundreds to millions of other nucleic acid molecules within, for example, a nucleic acid library (e.g., a cDNA, or genomic library) or a portion of a gel (e.g., agarose, or polyacrylamine) containing restriction-digested genomic DNA is not to be considered an isolated nucleic acid.

Isolated nucleic acid molecules of the invention can be obtained using techniques routine in the art. For example, isolated nucleic acids within the scope of the invention can be obtained using any method including, without limitation, recombinant nucleic acid technology, and/or the polymerase chain reaction (PCR). General PCR techniques are described, for example in *PCR Primer: A Laboratory Manual*, Dieffenbach & Dveksler, Eds., Cold Spring Harbor Laboratory Press, 1995. Recombinant nucleic acid techniques include, for example, restriction enzyme digestion and ligation, which can be used to isolate a nucleic acid molecule of the invention. Isolated nucleic acids of the invention also can be chemically synthesized, either as a single nucleic acid molecule or as a series of oligonucleotides. In addition, isolated nucleic acid molecules of the invention also can be obtained by mutagenesis. For example, an isolated nucleic acid that shares identity with an art known *M. paratuberculosis*-specific nucleic acid sequence can be mutated using common molecular cloning techniques (e.g., site-directed mutagenesis). Possible mutations include, without limitation, deletions, insertions, substitutions, and combinations thereof.

Vectors containing *M. paratuberculosis*-specific nucleic acid molecules also are provided by the invention. Vectors, including expression vectors, suitable for use in the present invention are commercially available and/or produced by recombinant DNA technology methods routine in the art. A vector containing a *M. paratuberculosis*-specific nucleic acid molecule can have elements necessary for expression operably linked to such a *M. paratuberculosis*-specific nucleic acid, and further can include sequences such as those encoding a selectable marker (e.g., an antibiotic resistance gene), and/or those that can be used in purification of a *M. paratuberculosis*-specific polypeptide (e.g., 6×His tag).

Elements necessary for expression include nucleic acid sequences that direct and regulate expression of nucleic acid coding sequences. One example of an element necessary for expression is a promoter sequence, for example, a *M. paratuberculosis*-specific promoter (e.g., from the same coding sequence being expressed or from a different coding sequence) or a non-*M. paratuberculosis*-specific promoter. Elements necessary for expression also can include introns, enhancer sequences, response elements, or inducible elements that modulate expression of a *M. paratuberculosis*-specific nucleic acid. Elements necessary for expression can be of bacterial, yeast, insect, mammalian, or viral origin and vectors can contain a combination of elements from different origins. Elements necessary for expression are described, for example, in Goeddel, 1990, *Gene Expression Technology: Methods in Enzymology*, 185, Academic Press, San Diego, Calif. As used herein, operably linked means that a promoter and/or other regulatory element(s) are positioned in a vector relative to a *M. paratuberculosis*-specific nucleic acid in such a way as to direct or regulate expression of the *M. paratuberculosis*-specific nucleic acid. Many methods for introducing nucleic acids into cells, both in vivo and in vitro, are well known to those skilled in the art and include, without limitation, calcium phosphate precipitation, electroporation, heat shock, lipofection, microinjection, and viral-mediated nucleic acid transfer.

Another aspect of the invention pertains to host cells into which a vector of the invention, e.g., an expression vector, or an isolated nucleic acid molecule of the invention has been introduced. The term "host cell" refers not only to the particular cell but also to the progeny or potential progeny of such a cell. A host cell can be any prokaryotic or eukaryotic cell. For example, *M. paratuberculosis*-specific nucleic acids can be expressed in bacterial cells such as *E. coli*, or in insect cells, yeast or mammalian cells (such as Chinese hamster ovary cells (CHO) or COS cells). Other suitable host cells are known to those skilled in the art.

Vectors containing representative nucleic acid molecules unique to *M. paratuberculosis* were deposited with the American Type Culture Collection (ATCC), 10801 University Boulevard Manassas, Va. 20110, on Apr. 3, 2002, and assigned Accession Numbers PTA-4199, and PTA-4200. Each deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

Purified *M. paratuberculosis* Polypeptides

One aspect of the invention pertains to purified *M. paratuberculosis*-specific polypeptides, as well as polypeptide fragments. A "*M. paratuberculosis*-specific polypeptide" refers to a polypeptide encoded by a nucleic acid molecule that is unique to *M. paratuberculosis* (e.g., *M. paratuberculosis*-specific nucleic acid molecules, for example, those having the sequence shown in SEQ ID NOs:1-23 and 110-1342). Predicted amino acid sequences encoded by novel *M. paratuberculosis*-specific nucleic acids of the invention are shown in SEQ ID NOs:24-45.

The term "purified" polypeptide as used herein refers to a polypeptide that has been separated or purified from cellular components that naturally accompany it. Typically, the polypeptide is considered "purified" when it is at least 70% (e.g., at least 75%, 80%, 85%, 90%, 95%, or 99%) by dry weight, free from the proteins and naturally occurring molecules with which it is naturally associated. Since a polypeptide that is chemically synthesized is, by nature, separated from the components that naturally accompany it, a synthetic polypeptide is "purified."

*M. paratuberculosis*-specific polypeptides can be purified from natural sources (e.g., a biological sample) by known methods such as DEAE ion exchange, gel filtration, and hydroxyapatite chromatography. A purified *M. paratuberculosis*-specific polypeptide also can be obtained by expressing a *M. paratuberculosis*-specific nucleic acid in an expression vector, for example. In addition, a purified *M. paratuberculosis*-specific polypeptide can be obtained by chemical synthesis. The extent of purity of a *M. paratuberculosis*-specific polypeptide can be measured using any appropriate method, e.g., column chromatography, polyacrylamide gel electrophoresis, or HPLC analysis.

In addition to naturally-occurring *M. paratuberculosis*-specific polypeptides, the skilled artisan will further appreciate that changes can be introduced into a nucleic acid molecule (e.g., those having the sequence shown in SEQ ID NOs:1-23, 110-1341, or 1342) as discussed herein, thereby leading to changes in the amino acid sequence of the encoded polypeptide. For example, changes can be introduced into *M. paratuberculosis*-specific nucleic acid coding sequences leading to conservative and/or non-conservative amino acid substitutions at one or more amino acid residues. A "conservative amino acid substitution" is one in which one amino acid residue is replaced with a different amino acid residue having a similar side chain. Similarity between amino acid residues has been assessed in the art. For example, Dayhoff et al. (1978, in *Atlas of Protein Sequence and Structure*, Vol. 5, Suppl. 3, pp 345-352) provides frequency tables for amino acid substitutions that can be employed as a measure of amino acid similarity. A non-conservative substitution is one in which an amino acid residue is replaced with an amino acid residue that does not have a similar side chain.

The invention also provides for chimeric or fusion polypeptides. As used herein, a "chimeric" or "fusion" polypeptide includes a *M. paratuberculosis*-specific polypeptide operatively linked to a heterologous polypeptide. A heterologous polypeptide can be at either the N-terminus or C-terminus of the *M. paratuberculosis*-specific polypeptide. Within a chimeric or fusion polypeptide, the term "operatively linked" is intended to indicate that the two polypeptides are encoded in-frame relative to one another. In a fusion polypeptide, the heterologous polypeptide generally has a desired property such as the ability to purify the fusion polypeptide (e.g., by affinity purification). A chimeric or fusion polypeptide of the invention can be produced by standard recombinant DNA techniques, and can use commercially available vectors.

A polypeptide commonly used in a fusion polypeptide for purification is glutathione S-transferase (GST), although numerous other polypeptides are available and can be used. In addition, a proteolytic cleavage site can be introduced at the junction between a *M. paratuberculosis*-specific polypeptide and a non-*M. paratuberculosis*-specific polypeptide to enable separation of the two polypeptides subsequent to purification of the fusion polypeptide. Enzymes that cleave such proteolytic sites include Factor Xa, thrombin, or enterokinase. Representative expression vectors encoding a heterologous polypeptide that can be used in affinity purification of a *M. paratuberculosis* polypeptide include pGEX (Pharmacia Biotech Inc; Smith & Johnson, 1988, *Gene,* 67:31-40), pMAL (New England Biolabs, Beverly, Mass.) and pRIT5 (Pharmacia, Piscataway, N.J.).

Anti-*M. paratuberculosis*-Specific Antibodies

Another aspect of the invention relates to anti-*M. paratuberculosis*-specific antibodies. The term "anti-*M. paratuberculosis*-specific antibodies" as used herein refers to immunoglobulin molecules and immunologically active portions of immunoglobulin molecules that have specific binding affinity for a *M. paratuberculosis*-specific polypeptide. The invention provides polyclonal and monoclonal antibodies that have specific binding affinity for *M. paratuberculosis*-specific polypeptides. The sequences of numerous *M. paratuberculosis*-specific polypeptides that can be used to generate anti-*M. paratuberculosis*-specific antibodies are disclosed herein (e.g., SEQ ID NOs:24-45). Examples of immunologically active portions of immunoglobulin molecules include F(ab) and $F(ab')_2$ fragments, which can be generated by treating an immunoglobulin molecule with an enzyme such as pepsin. As used herein, an antibody that has "specific binding affinity" for a *M. paratuberculosis*-specific polypeptide is an antibody that binds a *M. paratuberculosis*-specific polypeptide but does not bind a non-*M. paratuberculosis*-specific polypeptides. A non-*M. paratuberculosis*-specific polypeptide as used herein refers to a polypeptide that may or may not be found in *M. paratuberculosis*, but is found in at least one other organism besides *M. paratuberculosis.*

A purified *M. paratuberculosis*-specific polypeptide or a fragment thereof can be used as an immunogen to generate polyclonal or monoclonal antibodies that have specific binding affinity for *M. paratuberculosis*-specific polypeptides. Such antibodies can be generated using standard techniques as described herein. Full-length *M. paratuberculosis*-specific polypeptides (see Table 2) or, alternatively, antigenic fragments of *M. paratuberculosis*-specific polypeptides can be used as immunogens. An antigenic fragment of a *M. paratuberculosis*-specific polypeptide usually includes at least 8 (e.g., 10, 15, 20, or 30) amino acid residues of a *M. paratuberculosis*-specific polypeptide (e.g., having the sequence shown in SEQ ID NOs:23-45), and encompasses an epitope of a *M. paratuberculosis*-specific polypeptide such that an antibody (e.g., polyclonal or monoclonal) raised against the antigenic fragment has specific binding affinity for a *M. paratuberculosis*-specific polypeptide.

Antibodies are typically prepared by first immunizing a suitable animal (e.g., a rabbit, a goat, a mouse or another mammal) with an immunogenic preparation. An appropriate immunogenic preparation can contain, for example, a recombinantly expressed or chemically synthesized *M. paratuberculosis*-specific polypeptide, of a fragment thereof. The preparation can further include an adjuvant, such as Freund's complete or incomplete adjuvant, or similar immunostimulatory agent. Immunization of a suitable animal with an immunogenic *M. paratuberculosis*-specific polypeptide preparation induces a polyclonal anti-*M. paratuberculosis*-specific antibody response.

The titer of the anti-*M. paratuberculosis*-specific antibody in the immunized animal can be monitored over time by standard techniques, such as with an enzyme-linked immunosorbent assay (ELISA) using immobilized *M. paratuberculosis*-specific polypeptides. If desired, the antibody molecules directed against *M. paratuberculosis*-specific polypeptides can be isolated from the animal (e.g., from the blood) and further purified by well-known techniques such as protein A chromatography to obtain the IgG fraction.

At an appropriate time after immunization, e.g., when the anti-*M. paratuberculosis*-specific antibody titers are highest, antibody-producing cells can be obtained from the animal and used to prepare monoclonal antibodies by standard techniques, such as the hybridoma technique originally described by Kohler & Milstein (1975, *Nature,* 256:495-497), the human B cell hybridoma technique (Kozbor et al., 1983, *Immunol. Today,* 4:72), or the EBV-hybridoma technique (Cole et al., 1985, *Monoclonal Antibodies and Cancer Therapy*, Alan R. Liss, Inc., pp. 77-96). The technology for producing various monoclonal antibody hybridomas is well known (see, generally, *Current Protocols in Immunology,* 1994, Coligan et al. (Eds.), John Wiley & Sons, Inc., New York, N.Y.). Briefly, an immortal cell line (e.g., a myeloma cell line) is fused to lymphocytes (e.g., splenocytes) from an animal immunized with an immunogenic *M. paratuberculosis*-specific polypeptide as described above, and the culture supernatants of the resulting hybridoma cells are screened to identify a hybridoma producing a monoclonal antibody that has specific binding affinity for the *M. paratuberculosis*-specific polypeptide.

Any of the well-known protocols used for fusing lymphocytes and immortalized cell lines can be applied for the purpose of generating an anti-*M. paratuberculosis*-specific monoclonal antibody (see, e.g., *Current Protocols in Immunology*, supra; Galfre et al., 1977, *Nature,* 266:55052; R. H. Kenneth, in *Monoclonal Antibodies: A New Dimension In Biological Analyses*, Plenum Publishing Corp., New York, N.Y., 1980; and Lerner, 1981, *Yale J. Biol. Med.,* 54:387-402). Moreover, the ordinary skilled worker will appreciate that there are many variations of such methods that also would be useful. Typically, the immortal cell line is derived from the same species as the lymphocytes. For example, murine hybridomas can be made by fusing lymphocytes from a mouse immunized with an immunogenic preparation with an immortalized mouse cell line, e.g., a myeloma cell line that is sensitive to culture medium containing hypoxanthine, aminopterin and thymidine ("HAT medium"). Any of a number of ATCC-available myeloma cell lines can be used as a fusion partner according to standard techniques, e.g., the P3-NS1/1-Ag4-1, P3-x63-Ag8.653 or Sp2/O-Ag14 myeloma lines. Typically, HAT-sensitive mouse myeloma cells are fused to mouse splenocytes using polyethylene glycol (PEG). Hybridoma cells resulting from the fusion are then selected using HAT medium. Hybridoma cells producing a monoclonal antibody are detected by screening the hybridoma culture supernatants for antibodies that bind *M. paratuberculosis*-specific polypeptides, e.g., using a standard ELISA assay.

As an alternative to preparing monoclonal antibody-secreting hybridomas, an anti-*M. paratuberculosis*-specific monoclonal antibody can be identified and isolated by screening a recombinant combinatorial immunoglobulin library (e.g., an antibody phage display library) with *M. paratuberculosis*-specific polypeptides. Immunoglobulin library members that have specific binding affinity for *M. paratuberculosis*-specific polypeptides can be isolated from such libraries. Kits for generating and screening phage display libraries are commercially available (e.g., the Pharmacia Recombinant Phage Antibody System, Catalog No. 27-9400-01; and the Stratagene SurfZAP Phage Display Kit, Catalog No. 240612). Additionally, examples of methods and reagents particularly amenable for use in generating and screening antibody display libraries can be found in, for example, U.S. Pat. No. 5,223,409; PCT Publication No. WO 92/20791; PCT Publication No. WO 93/01288; Hay et al., 1992, *Hum. Antibod. Hybridomas*, 3:81-85; Griffiths et al., 1993, *EMBO J.*, 12:725-734; and references therein.

Additionally, recombinant anti-*M. paratuberculosis*-specific antibodies, such as chimeric and humanized monoclonal antibodies, comprising both human and non-human portions, are within the scope of the invention. Such chimeric and humanized monoclonal antibodies can be produced by recombinant DNA techniques known in the art, for example using methods described in PCT Publication No. WO 87/02671; European Patent (EP) Application 184,187; U.S. Pat. No. 4,816,567; Better et al., 1988, *Science,* 240:1041-1043; Shaw et al., 1988, *J. Natl. Cancer Inst.,* 80:1553-1559); U.S. Pat. No. 5,225,539; Verhoeyan et al., 1988, *Science,* 239:1534; Beidler et al., 1988, *J. Immunol.,* 141:4053-4060; and references therein.

An anti-*M. paratuberculosis*-specific antibody (e.g., a monoclonal antibody) can be used to isolate *M. paratuberculosis*-specific polypeptides by standard techniques, such as affinity chromatography or immunoprecipitation. An anti-*M. paratuberculosis*-specific antibody can facilitate the purification of natural *M. paratuberculosis*-specific polypeptides from cells and of recombinantly-produced *M. paratuberculosis*-specific polypeptides expressed in host cells. Moreover, an anti-*M. paratuberculosis*-specific antibody can be used to detect *M. paratuberculosis*-specific polypeptides (e.g., in a cellular lysate or cell supernatant) in order to evaluate the presence or absence of the *M. paratuberculosis*-specific polypeptides. Anti-*M. paratuberculosis*-specific antibodies can be used diagnostically to detect *M. paratuberculosis*-specific polypeptides, and hence, *M. paratuberculosis*, in a biological sample, e.g., to determine the infection status of an animal, or to determine the efficacy of a given treatment regimen.

Methods of Detecting *M. paratuberculosis*

The *M. paratuberculosis*-specific nucleic acid molecules and polypeptides, and the anti-*M. paratuberculosis*-specific antibodies described herein can be used in diagnostic assays for the detection of *M. paratuberculosis*. Diagnostic assays for determining the presence or absence of *M. paratuberculosis* are performed using a biological sample (e.g., fecal, blood, milk) to determine whether an animal has been exposed to or is infected with *M. paratuberculosis*. An exemplary method for detecting the presence or absence of *M. paratuberculosis* in a biological sample involves obtaining a biological sample from an animal and contacting the biological sample with an appropriate agent capable of detecting *M. paratuberculosis*-specific nucleic acids or polypeptides, or anti-*M. paratuberculosis*-specific antibodies.

The term "biological sample" is intended to include cells and biological fluids obtained from an animal. In one embodiment, a biological sample contains polypeptides from the animal. Alternatively, the biological sample can contain nucleic acid molecules from the animal, or the biological sample can contain antibodies from the animal. It should be understood that any biological sample in which *M. paratuberculosis*-specific nucleic acids or polypeptides, or anti-*M. paratuberculosis*-specific antibodies may be present can be utilized in the methods described herein.

In one embodiment, an agent for detecting the presence or absence of *M. paratuberculosis* in a biological sample is an isolated *M. paratuberculosis*-specific nucleic acid molecule of the invention. The presence of *M. paratuberculosis*-specific nucleic acids in a sample indicates the presence of *M. paratuberculosis* in the sample. Methods for detecting nucleic acids include, for example, PCR and nucleic acid hybridizations (e.g., Southern blot, Northern blot, or in situ hybridizations). Specifically, an agent can be one or more oligonucleotides (e.g., oligonucleotide primers) capable of amplifying *M. paratuberculosis*-specific nucleic acids using PCR. PCR methods generally include the steps of collecting a biological sample from an animal, isolating nucleic acid (e.g., DNA, RNA, or both) from the sample, and contacting the nucleic acid with one or more oligonucleotide primers that hybridize(s) with specificity to *M. paratuberculosis*-specific nucleic acid under conditions such that amplification of the *M. paratuberculosis*-specific nucleic acid occurs if *M. paratuberculosis* is present. In the presence of *M. paratuberculosis*, an amplification product corresponding to the *M. paratuberculosis*-specific nucleic acid is produced. Conditions for amplification of a nucleic acid and detection of an amplification product are known to those of skill in the art (see, e.g., *PCR Primer: A Laboratory Manual,* 1995, Dieffenbach & Dveksler, Eds., Cold Spring Harbor Laboratory Press, Cold Spring Harbor, N.Y.; and U.S. Pat. Nos. 4,683,195; 4,683,202; 4,800,159; and 4,965,188). Modifications to the original PCR also have been developed. For example, anchor PCR, RACE PCR, or ligation chain reaction (LCR) are additional PCR methods known in the art (see, e.g., Landegran et al., 1988, *Science,* 241:1077-1080; and Nakazawa et al., 1994, *Proc. Natl. Acad. Sci. USA,* 91:360-364).

Alternatively, an agent for detecting *M. paratuberculosis*-specific nucleic acids can be a labeled oligonucleotide probe capable of hybridizing to *M. paratuberculosis*-specific nucleic acids on a Southern blot. An oligonucleotide probe can be, for example, a *M. paratuberculosis*-specific nucleic acid molecule such as a nucleic acid molecule having the sequence shown in SEQ ID NO:1-22, 110-1341, or 1342, or a fragment thereof. In the presence of *M. paratuberculosis*, a hybridization complex is produced between *M. paratuberculosis* nucleic acid and the oligonucleotide probe. Hybridization between nucleic acid molecules is discussed in detail in Sambrook et al. (1989, *Molecular Cloning: A Laboratory Manual,* $2^{nd}$ Ed., Cold Spring Harbor Laboratory Press, Cold Spring Harbor, N.Y.; Sections 7.37-7.57, 9.47-9.57, 11.7-11.8, and 11.45-11.57).

For oligonucleotide probes less than about 100 nucleotides, Sambrook et al. discloses suitable Southern blot conditions in Sections 11.45-11.46. The Tm between a sequence that is less than 100 nucleotides in length and a second sequence can be calculated using the formula provided in Section 11.46. Sambrook et al. additionally discloses prehybridization and hybridization conditions for a Southern blot that uses oligonucleotide probes greater than about 100 nucleotides (see Sections 9.47-9.52). Hybridizations with an oligonucleotide greater than 100 nucleotides generally are performed 15-25° C. below the Tm. The Tm between a sequence greater than 100 nucleotides in length and a second sequence can be calculated using the formula provided in Sections 9.50-9.51 of Sambrook et al. Additionally, Sambrook et al. recommends the conditions indicated in Section 9.54 for washing a Southern blot that has been probed with an oligonucleotide greater than about 100 nucleotides.

The conditions under which membranes containing nucleic acids are prehybridized and hybridized, as well as the conditions under which membranes containing nucleic acids are washed to remove excess and non-specifically bound probe can play a significant role in the stringency of the hybridization. Such hybridizations can be performed, where appropriate, under moderate or high stringency conditions. Such conditions are described, for example, in Sambrook et al. section 11.45-11.46. For example, washing conditions can be made more stringent by decreasing the salt concentration in the wash solutions and/or by increasing the temperature at which the washes are performed. In addition, interpreting the amount of hybridization can be affected, for example, by the specific activity of the labeled oligonucleotide probe, by the number of probe-binding sites on the template nucleic acid to which the probe has hybridized, and by the amount of exposure of an autoradiograph or other detection medium.

It will be readily appreciated by those of ordinary skill in the art that although any number of hybridization and washing conditions can be used to examine hybridization of a probe nucleic acid molecule to immobilized target nucleic acids, it is more important to examine hybridization of a probe to target nucleic acids, for example, from *M. paratuberculosis* and at least one organism other than *M. paratuberculosis*, under identical hybridization, washing, and exposure conditions. Preferably, the target nucleic acids (e.g., nucleic acids from *M. paratuberculosis* and at least one organism other than *M. paratuberculosis*) are on the same membrane. Representative Southern blot conditions are described in Example 3.

A nucleic acid molecule is deemed to hybridize to *M. paratuberculosis* nucleic acids but not to nucleic acids from an organism other than *M. paratuberculosis* if hybridization to nucleic acid from *M. paratuberculosis* is at least 5-fold (e.g., at least 6-fold, 7-fold, 8-fold, 9-fold, 10-fold, 20-fold, 50-fold, or 100-fold) greater than hybridization to nucleic acid from an organism other than *M. paratuberculosis*. The amount of hybridization can be quantitated directly on a membrane or from an autoradiograph using, for example, a PhosphorImager or a Densitometer (Molecular Dynamics, Sunnyvale, Calif.). It can be appreciated that useful primers and probes of the invention include primers and probes that anneal and hybridize, respectively, to nucleic acids of organisms other than *M. paratuberculosis* provided that such nucleic acids are not typically present in the relevant test animals. For example, the fact that a particular primer or probe anneals or hybridizes, respectively, to human nucleic acid does not diminish the value of that primer or probe for detecting the presence or absence of *M. paratuberculosis* in ruminants, since ruminants typically are not contaminated with human nucleic acid.

In addition, anti-*M. paratuberculosis*-specific antibodies provided by the invention can be used as agents to detect the presence or absence of *M. paratuberculosis*-specific polypeptides in a biological sample. The presence of *M. paratuberculosis*-specific polypeptides is an indication of the presence of *M. paratuberculosis* in the sample. Techniques for detecting *M. paratuberculosis*-specific polypeptides include enzyme linked immunosorbent assays (ELISAs), Western blots, immunoprecipitations and immunofluorescence. An antibody of the invention can be polyclonal or monoclonal, and usually is detectably labeled. An antibody having specific binding affinity for a *M. paratuberculosis*-specific polypeptide can be generated using methods described herein. The antibody can be attached to a solid support such as a microtiter plate using methods known in the art (see, for example, Leahy et al., 1992, *BioTechniques*, 13:738-743). In the presence of *M. paratuberculosis*, an antibody-polypeptide complex is formed.

In addition, *M. paratuberculosis*-specific polypeptides of the invention can be used as an agent to detect the presence or absence of anti-*M. paratuberculosis*-specific antibodies in a biological sample. The presence of anti-*M. paratuberculosis*-specific antibodies in a sample indicates that the animal from which the sample was obtained mounted an immune response toward *M. paratuberculosis*. Given the etiology of *M. paratuberculosis* in its host animals, an animal that has detectable levels of anti-*M. paratuberculosis*-specific antibodies is likely infected with *M. paratuberculosis*. Alternatively, an animal that is positive for anti-*M. paratuberculosis*-specific antibodies may have resisted infection following a previous exposure to *M. paratuberculosis*, or may possess maternally-transmitted anti-*M. paratuberculosis*-specific antibodies. Techniques for detecting anti-*M. paratuberculosis*-specific antibodies in a biological sample include ELISAs, Western blots, immunoprecipitations, and immunofluorescence. A *M. paratuberculosis*-specific polypeptide can be attached to a solid support such as a microtiter plate by known methods (Leahy et al., supra). In the presence of *M. paratuberculosis*, a polypeptide-antibody complex is formed.

Detection of an amplification product, a hybridization complex, an antibody-polypeptide complex, or a polypeptide-antibody complex is usually accomplished by detectably labeling the respective agent. The term "labeled" with regard to an agent (e.g., an oligonucleotide, a polypeptide, or an antibody) is intended to encompass direct labeling of the agent by coupling (i.e., physically linking) a detectable substance to the agent, as well as indirect labeling of the agent by reactivity with another reagent that is directly labeled with a detectable substance. Detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H. Examples of indirect labeling include using a fluorescently labeled secondary antibody to detect an appropriate agent (e.g., a primary antibody), or end-labeling an agent with biotin such that it can be detected with fluorescently labeled streptavidin.

In another embodiment, the methods further involve obtaining a biological sample from an animal known to be infected with *M. paratuberculosis* (positive control) and a non-infected (negative control) animal, contacting the control samples with an agent capable of detecting *M. paratuberculosis*-specific nucleic acids or polypeptides, or anti-*M. paratuberculosis*-specific antibodies, such that the presence or absence of *M. paratuberculosis*-specific nucleic acids or polypeptides, or anti-*M. paratuberculosis*-specific antibodies in the samples is determined. The presence or absence of *M. paratuberculosis*-specific nucleic acids or polypeptides, or anti-*M. paratuberculosis*-specific antibodies in the control samples should correlate with the presence and absence of *M. paratuberculosis* in the positive and negative control samples, respectively.

Methods of Preventing a *M. paratuberculosis* Infection

In one aspect, the invention provides methods for preventing a disease or condition associated with infection by *M.*

*paratuberculosis* (e.g., Johne's disease) in an animal by administering a compound to the animal that immunizes the animal against *M. paratuberculosis* infection. Animals at risk for *M. paratuberculosis* infection can be administered the compound prior to the manifestation of symptoms that are characteristic of a *M. paratuberculosis* infection, such that a *M. paratuberculosis* infection is prevented or delayed in its progression.

In one embodiment, a compound that immunizes an animal can be a *M. paratuberculosis*-specific polypeptide. The sequences of representative *M. paratuberculosis*-specific polypeptides are disclosed herein (e.g., SEQ ID NOs:24-45) and can be produced using methods described herein. An *M. paratuberculosis*-specific polypeptide can be a fusion polypeptide, for example a *M. paratuberculosis*-specific polypeptide-immunoglobulin fusion polypeptide in which all or part of a *M. paratuberculosis*-specific polypeptide is fused to sequences derived from a member of the immunoglobulin family. An *M. paratuberculosis*-specific polypeptide or fusion polypeptide of the invention can be used as an immunogen to elicit anti-*M. paratuberculosis*-specific antibodies in an animal, thereby immunizing the animal.

In another embodiment, a compound that immunizes an animal can be a *M. paratuberculosis*-specific nucleic acid molecule. A *M. paratuberculosis*-specific nucleic acid molecule used to immunize an animal can include one of the *M. paratuberculosis*-specific nucleic acid molecules having the sequence shown in SEQ ID NOs:1-23, 110-1341, or 1342. *M. paratuberculosis*-specific nucleic acid coding sequences (e.g., full-length or otherwise) can be introduced into an appropriate expression vector such that a *M. paratuberculosis*-specific polypeptide or fusion polypeptide is produced in the animal upon appropriate expression of the expression vector. Expression of the *M. paratuberculosis*-specific nucleic acid molecule and production of a *M. paratuberculosis*-specific polypeptide in an animal thereby elicits an immune response in the animal and thereby immunizes the animal.

Compounds that can be used in immunogenic compositions of the invention (e.g., *M. paratuberculosis*-specific nucleic acid molecules or *M. paratuberculosis*-specific polypeptides) can be incorporated into pharmaceutical compositions suitable for administration. Such compositions typically comprise the nucleic acid molecule or polypeptide, and a pharmaceutically acceptable carrier. As used herein, "pharmaceutically acceptable carrier" is intended to include any and all solvents, dispersion media, coatings, antibacterial and anti-fungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition of the invention is formulated to be compatible with its intended route of administration. Examples of routes of administration include parenteral, e.g., intravenous, intradermal, subcutaneous, oral (e.g., ingestion or inhalation), transdermal (topical), transmucosal, and rectal administration. Solutions or suspensions used for parenteral, intradermal, or subcutaneous application can include the following components: a sterile diluent such as water for injection, saline solution (e.g., phosphate buffered saline (PBS)), fixed oils, a polyol (for example, glycerol, propylene glycol, and liquid polyetheylene glycol, and the like), glycerine, or other synthetic solvents; antibacterial and antifungal agents such as parabens, chlorobutanol, phenol, ascorbic acid, thimerosal, and the like; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol or sorbitol, and sodium chloride in the composition. Prolonged administration of the injectable compositions can be brought about by including an agent that delays absorption. Such agents include, for example, aluminum monostearate and gelatin. The parenteral preparation can be enclosed in ampoules, disposable syringes or multiple dose vials made of glass or plastic.

Oral compositions generally include an inert diluent or an edible carrier. Oral compositions can be liquid, or can be enclosed in gelatin capsules or compressed into tablets. Pharmaceutically compatible binding agents, and/or adjuvant materials can be included as part of an oral composition. Tablets, pills, capsules, troches and the like can contain any of the following ingredients, or compounds of a similar nature: a binder such as microcrystalline cellulose, gum tragacanth or gelatin; an excipient such as starch or lactose; a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring. Transmucosal administration can be accomplished through the use of nasal sprays or suppositories. For transdermal administration, the active compounds are formulated into ointments, salves, gels, or creams as generally known in the art.

It is especially advantageous to formulate oral or parenteral compositions in dosage unit form for ease of administration and uniformity of dosage. Dosage unit form as used herein refers to physically discrete units suited as unitary dosages for an animal to be treated; each unit containing a predetermined quantity of active compound calculated to produce the desired therapeutic effect in association with the required pharmaceutical carrier. The dosage unit forms of the invention are dependent upon the amount of a compound necessary to immunize the animal. The amount of a compound necessary to immunize an animal can be formulated in a single dose, or can be formulated in multiple dosage units. Immunization of an animal may require a one-time dose, or may require repeated doses.

For polypeptide vaccines, the dose typically is from about 0.1 mg/kg to about 100 mg/kg of body weight (generally, about 0.5 mg/kg to about 5 mg/kg). Modifications such as lipidation (Cruikshank et al., 1997, *J. Acquired Immune Deficiency Syndromes and Human Retrovirology*, 14:193) can be used to stabilize polypeptides and to enhance uptake and tissue penetration. For nucleic acid vaccines, the dose administered will depend on the level of expression of the expression vector. Preferably, the amount of vector that produces an amount of a *M. paratuberculosis*-specific polypeptide from about 0.1 mg/kg to about 100 mg/kg of body weight is administered to an animal.

Articles of Manufacture

The invention encompasses articles of manufacture (e.g., kits) for detecting the presence of *M. paratuberculosis*-specific nucleic acids or polypeptides, or anti-*M. paratuberculo*- sis-specific antibodies in a biological sample (a test sample). Such kits can be used to determine if an animal has been exposed to, or is infected with, *M. paratuberculosis*. For example, a kit of the invention can include an agent capable of detecting *M. paratuberculosis*-specific nucleic acids or polypeptides, or anti-*M. paratuberculosis*-specific antibodies in a biological sample (e.g., a *M. paratuberculosis*-specific oligonucleotide, an anti-*M. paratuberculosis*-specific antibody, or a *M. paratuberculosis*-specific polypeptide, respectively).

For antibody-based kits to detect *M. paratuberculosis*-specific polypeptides, the kit can include, for example, a first antibody (e.g., attached to a solid support) that has specific binding affinity for a *M. paratuberculosis*-specific polypeptide and, optionally, a second antibody which binds to *M. paratuberculosis*-specific polypeptides or to the first antibody and is detectably labeled. For oligonucleotide-based kits to detect *M. paratuberculosis*-specific nucleic acids, the kit may comprise, for example, one or more oligonucleotides. For example, a kit of the invention can include a detectably labeled oligonucleotide probe that hybridizes to a *M. paratuberculosis*-specific nucleic acid molecule or a pair of oligonucleotide primers for amplifying a *M. paratuberculosis*-specific nucleic acid molecule. Such oligonucleotides provided in a kit of the invention can be detectably labeled or, alternatively, the components necessary for detectably labeling an oligonucleotide can be provided in the kit. Polypeptide-based kits for detecting anti-*M. paratuberculosis*-specific antibodies in a biological sample can contain a *M. paratuberculosis*-specific polypeptide as disclosed herein (e.g., attached to a solid support) and, optionally, an antibody which binds to *M. paratuberculosis*-specific polypeptides or to an anti-*M. paratuberculosis*-specific antibody and is detectably labeled.

Kits can include additional reagents (e.g., buffers, co-factors, or enzymes) as well as reagents for detecting the agent (e.g., labels or other detection molecules), as well as instructions for using such agents and reagents to detect the presence or absence of *M. paratuberculosis*-specific nucleic acids or polypeptides, or anti-*M. paratuberculosis*-specific antibodies. The kit can also contain a control sample or a series of control samples that can be assayed and compared to the biological sample. Each component of the kit is usually enclosed within an individual container and all of the various containers are within a single package.

The invention also encompasses articles of manufacture (e.g., vaccines) for preventing *M. paratuberculosis* infection in an animal. Articles of manufacture of the invention can include pharmaceutical compositions containing either a *M. paratuberculosis*-specific nucleic acid molecule or a *M. paratuberculosis*-specific polypeptide. Such nucleic acid molecules or polypeptides are formulated for administration as described herein, and are packaged appropriately for the intended route of administration. Pharmaceutical compositions of the invention further can include instructions for administration.

The invention will be further described in the following examples, which do not limit the scope of the invention described in the claims.

EXAMPLES

Example 1

Mycobacterial Strains

Mycobacteria used in this study are listed in Table 3. All mycobacteria were cultured in Middlebrook 7H9 media with 0.05% Tween 80 and oleic acid albumin dextrose complex (Becton Dickinson Microbiology, Sparks, Md.). Cultures containing *M. paratuberculosis* isolates were supplemented with 2 mg/L ferric mycobactin J (Allied Monitor Inc., Fayette, Mo.). All growth flasks were incubated at 37° C. without shaking.

TABLE 3

Mycobacterial strains used

| Isolate[a] | Source[b] | Origin | Additional Information |
|---|---|---|---|
| *M. avium* subsp. *paratuberculosis* | | | |
| ATCC 19698 | ATCC | Bovine | Isolated from ileum in 1974; type strain |
| 1434 | NADC | Ovine | |
| 1045 | NADC | Bovine | Isolated from a Holstein lymph node in 1984 |
| 1112 | NADC | Bovine | Isolated from an Angus lymph node in 1984 |
| 1018 | NADC | Bovine | Isolated from a Holstein lymph node in 1983 |
| KAY | NADC | Bovine | Isolated from a Holstein ileum in 1993 |
| K-10 | NADC | Bovine | Isolated from a Wisconsin dairy herd in 1990 |
| 1010 | NADC | Bovine | |
| 1113 | NADC | Bovine | |
| *M. avium* subsp. avium | | | |
| 236 | NADC | Bovine | |
| WP21 CP (Sep. 5, 2001) | NADC | Avian | Mycobactin J independent, isolated from a wood pigeon |
| 6004 CP (Oct. 16, 2001) | NADC | Chicken | ATCC 35719; TMC 801 |
| 1015 | UMN | Deer | |
| 1161 | UMN | Avian | |
| 1282 | UMN | Human | |
| 1285 | UMN | Human | |
| *M. phlei* | NADC | | |
| *M. smegmatis* | NADC | | |
| *M. intracellulare* | NADC | Porcine | TMC 1472, 35773; *M. avium-M. intracellulare-M. scrofulaceum* complex 6 |
| *M. fortuitum* | NADC | | |

TABLE 3-continued Mycobacterial strains used

| Isolate[a] | Source[b] | Origin | Additional Information |
|---|---|---|---|
| M. bovis | | | |
| BCG Pasteur (Aug. 11, 2001) | ATCC | | ATCC 35734; TMC 1011 |
| 95 1398 (1998-1999) | NADC | Deer | Isolated from a Colorado feedlot |
| M. tuberculosis TB 14323 | | Human | |

[a]Dates of isolation (month/day/year) are in parentheses;
[b]ATCC, American Type Culture Collection; NADC, National Animal Disease Center: UMN, University of Minnesota Example 2

Annotation of M. paratuberculosis Contigs Greater than 10 kb

The sequencing and assembly strategies used herein for M. paratuberculosis were as described for Pasteurella multocida (see May et al., 2001, *Proc. Natl. Acad. Sci. USA*, 98:3460-5). For these studies, assembled *M. paratuberculosis* contig fragments greater than 10 kb were chosen. Predicted coding sequences were identified using ARTEMIS software and TB-parse, a program used to identify coding sequences in the *M. tuberculosis* genome (Cole et al., 1998, *Nature*, 393:537-44). The results were compared and verified manually in ARTEMIS. A putative ribosome-binding site (RBS) was also evaluated for each coding sequence. The presence of an AG-rich sequence approximately 30-bp upstream of the start codon was scored as a putative RBS sequence. Similarities were identified with BLASTP analysis by using GenBank and a local database constructed by the Computational Biology Center at the University of Minnesota (cbc.umn.edu on the World Wide Web).

ARTEMIS and ACT are funded by the Wellcome Trust's Beowulf Genomics initiative and are available free on the internet at sanger.ac.uk/Software/. Sequence alignments between *M. paratuberculosis* and *M. avium* were compared and visualized with ACT software. *M. avium* is being sequenced by The Institute for Genomic Research (TIGR; at tigr.org/cgi-bin/BlastSearch/blast.cgi?organism=m_avium on the World Wide Web). Sequence alignments to produce figures or schematic illustrations were performed with AssemblyLIGN™ software (Accelrys, Princeton, N.J.).

The nucleotide sequence of each *M. paratuberculosis* gene described in this study was deposited individually in the GenBank/EMBL Nucleotide Sequence Data Library and were assigned GenBank Accession Nos. AF445420 through AF445446.

Example 3

DNA Hybridizations

Genomic DNA was extracted from several species of mycobacteria using a modified method from that described by Whipple et al. (Whipple et al., 1987, *J. Clin. Microbial.*, 25:1511-15). Briefly, one liter of Middlebrook 7H9 cultured mycobacteria was incubated at 37° C. until an $OD_{540}$ of between 0.50 and 0.56 was reached. D-Cycloserine was added to the media at a final concentration of 0.5 mg/ml and incubated an additional 24 h. Mycobacteria were harvested by centrifugation at 8,000 rpm for 15 min and the pellet was resuspended in 11 ml of Qiagen buffer B1 containing 1 mg/ml Qiagen RNase A. Lipase was added (450,000 Units, Sigma Catalog No L4384) to digest mycobacterial cell wall lipids. Following incubation for 2 h at 37° C., 20 mg of lysozyme was added and incubation proceeded for an additional 3 h at 37° C. 500 μl of Qiagen proteinase K (20 mg/ml) was added and incubated for 1.5 h at 37° C. Qiagen buffer B2 (4 ml) was added and the slurry mixed and incubated 16 h at 50° C. The remaining cellular debris was removed by centrifugation at 10,000 rpm for 20 min. The supernatant was poured over a pre-equilibrated Qiagen 500/G genomic tip. The loaded column was washed and processed according to the instructions of the manufacturer. PstI restricted DNA fragments were separated on a 1% agarose gel. DNA-containing gels were depurinated, denatured, and neutralized as described by Sambrook et al. (1989, *Molecular Cloning: A Laboratory Manual*, Second Ed., Cold Spring Harbor Laboratory Press, Cold Spring Harbor, N.Y.). DNA was transferred by capillary action to BrightStar-Plus membranes (Ambion, Austin, Tex.) and probes were labeled using [$\alpha$-$^{32}$P]dCTP (ICN, Cost Mesa, Calif.) by random priming. Hybridization was performed in a AUTOBLOT hybridization oven (Bellco Biotechnology, Vineland, N.J.) at 45° C. for 16 h in ExpressHyb hybridization solution (Clontech, Palo Alto, Calif.). Probed blots were washed sequentially with solutions increasing in stringency as follows: 2 washes at room temp in 2×SSC, 0.1% SDS; 2 washes at room temp in 0.2×SSC, 0.1% SDS; and 2 washes at room temp in 0.16×SSC, 0.1% SDS. Detection was by autoradiography at room temp using BioMax MR film (Kodak, Rochester, N.Y.) with a Kodak intensifying screen for less than 16 hours.

Example 4

PCR Amplification

Oligonucleotide primers listed in Table 4 were designed using the *M. paratuberculosis*-specific nucleic acid sequences identified herein. PCR amplification of *M. paratuberculosis*-specific nucleic acid molecules was performed as follows. A PCR master mix was generated that contained (each in final concentration) 1× AmpliTaq Gold buffer (Perkin-Elmer), 5% dimethylsufoxide (DMSO, Sigma), 20 mM each nucleotide (Roche Biochemicals), 10 ng genomic DNA, and 1 Unit of AmpliTaq Gold DNA polymerase (Perkin-Elmer). Primers were added to individual PCR tubes containing 25 μl of master mix. The PCR reaction conditions were as follows: a 5 min denaturing step at 94° C., followed by 35 cycles of: 94° C. for 45 sec, 55° C. for 1 min, and 72° C. for 2 min. At the end of 35 cycles, there was a 7 min incubation at 72° C. and a hold at 4° C. High fidelity Pwo polymerase (Boehringer Ingelheim Pharmaceutical Inc., Ridgefield, Conn.) was used in amplifications to generate probes used in Southern hybridization experiments. All other amplifications used Taq DNA polymerase (Roche Molecular Biochemicals, Indianapolis, Ind.).

TABLE 4

PCR primers used

| Gene | Primer 1 | SEQ ID NO: | Primer 2 | SEQ ID NO: |
|---|---|---|---|---|
| 10 | CGGCGGATCAGCATCTAC | 46 | CACCTCATCGTGGCCAGGTT | 47 |
| 11 | ACCGAACACGAGTGGAGCA | 48 | CAGACTCTGACCGACGTCAT | 49 |
| 38 | GCATTTCGGCTCCCACGGTG | 50 | TACGTCGGTTCGGCGCGCAT | 51 |
| 56 | ATGAACACTTCTTCCTCTCTA | 52 | CATATCGCGGTGATCCTGAC | 53 |
| 57 | ATGGCCACCAACGACGACCA | 54 | CGCGGCCGTCGGGCCGGCTG | 55 |
| 135 | GCAGGCGTTTGCGTTCTTG | 56 | CGAGGTCCGAAATAGCGTAG | 57 |
| 159 | ATGCGTTTCGCCCTCCCGAC | 58 | TCACGCCTTGATTTCGTCCT | 59 |
| 217 | TGGCCGAACGCGGACTGTTC | 60 | TAGGAATCCGCGTCGACGAT | 61 |
| 218 | CAAGGTTCGTGACGGTATCG | 62 | TGACCCCAGCAGGTATGGC | 63 |
| 219 | CATCTACTGAGCGCCGTTTG | 64 | CACGCCGCCACCCCGTCCCG | 65 |
| 228 | GCAAGGTGGGCTTTGAAG | 66 | TGCGTGGGAGGATAAGGC | 67 |
| 240 | TTGGCACTGGCGTTTATG | 68 | ACATCGGGAACACAGGTCTC | 69 |
| 241 | ATCCTCCGGTTTGGCGGGAA | 70 | ACAGAGGTCGATCGGGTCG | 71 |
| 250 | CAGTCGGCCGGCGAAACGCC | 72 | CGCGGCGAAATCGAACGC | 73 |
| 251 | CACGTGCTGTCCCCATCGGC | 74 | CTACGTCTTCGTGACCAAAG | 75 |
| 252 | TGACCACCGACAACCCCACG | 76 | CATGAGGGCTGTCCCTCTCC | 77 |
| 253 | TTGACCGCGTTGACGGCGTT | 78 | CAGCGGTCCGCGCTCTTCGC | 79 |
| 254 | TGGGCAGCCCGGTGTCCCG | 80 | CACGCGCTCCTTTCAGCCTT | 81 |
| 255 | CAGTCACCCCGCGGCCGGTA | 82 | TCTACTGACCCGCAGATCGAA | 83 |
| 256 | TGGCCGTCAAGGACCAGAAC | 84 | CATGACCCTGCCGGCGTCCC | 85 |
| 257 | TGGCATTGGATCGCGTCGGA | 86 | TCAAACCCGGCGAGTTCTTC | 87 |

Primers are shown in the 5' to 3' direction

Primers used to amplify the #7 sequence for a probe in Southern hybridizations were 5'-ATC AGG CTG ACG GGA TTG CCC-3'   (SEQ ID NO: 88)
and
5'-TCA ACG AGT GCA CGG GAA CC-3'.   (SEQ ID NO: 89)

Example 5

Twenty-Seven M. paratuberculosis Predicted Coding Sequences are not Present in M. avium The complete genome of M. paratuberculosis K-10, a field isolate recovered from a cow with clinical Johne's disease, is currently being sequenced (cbc.umn.edu/ResearchProjects/AGAC/Mptb/Mptbhome.html on the World Wide Web). The genome size is estimated to be >5 Mb based on assembled sequence data, and by July, 2001, 2.65 Mb were contained in contig fragments greater than 10 kb. Those Contigs above 10 kb were annotated using ARTEMIS and represent 48% of the total genome. The average size of the annotated contigs is 25 kb with one contig over 70 kb. Each gene within the annotated contig set was also checked manually and confirmed by TB-parse. These contigs were aligned with M. avium sequence data generated at TIGR. TIGR has 612 contigs that total 5,867,714 bp in the Jul. 8, 2001 data set.

M. avium and M. paratuberculosis display a high degree of similarity at the nucleotide level as well as local gene order conservation. An analysis of an 11-kb region surrounding the origin of replication for each of these genomes shows 98% sequence identity at the nucleotide level. The sequence similarity between orthologs in M. paratuberculosis and M. avium was greater than between M. paratuberculosis and other mycobacterial species. A more global comparison shows that these strong nucleotide identities are present throughout both genomes. Despite this strong genetic similarity, a total of 27 genes from the annotated M. paratuberculosis contigs were identified that did not align with the unfinished M. avium genome by computerized alignments. Of these, three contained weak similarity to proteins in other mycobacterial species or proteins in GenBank. This left 24 genes that have no significant similarity to any known proteins. Since only about half of the *M. paratuberculosis* genome was used in these analyses, a complete genome analysis may reveal an estimated 50 unique *M. paratuberculosis* genes.

Some *M. paratuberculosis* sequences that did not align with *M. avium* sequences, either in silico or experimentally, contain similarity to other mycobacterial species. One such sequence, designated #7, was tested by PCR and Southern hybridization with two *M. avium* isolates and two *M. paratuberculosis* strains. An amplified PCR fragment was produced only with *M. paratuberculosis* genomic DNA as template. Likewise, DNA hybridization on Southern blots detected only *M. paratuberculosis* sequences, not *M. avium*. However, BLASTP analysis of the #7 sequence revealed strong similarity to hypothetical proteins in the *M. tuberculosis* genome.

Example 6

PCR Analysis

PCR amplification was performed on several mycobacterial species, strains and isolates to experimentally determine the specificity for 26 of the 27 sequences (Table 5). Gene 128 was not included in these analyses because it had the lowest expect value (highest similarity to a sequence in GenBank) of the 27 sequences by BLASTP analysis. These data show that primers designed from all 26 *M. paratuberculosis*-specific genes from isolate K-10 could produce an amplified product in all 10 *M. paratuberculosis* strains or isolates tested. In addition, despite an absence of any homologous sequences in public databases, PCR products of the correct size were obtained for five genes using template from other mycobacterial species. Following this analysis a core group of 21 genes remained that are present only in *M. paratuberculosis* (Table 5).

Example 7

Sequence Analysis of an *M. paratuberculosis*-Specific Eight Gene Cluster

Eight genes were present on contig fragment 1614. These eight genes are arranged in tandem, span a total of 4.4 kb at the end of the 1614 contig (FIG. 1), and are present only in *M. paratuberculosis* (Table 5). 1408-bp upstream of gene 250 is an integrase gene that contains similarity to other mycobacteriophage integrases. This 4.4-kb segment (designated #481 (SEQ ID NO:23)) contains genes 250-257 and is located at the end of the 46-kb contig 1614. The sequences represented by #481 were found to align with the 94-kb contig 1398 present in a different contig assembly data set (FIG. 1). The #481 sequence aligned near the center of the 94-kb contig, essentially at position 35 to 45 kb. A trimmed portion of the 1398 contig is shown in the alignment in FIG. 1. The results of this analysis further extended the region of *M. paratuberculosis*-specific nucleic acid sequence to a 9.4-kb region, which does not align with *M. avium* sequence in silico.

TABLE 5

PCR analysis of *M. paratuberculosis* predicted coding sequences

| Strain | Gene Number | | | | | | | | | | | | | | |
|---|---|---|---|---|---|---|---|---|---|---|---|---|---|---|---|
| | 56 | 57 | 159 | 217 | 218 | 228 | 240 | 250 | 251 | 252 | 253 | 254 | 255 | 256 | 257 |
| *M. paratuberculosis* | | | | | | | | | | | | | | | |
| ATCC19698 | + | + | + | + | + | + | + | + | + | + | + | + | + | + | + |
| 1434 | + | + | + | + | + | + | + | + | + | + | + | + | + | + | + |
| 1045 | + | + | + | + | + | + | + | + | + | + | + | + | + | + | + |
| 1112 | + | + | + | + | + | + | + | + | + | + | + | + | + | + | + |
| 1018 | + | + | + | + | + | + | + | + | + | + | + | + | + | + | + |
| Kay | + | + | + | + | + | + | + | + | + | + | + | + | + | + | + |
| K-10 | + | + | + | + | + | + | + | + | + | + | + | + | + | + | + |
| 1010 | + | + | + | + | + | + | + | + | + | + | + | + | + | + | + |
| 1113 | + | + | + | + | + | + | + | + | + | + | + | + | + | + | + |
| *M. avium* | | | | | | | | | | | | | | | |
| #236 | − | − | − | − | − | − | − | − | − | − | − | − | − | − | − |
| WP21 | − | − | − | − | − | − | − | − | − | − | − | − | − | − | − |
| TMC801 | − | − | − | − | − | − | − | − | − | − | − | − | − | − | − |
| 1015 | − | − | − | − | − | − | − | − | − | − | − | − | − | − | − |
| 1161 | − | − | − | − | − | − | − | − | − | − | − | − | − | − | − |
| 1282 | − | − | − | − | − | − | − | − | − | − | − | − | − | − | − |
| 1285 | − | − | − | − | − | − | − | − | − | − | − | − | − | − | − |
| *M. phlei* | − | − | − | − | − | − | − | − | − | − | − | − | − | − | − |
| *M. smegmatis* | − | − | − | − | − | − | − | − | − | − | − | − | − | − | − |
| *M. intracellulare* | − | − | − | − | − | − | − | − | − | − | − | − | − | − | − |
| *M. fortuitum* | − | − | − | − | − | − | − | − | − | − | − | − | − | − | − |
| *M. bovis* BCG | − | − | − | − | − | − | − | − | − | − | − | − | − | − | − |
| *M. bovis* 95-1398 | − | − | − | − | − | − | − | − | − | − | − | − | − | − | − |
| *M. tuberculosis* | − | − | − | − | − | − | − | − | − | − | − | − | − | − | − |

| Strain | Gene Number | | | | | | | | | | |
|---|---|---|---|---|---|---|---|---|---|---|---|
| | 10 | 11 | 38 | 48 | 49 | 50 | 93 | 134 | 135 | 219 | 241 |
| *M. paratuberculosis* | | | | | | | | | | | |
| ATCC19698 | + | + | + | + | + | + | + | + | + | + | + |
| 1434 | + | + | + | + | + | + | + | + | + | + | + |
| 1045 | + | + | + | + | + | + | + | + | + | + | + |

TABLE 5-continued

PCR analysis of M. paratuberculosis predicted coding sequences

| | | | | | | | | | | | |
|---|---|---|---|---|---|---|---|---|---|---|---|
| 1112 | + | + | + | + | + | + | + | + | + | + | + |
| 1018 | + | + | + | + | + | + | + | + | + | + | + |
| Kay | + | + | + | + | + | + | + | + | + | + | + |
| K-10 | + | + | + | + | + | + | + | + | + | + | + |
| 1010 | + | + | + | + | + | + | + | + | + | + | + |
| 1113 | + | + | + | + | + | + | + | + | + | + | + |
| *M. avium* | | | | | | | | | | | |
| #236 | − | − | − | − | − | − | + | + | − | − | − |
| WP21 | − | − | − | + | + | + | + | + | − | − | − |
| TMC801 | − | − | − | + | + | + | + | + | − | − | − |
| 1015 | − | − | − | + | + | + | + | + | − | − | − |
| 1161 | − | − | − | + | + | + | + | + | − | − | − |
| 1282 | − | − | − | − | − | − | + | + | − | − | − |
| 1285 | − | − | − | − | − | − | + | + | − | − | − |
| *M. phlei* | − | − | − | − | − | − | − | + | − | − | − |
| *M. smegmatis* | − | − | − | − | − | − | − | − | − | − | − |
| *M. intracellulare* | − | − | − | + | + | + | + | − | − | − | − |
| *M. fortuitum* | − | − | − | − | − | − | − | − | − | − | − |
| *M. bovis* BCG | − | − | − | − | + | − | − | − | − | − | − |
| *M. bovis* 95-1398 | − | − | − | − | + | − | − | − | − | − | − |
| *M. tuberculosis* | − | − | − | − | + | − | − | − | − | − | − |

"+" indicates that an amplification product of the correct size was detected by ethidium bromide staining.
"−" indicates that no amplification product was detected by ethidium bromide staining.

A TBLASTX analysis was performed on the 9.4-kb sequence (designated contig 1398-trimmed in FIG. 1). The results of these analyses revealed that, while no sequences aligned with *M. avium*, the ends of contig 1398-trimmed align with sequences in *M. tuberculosis*. This leaves a core sequence of eight ORFs within the #481 sequence that are present only in *M. paratuberculosis*. This core sequence is flanked by 1408 bp of non-coding sequence downstream and 1092-bp of non-coding sequence upstream (FIG. 1). Therefore, this novel core sequence is well separated from other predicted open reading frames.

Example 8

Southern Hybridization Analysis Shows that the #481 Sequence is Specific to *M. paratuberculosis*

To confirm experimentally that #481 is present only in *M. paratuberculosis*, three arbitrarily chosen genes of the #481 sequence (251, 253, and 255) were radiolabeled and used as probes in DNA hybridization with several mycobacterial species including *M. fortuitum, M. bovis, M. intracellulare, M. avium*, and *M. paratuberculosis*. Following Southern blotting, only a *M. paratuberculosis* fragment greater than 9.5 kb was detected by each of the three probes.

Example 9

Characteristics of *M. paratuberculosis*-Specific Polypeptides

The characteristics of *M. paratuberculosis*-specific polypeptides shown in Table 6 were obtained using MacVector sequence analysis software (Oxford Molecular).

TABLE 6

Characteristics of *M. paratuberculosis*-specific polypeptides

| Gene | pI | MW (Da) |
|---|---|---|
| 10 | 5.29 | 36,380 |
| 11 | 5.12 | 21,826 |
| 38 | 9.51 | 18,730 |
| 56 | 9.32 | 21,116 |
| 57 | 3.90 | 10,417 |
| 128 | 9.96 | 20,772 |
| 135 | 11.58 | 17,018 |
| 159 | 11.47 | 20,655 |
| 217 | 10.49 | 11,567 |
| 218 | 11.05 | 91,530 |
| 219 | 12.05 | 10,004 |
| 228 | 12.30 | 40,817 |
| 240 | 9.14 | 24,949 |
| 241 | 9.17 | 13,509 |
| 250 | 4.40 | 21,434 |
| 251 | 5.54 | 19,500 |
| 252 | 3.87 | 9,687 |
| 253 | 11.50 | 7,881 |
| 254 | 8.38 | 16,262 |
| 255 | 7.36 | 25,851 |
| 256 | 7.17 | 15,120 |
| 257 | 5.48 | 9,358 |

Example 10

Expression of *M. paratuberculosis* Genes in *E. coli*

To confirm coding predictions of novel *M. paratuberculosis* genes and assess their immunogenicity, coding sequences were amplified from the genome by PCR and cloned into the pMAL-c2 *E. coli* expression plasmid. These proteins were expressed as a fusion with *E. coli* maltose binding protein (MBP) to enable affinity purification on an amylase resin column. An immunoblot was probed with a monoclonal antibody that binds MBP, which identified each fusion protein. A duplicate immunoblot was probed with polyclonal sera from a rabbit immunized with heat-killed preparation of *M. paratuberculosis*. Only the fusion protein containing the *M. paratu*-

*berculosis* specific polypeptide produced from gene 253 was detected by the rabbit sera, indicating that the polypeptide encoded by gene 253 was produced by *M. paratuberculosis*. The MBP protein was not detected by the polyclonal sera.

Example 11

The psp-1 Gene Product is Recognized by Sera from Cattle with Johne's Disease

The polypeptide produced from gene 253 was termed psp-1 (*paratuberculosis*-specific protein). To determine if psp-1 is recognized during infection of cattle, the purified MBP/psp-1 fusion was evaluated further by immunoblot with sera from cattle with overt signs of Johne's disease. Sera from all three Johne's cows examined recognized the MBP/psp-1 fusion protein but did not recognize MBP alone. Another *M. paratuberculosis*-MBP fusion protein using gene 251 was also evaluated in this experiment, but the fusion protein produced therefrom was only weakly detected.

Immunoblot analysis of psp-1 was further expanded to include additional sera from Johne's cattles as well as control cattle housed at NADC and a local Iowa diary herd. The polypeptide designated psp-1 was not detected by sera from 7 control cows, but was detected by 14 of 16 Johne's cows tested.

Example 12

Expression of *M. paratuberculosis* Coding Sequences

Coding sequences within *M. paratuberculosis*-specific DNA fragments are cloned into *E. coli* expression vectors (e.g., containing a sequence encoding a 6×His tag). Heterologously expressed mycobacterial proteins are affinity purified from *E. coli* lysates by a polyhistidine tag. These purified proteins are then evaluated serologically with a panel of sera from infected and control cows to determine if the protein is recognized by sera from infected animals.

Specifically, each open reading frame identified as unique to *M. paratuberculosis* is amplified from genomic DNA, cloned into the pCRT7 expression vector (Invitrogen), and transformed into *E. coli* DH5-α. Each of the constructs are verified by DNA sequence analysis. The level of expression of the gene of interest is evaluated by loading the recombinant *E. coli* lysates onto SDS-PAGE gels and staining them in Coomassie blue. Expressed proteins are purified from *E. coli* lysates using the vector-encoded polyhistidine tag that has affinity for metal ions. Column purification using TALON metal resin (Clontech) is used. The fusion alone is used as a negative control. Comparisons of the reactivity of a collection of cattle antisera with the fusion proteins are conducted using a slot-blotting device (BioRad). Lysates of recombinant *E. coli* are loaded onto preparative 12% (w/v) polyacrylamide gels and transferred to nitrocellulose. After blocking, these filters are placed into the slot-blot device. Individual cattle antisera, each diluted 1:200, is added to independent slots. The rest of the procedure is carried out using standard immunoblot protocols. Protein G-peroxidase diluted 1:25,000 or anti-bovine IgG-peroxidase diluted 1:20,000 are used for detection of bound antibody.

Example 13

Production of Monoclonal and Polyclonal Antibodies Against *M. paratuberculosis*-Specific Polypeptides All expressed and purified *M. paratuberculosis*-specific polypeptides are used to immunize both BALB/c mice and New Zealand white rabbits. Standard immunization regimens are used in each instance. TiterMax or Freund's incomplete serve as the adjuvant. Splenic lymphocytes from the immunized mice are hybridized with myeloma cells for the production of monoclonal antibodies. ELISA is the method used to assay secreting hybridomas for reactivity to purified antigens. Hybridomas in positive wells are cloned and expanded using standard methods. Rabbit antisera is collected following boost injections of isolated polypeptide until a sufficient titer is obtained.

Example 14

ELISA Assays

Improvement in the specificity of the ELISA test for detection of animals with Johne's disease has always been a major goal. The only test commercially available in the US is a direct test that uses a protoplasmic antigen preparation (Dubash et al., 1995, *J. Vet. Diag. Invest.*, 7:347-51; Collins & Sockett, 1993, *J. Am. Vet. Med. Assoc.*, 203:1456-63). Efforts to amplify antigen/antibody reactions focus on the use of an indirect biotin/avidin system. The purified *M. paratuberculosis*-specific polypeptide to be evaluated is diluted in PBS and added to 96-well microtiter plates. Plates with bound polypeptide are blocked in PBS containing 1% gelatin and then washed three times with PBS containing 0.05% Tween. Test cattle sera is diluted 1:400 in PBS, added to individual wells, and processed as a standard ELISA. Mouse anti-bovine IgM or mouse anti-bovine IgG is the second antibody in these assays. Results show that the use of a biotinylated second antibody followed by streptavidin/alkaline phosphatase and enzyme detection enhances test sensitivity 8 to 16-fold (based on antibody titers) as compared to the standard direct ELISA.

The method described herein using a *M. paratuberculosis*-specific polypeptide is compared to the commercially available direct ELISA by determining antibody titers of sera from clinically affected animals. Sera selected for these evaluations will include samples from both clinical and subclinical animals at NADC and from a nearby diary herd (State Center, Iowa) shown to have Johne's disease. For all evaluations, it is necessary to include samples from known negative animals to assess specificity. In addition, because of potential cross-reactivity that may be encountered with other bacteria, especially other mycobacteria, sera from animals known to be naturally or experimentally infected with other mycobacterial, particularly *M. avium*, are included. These controls determine whether the ELISA test detects only *M. paratuberculosis*-infected cattle.

Example 15

Use of Antibodies Against *M. paratuberculosis*-Specific Polypeptides in Immunohistochemical Diagnosis of Infected Bovine Tissues Histopathologic analysis of tissues from infected animals is a rapid method of detecting *M. paratuberculosis*. Biopsy tissue or tissue samples taken at necropsy are stained for acid-fastness to determine the presence of *M. paratuberculosis*. However, this method is non-specific and does not distinguish among mycobacterial species. Therefore, bovine tissues from *M. paratuberculosis*-, *M. bovis*-, *M. avium*-infected and uninfected animals are tested by histopathologic analysis using high-titer antibodies directed at *M. paratuberculosis*-specific polypeptides. Briefly, samples from the ileum and mesenteric lymph node of cows are fixed in buffered formalin, processed routinely, and embedded in paraffin wax. 6 µm cut sections are stained with hematoxylin and eosin or Ziehl-Neelsen by conventional methods. Replicate unstained sections will be prepared for immunohistochemistry. Sections that are immunostained are deparaffinized, rehydrated and blocked using routine methods (Stabel et al., 1996, *J. Vet. Diagn. Invest.*, 8:469-73). Blocked sections are incubated with *M. paratuberculosis*-specific antibodies developed in the above-described studies. Depending on the nature of the primary antibody, either goat anti-rabbit biotinylated antibody or goat anti-mouse biotinylated antibody is added followed by washing instreptavidin-alkaline phosphatase solution. The tissue is stained with chromogen, and Histomark Red. Results are visualized under a bright-field microscope. Staining intensities are quantitatively compared among the different infected and uninfected tissues.

Example 16

Detection of *M. paratuberculosis* by PCR Amplification

Detection of *M. paratuberculosis* using oligonucleotide primers complementary to *M. paratuberculosis*-specific genes 93, 135, 218, 228, 240, and 251 or oligonucleotide primers complementary to IS900 nucleic acid sequences was examined by PCR. IS900 primer sequences were as follows: 5'-AAT CAA CTC CAG CAG CGC GGC CTC G-3' (SEQ ID NO:108) and 5'-CCG CTA ATT GAG AGA TGC GAT TGG-3' (SEQ ID NO:109). Fourteen fecal samples were processed from cattle in various stages of shedding. The bacterial load being shed by each animal was determined by culture on 7H10 slants.

To detect *M. paratuberculosis* by amplification of nucleic acids from a biological sample, a PCR master mix was generated similar to that described in Example 4 with the addition to the master mix of 10 mM MgCl. The PCR reaction conditions for amplification of nucleic acids from a biological sample were as follows: a 10 min denaturing step at 94° C., followed by 50 cycles of: 94° C. for 59 sec, 60° C. for 30 sec, and 72° C. for 1 min. At the end of 50 cycles, there was a 10 min incubation at 72° C. followed by a hold at 4° C.

Results of the PCR assays are as follows. Seven cattle identified as shedding heavily were all positive for *M. paratuberculosis* nucleic acid using either IS900 or MP228 primers. Out of 5 cattle identified as medium shedders, primers directed toward IS900 detected *M. paratuberculosis* nucleic acid in 1 animal, while primers directed toward MP228 detected *M. paratuberculosis*-specific nucleic acid in 2 animals. Out of 2 cattle identified as low shedders, primers directed toward IS900 detected *M. paratuberculosis* nucleic acid in 1 animal, while MP228 primers didn't detect *M. paratuberculosis*-specific nucleic acid in any animal. In titrations of *M. paratuberculosis* genomic DNA (isolate K-10), IS900 nucleic acids were detectable in 1 fg of nucleic acid, while each of the *M. paratuberculosis*-specific nucleic acids were detectable in 10 fg of nucleic acid.

TABLE 7

Primers used in PCR amplifications

| Primer Name | Primer sequence | SEQ ID NO: | Gene |
|---|---|---|---|
| MP93F | 5'-TTGCTGCGGGAAGGTTGCC-3' | 90 | 93 |
| MP93B | 5'-CGAGAACGAGATGTGCGTCAG-3' | 91 | |
| MP135F | 5'-GCAGGCGTTTGCGTTCTTG-3' | 92 | 135 |
| MP135B | 5'-CGAGGTCCGAAATAGCGTAGG-3' | 93 | |
| MP218F | 5'-CCAAGGTTCGTGACGGTATCG-3' | 94 | 218 |
| MP218B | 5'-TGACCCCAGCAGGTATGGC-3' | 95 | |
| MP228F | 5'-GCAAGGTGGGCTTTGAAG-3' | 96 | 228 |
| MP228B | 5'-TGCGTGGGAGGATAAGGC-3' | 97 | |
| MP240F | 5'-TTGGCACTGGCGTTTATG-3' | 98 | 240 |
| MP240B | 5'-ACATCGGGAACACAGGTCTC-3' | 99 | |
| MP251F | 5'-ATGCCTACGGTTCGGTGC-3' | 100 | 251 |
| MP251B | 5'-AAGACAGCGTCAGCCAGC-3' | 101 | |

Example 17

Analysis of the *M. paratuberculosis* Genome

A shotgun strategy was adopted to sequence the genome of *M. paratuberculosis* strain K-10. To create a small (1.5- to 3.0-kb) insert library, genomic DNA was isolated using a chloroform/cetyltrimethylammonium bromide-based method and DNA was sheared by nebulization and cloned into a pUC18 plasmid vector for shotgun sequence analyses essentially as described (May et al., 2001, *Proc. Natl. Acad. Sci., USA*, 98:3460-5). Approximately 24,000 clones were sequenced from both ends using Dye-terminator chemistry on ABI 3700 and 3100 (Applied Biosystems) sequencing machines and a total of 45,653 sequences (representing ~7.8-fold coverage of the genome) were generated in this manner for inclusion in the final sequence assembly. Sequence assembly and verification were accomplished by using the phred-Phrap and Consed suite of software (genome.washington.edu on the internet). In order to close the final ~400 gaps at the end of the shotgun phase, several methods were used, including primer walking and random PCR. The final sequence showed that the *M. paratuberculosis* genome was a single circular chromosome of 4,830,869 bp and an average GC content of 69.3%.

The sequence of the entire *M. paratuberculosis* genome (SEQ ID NO:1355) is shown in Table 8 (contained on the appended compact disc, which has been incorporated by reference herein).

The resulting approximately 24,000 nucleic acid segments were analyzed as follows. Each of the 24,155 segments was compared to the *M. avium* genome using BLASTN (released May 14, 2002). 23,056 segments had homology to *M. avium* sequences, while 1,099 segments had no homology with sequences in the *M. avium* database. Of the 23,056 segments having homology to *M. avium* sequences, 22,558 segments had >50% sequence identity to *M. avium* sequences, while 498 segments possessed <50% sequence identity to *M. avium* sequences. The 498 segments having <50% sequence identity to *M. avium* sequences were then compared to sequences in the GenBank database (having a release date of Dec. 28, 2002) using BLASTN. Of the 498 segments used in the BLASTN comparison, 130 segments were identified as having <50% sequence identity with sequences in the GenBank database, while 277 segments had no sequence identity with sequences in the GenBank database. Those 407 segments (277 segments+130 segments) were considered to be *M. paratuberculosis*-specific nucleic acids. The 1,099 segments that had no homology to *M. avium* sequences were then compared to the GenBank database using the BLASTN. 702 segments had no homology with sequences in GenBank, while 397 segments possessed homology with sequences in the GenBank database. Of those 397 segments, 29 segments exhibited <50% sequence identity with sequences in the GenBank database, while 95 segments exhibited sequence identity with *M. paratuberculosis* sequences that were previously submitted to the GenBank database. Those 825 segments (702 segments+29 segments+95 segments) were also considered to be *M. paratuberculosis*-specific nucleic acids.

The positions of these *M. paratuberculosis*-specific nucleic acids are schematically shown in FIG. 5. The sequences of the resulting 1,232 *M. paratuberculosis*-specific nucleic acids are shown in FIG. 6 (SEQ ID NOs:110-1342). As can be seen from the numerical designations of the 1,232 segments (FIG. 6), many of the 200 nucleotide segments are contiguous. Therefore, any number of contiguous segments can be joined to generate a longer *M. paratuberculosis*-specific nucleic acid.

Potential coding sequences (CDSs) in the genome were predicted by using GLIMMER, and ARTEMIS, and the results were compared and verified manually in ARTEMIS. Homology studies using the predicted polypeptide sequence were completed with BLASTP analysis by using customized sequence databases constructed by the Computational Biology Center at the University of Minnesota (cbc.umn.edu on the World Wide Web). Table 9 (contained on the appended compact disc, which has been incorporated by reference herein) describes the annotation of the *M. paratuberculosis* genomic sequences, and Table 10 (contained on the appended compact disc, which has been incorporated by reference herein) describes the predicted amino acid sequences encoded by each identified coding sequence.

Example 18

DNA Isolation from Bacterial Culture and Fecal Samples

A total of 161 bacterial isolates were used in these studies, including *M. paratuberculosis* (n=118), *M. avium* (n=21), and other mycobacterial and non-mycobacterial species (n=22). See Table 11. *M. paratuberculosis* strain K-10 was used as the standard strain. *M. paratuberculosis* isolates were grown on Middlebrook 7H9 broth or 7H11 agar (Difco Laboratories, Detroit, Mich.) with OADC supplement (Becton Dickinson, Sparks, Md.) and mycobactin J (2 mg/100 ml), and cultures were incubated at 37° C. for 4-6 months until colonies were observed. *M. avium* isolates were grown on Middlebrook 7H9 broth without mycobactin J and cultures were incubated at 37° C. for 2 weeks. Other mycobacterial and non-mycobacterial species were grown on LB medium and incubated overnight at 37° C.

DNA was isolated from bacterial cultures using the QIAamp DNA Mini Kit (QIAGEN Inc., Valencia, Calif.). Briefly, bacteria were pelleted and resuspended in 180 μl Buffer ALT. Proteinase K (20 μl) was added, and the samples were vortexed and incubated at 56° C. for 10 minutes. After addition of 200 μl Buffer AL, the samples were incubated at 70° C. for 10 minutes. Ethanol (200 μl) was added and the samples were vortexed and loaded onto spin columns, which were subjected to centrifugation at 8000 rpm for 1 minute. The columns were washed with 500 μl Buffer AW and the DNA was eluted in 50 μl distilled water.

TABLE 11

| *Mycobacterium* isolates tested | | |
|---|---|---|
| Bacteria | Source | n |
| *M. paratuberculosis* | Human | 3 |
|  | Ovine | 7 |
|  | Bovine | 99 |
|  | Murine | 1 |
|  | Caprine | 6 |
|  | Unknown | 2 |
| *M. avium* |  | 21 |
| *M. intracellulare* |  | 1 |
| *M. scrofulaceum* |  | 1 |
| *M. phlei* |  | 1 |
| *M. smegmatis* |  | 1 |
| *M. sylvaticum* |  | 1 |
| *M. fortuitum* |  | 1 |
| Atypical mycobacteria |  | 4 |
| Uncharacterized non-MAP |  | 9 |
| *Salmonella* spp. |  | 2 |
| *S. aureus* |  | 1 |
|  | Total: | 161 |

The QIAamp DNA Stool Mini Kit (QIAGEN Inc.) was used to isolate DNA from stool samples. Briefly, 1.4 ml Buffer ASL was added to 200 mg of sample (1 gm of sample can be used with 10× Buffer ASL). The mixtures were vortexed, heated at 95° C. for 5 minutes, and pelleted to remove stool particles, and 1.2 ml of each resulting supernatant was transferred to a new 2 ml tube. An InhibitEX tablet was added to each sample, and the tubes were vortexed and then incubated for 1 minute at 25° C. The mixtures were pelleted and 15 μl of Proteinase K was added to 200 μl of each supernatant. Buffer AL (200 μl) was added and the samples were incubated at 70° C. for 10 minutes. After addition of 200 μl ethanol, samples were vortexed and loaded onto spin columns. The columns were subjected to centrifugation at 8000 rpm for 1 minute and then washed two times with 500 μl Buffer AW1 and Buffer AW2. DNA was eluted in 50 μl distilled water.

Example 19

Real-Time PCR

A PCR master mix was prepared containing the following: 1× TaqMan Buffer A (Perkin Elmer), 5.0 mM $MgCl_2$, 1.25 units per reaction Amplitaq Gold, 200 µM dATP, 200 µM dCTP, 200 µM dGTP, 400 µM dUTP, 5% DMSO, 0.01 units per reaction UNG, 100 µM of each primer, and 150 µM of each probe. Five µl of template DNA was placed in each PCR reaction tube, and 45 µl of Master mix was added. PCR samples were subject to initial denaturation at 50° C. for 10 minutes and then at 95° C. for 10 minutes; 40 amplification cycles of 94° C. for 30 seconds, 60° C. for 30 seconds, and 72° C. for 1 minute; a final extension at 72° C. for 7 minutes; and a soak at 25° C. Specific PCR products were detected using the ABI Prism 7700 or 7900HT Sequence Detection System (Applied Biosystems, Inc.). Results were recorded as Delta-RQ, which is the difference in the Rn values from the samples and the no-template control. The Rn values are the ratio of reporter emission to quencher emission. Agarose gel electrophoresis with ethidium bromide staining was performed to verify the results of the TaqMan assay. All assays were performed in duplicate.

To evaluate the sensitivity of the assay, ten-fold dilutions of *M. paratuberculosis* strain K-10 cells were spiked into a negative fecal sample collected from a known *M. paratuberculosis*-free dairy farm. *M. paratuberculosis* DNA amounts ranged from 100 ng to 1 fg, equivalent to 112900 to 0.0011 molecules/reaction. DNA was extracted from the spiked samples using a QIAamp DNA Stool Mini Kit, the sensitivity of the assay for detecting *M. paratuberculosis* in fecal samples was assessed by PCR as described above.

The specificity of the assay was evaluated using template DNA from other mycobacteria (n=48), and non-mycobacterial spp. (n=3). In addition, the TaqMan assay was compared to conventional PCR, which was performed using primer sequences complimentary to SR134 (see Table 12).

TABLE 12

Primer and probe sequences

| Primer/Probe | Sequence | SEQ ID NO: |
|---|---|---|
| TaqMan | | |
| SR134-236F | 5'GTGGTGCAGCCAATGGTTG | 1343 |
| SR134-427R | 5'GGACGCAAACTCACCCTTCAT | 1344 |
| SR134-1437F | 5'TTTCCAGCGCAGATCGAAA | 1345 |
| SR134-1633R | 5'ACAGCATGTTTGCGTTCCTG | 1346 |
| Probe | | |
| SR134-273T | 5'6FAM-TAGCGGACCTTGCGGTTGCCG-TAMRA | 1347 |
| SR134-1479T | 5'6FAM-ATCCGAAAAACCGTGCAGGGCC-TAMRA | 1348 |
| Conventional PCR | | |
| SR134-2-F | 5'GTGTTGTAGTCAGACCCTGTGG | 1349 |
| SR134-2-R | 5'AAAAACAACCATTGGCTGCAC | 1350 |
| SR134-3-F | 5'TGGATATGAAGGGTGAGTTTGC | 1351 |
| SR134-3-R | 5'GATCAAACCGCTACCGCTAC | 1352 |
| SR134-5-F | 5'TCAACGTCGTCGAATGAAAC | 1353 |
| SR134-5-R | 5'TGTTTCCCGAGGAGATGTTC | 1354 |

Example 20

Use of Real-Time PCR for Detection and Quantitation of *M. paratuberculosis*

A real-time PCR assay was developed for detection and quantitation of *M. paratuberculosis*. Primers and probes were designed based on a novel unique sequence, SR134 (Table 11). SR134 is a sequence unique to *M. paratuberculosis* and is present in 6 copies in the genome. To increase sensitivity, two sets of primer-probe combinations were tested and used in the TaqMan assay as a multiplex strategy to amplify 211 bp and 215 bp fragments of the *M. paratuberculosis* SRI 34 sequence. Assay conditions were optimized for $MgCl_2$, primer, and probe concentrations in the reaction mix; optimal concentrations were found to be 5.0 mM $MgCl_2$, 100 µM each primer, and 150 nM each probe.

To quantitate standard *M. paratuberculosis*, curves resulting from amplification of SRI 34 from known amounts of *M. paratuberculosis* DNA (100 ng to 1 fg) were generated. A regression line was generated from the data points, and the correlation coefficient ($R^2$) value was determined to be 0.99. The ability to employ the TaqMan approach for quantitation of *M. paratuberculosis* also was determined. For example, a sample containing a "blinded" number of *M. paratuberculosis* cells had a Ct value of 24.16, which was equivalent to 0.082 ng DNA or 96 cell equivalents, and closely approximates the 100 cell equivalents that were spiked into the sample.

Known amounts of *M. paratuberculosis* K-10 genomic DNA were used to test the sensitivity of the assay. DNA concentrations ranging from 100 ng to 1 fg resulted in Ct values of 15.18 to 39.09. The cut-off point for accurate detection of *M. paratuberculosis* K-10 DNA was approximately 100 fg of DNA (35.04 Ct), which represents 0.11 cell equivalents of *M. paratuberculosis*. Ten-fold dilutions of *M. paratuberculosis* K-10 cells spiked in feces also were used to determine the sensitivity of the assay. The assay was reliably able to detect 1 cell of *M. paratuberculosis* per PCR reaction.

The specificity of the TaqMan assay was tested using 118 *M. paratuberculosis* isolates from different animal species including bovine, ovine, murine, and humans, isolates representing 7 other mycobacterial species (n=27) including the closely related *Mycobacterium avium*, atypical mycobacteria (n=4), and uncharacterized non-MAP (n=9) (Table 11). The SRI 34 TaqMan assay was able to detect all but two *M. paratuberculosis* isolates, whereas no amplification was observed with any of the other mycobacterial and non-mycobacterial species. Thus, this assay was 100% specific for amplification of *M. paratuberculosis* DNA.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (5809 sequences)

SEQ ID NO: 1 - DNA, 969 bp, Mycobacterium paratuberculosis
gtgcgcccgcacaccggcggacggcggatcagcatctactggacgtggagctatccgtgggaatcgcagcgcgacattcagaccctggacaaccgcttctccaccatgaccgaagtgcgcagggcggcctggccccgatacgaggggcccgactgggacgacgcccactttctgcagggcatcgccggcaccttggagcttttccaccgctcgacgcttgcgttccaggagctggccggcgaagcaaccggtcagcaggtggcggtgttccagcgcgtcgaccaggccggctaccggctggtgatcgacgagcggatattggccgacaccgacaccctgatggtgttcgggctggaccatctcgccggggaagacgaggccgagcccggggagatctcggccatccgtgcctggctggaacgcgagggcacctgcctgctgctggccccgcaccacgacgtcggcggcaccgacgacatggcccagcggcaggtcgaatacctgcaccacggggatccgctcgtgccgcggcaacaacggttttccgcctacacccgctcgctgatgaaggggctcgacgttcccgtccgcaacaggtggggcctgcatccggcccgggtggccgcgaccggtcagatggcaccgctgacctgctttcgcgacctggacgcgcccgggctgctggacgatgtcacgacgctgaactttcacccgcatctgccgcactacgagctcaccgccccggaaagcgacgggctacgggtgctggccacccaacgcgtcgacccggcccggccccatccctttaccgaggcgggcaacagcgaattcaacgcgttgatctggatgccgccgcacgccgaacgagccggtgacatcgtgctcgtcgactcgaccaacttcacgacgctgttcggcgggtccgacagcctcagaaacttctggcacaacctggccacgatgaggtga

SEQ ID NO: 2 - DNA, 576 bp, Mycobacterium paratuberculosis
atggtggcaaccgaacacgagtggagcaaacccgcggccctggccattcccagggagggctacttcgagctcgaacgcggtcgttacgggccgctgtatccccgcaccccggcctgctacggcttttccatcatcgccaaggtcaaggagggccgcgaggaagccgtccgcgcctacggcaaacagatcgaagaggccatcaaggccgatccgcacgtgcttgccgcgctgcggctgcactacctgcgctggttgctcttcgacgtcggatcgggactgcacttccagtaccagggcatcttcgacacggacttcgacaagtacaccgaggacgcggtgcagctgttcagtcagaccgggatcaccaccgtcttcacgaacctcgaggggtttcccgaagactggcgggagaacccggacgccttcgtcaagttcgtgcgtgagcaccagtgcccgagctttctggagtacggggagtatccctacgtcaccgccgacgagatcaaaaaggcgtacggctcaagccgcctcccagaccatgctggatcagatgcaatgacgtcggtcagagtctga

SEQ ID NO: 3 - DNA, 522 bp, Mycobacterium paratuberculosis
atggtggtaagcatttcggctcccacggtgccgataccccaggcgatgacgttcagcggtctgcggtcagacatcggacagaagccgacgcgtgggcagcaccgtcaacgggacgccgcgatcttcgaactgccagttcggcccatgagagatgtaggtcatttcgacttcctcccggcgcttcgcttcggtgtccgaccaccggatgtcgacgaccaggtcgctggcctcgtaggtcgcgtgcagatccgaccagtgcggatcgacaccggtggccatgacctcgaggggactgacatcgtgcgtcgacagcgtcgccatccaactgcggtcgcggacggcgggggagttgcttgggatgcgcacccgcaccgcgtcgcgcgctcctgtcccgaggcgctccacggatgctccggtgtaggcgaacgggcgcagggcgggatgcaaatcgaggaccgaagcaaggtcatctgcgccgacgccaaacccgaggctgctttgatgcgcgccgaaccgacgtag

SEQ ID NO: 4 - DNA, 582 bp, Mycobacterium paratuberculosis
atgaacacttcttcctctctacctgtcgacaccctggacgtcaccgcaccaccggatgccactgaggtttacggctgggcagcgcacccagacggtctggccgcccgtgcattcgaagcagcggtgcgtgactgcgccggctaccgggtccgggtgcgcggtgcgcaacgctccaacgtcacctgccgccgctgggtggccatcgaagccgcacccggcgccgacgagcaagcgttggagcccgaagcggtgcggcagctggcgccgcagatgagcgtcacgcctaccacgcgccggacagctgagatgctcgacgacgccgccttcgatgcgatcgtcgcggtgttcagtcaacgggcccgatgcgagatgcaaacgctgtcgggaggcaagtgcccacgggctgcgcgctggcgcattgatttgcacgggtgcgaacaggccattgtgtgcgggcagcacaagaaagcgtggctgcaggaggccctagccaacctctggcgcggcattcaacctcgctgcgcccactgcggaagagtgttcaacagcttccaagacgcggtcaggatcaccgcgatatga

SEQ ID NO: 5 - DNA, 311 bp, Mycobacterium paratuberculosis
atggccaccaacgacgaccaagacgacgggaagccacccattaccgcggccgctggcggtgatgagaccgcgatcggggcggccgctgatgaaaccgagctcgtcgcgccgctcaccgtgcccgcgtccgagttggcctggtcccacgaggacagcgacgctggtgattactcgtggggccgggctgcggaacgcgccagcatcatcgtgctcgcctgtgcggcggtcgctgtcgtgatcggtttgctgacctggctcgccttgcacctacacgaccaggccaagccgacagccggcccgacggccgcgcg

SEQ ID NO: 6 - DNA, 576 bp, Mycobacterium paratuberculosis
atgagcgccagggatctcatcaacatcggggtcttcggcgctctctacatcgccactgtgttcgcgatcaacgtgttcgctttcatcaatccgctcgtcatgttggtcgccctggcggtcagcatgatcgccggcggcgtgccgttcatgttgttcctcacccgggtgcgacatgcgggcatggtgacggtgtttgcgattatcacggccggactgctcgcactgaccgggcaccccccgatctgcttcgtgatcacagttgcgtgcgcgttggtggccgaagtcgtcctgtggctgggacgctatcgctcccgcaccatgggtgtactggcgtacgcaatctacgcggcgtggtacatcgggccgctgctgcccatcttctacgctcgcgatgaatatttctccagtcccggcatggcacagatgggtccgcgctacctcgaagagatggaacggttgttgtcgccagccgtgctaatcgcattcgacctgtccacggtggtattcgggctgatcggcggactgctcggagtaaggttgctgcgcaagcattttcagagggccggcctagcttga

SEQ ID NO: 7 - DNA, 474 bp, Mycobacterium paratuberculosis
atggcggggatgccggaggaggtcgctgcgcttctgcgcggtttcccacgcatcggcgcgcgcgagcaggcgtttgcgttcttgaccgttgacactggcgggtttccacatgcggcgttgctgtcgcgctgcgagctcgagcctgggcgggacccccaaacactgatggccgccatagctagccgacagacccgcgccaacttgcggcgtagcggcaccgcggggctgctcgcaatcaatggcactagttgccaccacctcaagctgcgagtggtcgcctcgctcgtcggtcgcggaatactcggatgtgtgtttgccgtgaccgaacataagcgcgatgacatgggaatacccttgcagcctacgctatttcggacctcggccgagatctcggtgcttgaggactggccgcgtagtcgggccatgttcgaccgtctcgcagcgctgcgcagcgcagcgcgggaggtcctatga

SEQ ID NO: 8 - DNA, 558 bp, Mycobacterium paratuberculosis
atgcgtttcgccctcccgacgcgcatcctgcactggctgatggcgccgatggtcatcgggcagctgctcatcggggtggtcatgatcacgtcgttgacctactatccgctgctgctggccatccaccggccgttgggcgccttgatcctggcgtttgcggtggtgcgcctggcgaaccggttcacccaccggctgccgcccttccttgccacgatgggccccgtcgaacgccgcgtcgcgacatggtcggagtacctgctctatgccctgctgctagcccagcccttgatcgggtgggcgatgctgtcggcggcgcggttcccggtcgtcttggtgggacccgtgcatctgcccggcatcgcaccgcacaacgtcgacgtctatgcggcgctgcgccaagcccacaacgtcggcgccttcctgcttttcctgaccttcacggcccacgtctgcgcggtcctctttcatacgctcggcctgcgcgaccggctcctcgatcgcatggcgctgtggcccaccaagcccgtcgcctcgcggcaggacgaaatcaaggcgtga

SEQ ID NO: 9 - DNA, 321 bp, Mycobacterium paratuberculosis
ctgcgcaggctgatggccgaacgcggactgttcaacacgacagcgttgcggccactgctggccgaacgcggggtgcagctgtcggccagccaggtctaccggctcgtgaccgagaaaccggaacggttgagcctgcccaccctggtggcactggtggacattttgaggtgtgcgatggacgagttgatcgagatcgtgcccgccacagctgcctcggcgaagaaggccgcgggcgcaccggagcgcagcaaaccggtcaggacgcgggaacttggtggccaccgccccgtccgggccaagatcgtcgacgcggattcctag

SEQ ID NO: 10 - DNA, 2508 bp, Mycobacterium paratuberculosis
atgcgcggaaaccgcagcgagttcgtgacggtgatcgtcactgcagtgggcgcgatcgagccgcacctgagccacgacgatgtccgcaccgcgatcgaggggatgggcctgtcggccgcgcagttgcagaggctgtctagaacgctgcggcgcgacggtagcgtgctcaccgggcccggcggcagcgactgcgccgccgacatcgagcagctgatcctgtgtctgcgccaactcggcgccatgcgtgttcgagcgccgcggtgtgcccagtgcggccgcaacgattccgaaacctactcgcgcaagctcaagaagcgcatctgccgagcctgttcgatgcagggttggcagccggctgtcggtgaatgcccgggctgcggcgcggtggacaagttgatctaccggccgcggcacggcgatggcctgttgtgtcggaggtgcaagcccgaacccgacgtcgatcacgccgccaaggttcgtgacggtatcgcgcaactgcggaccgggctttcggccaccgagattgaccgggtggcgtcggtgttcggcacggcggtcgcgcagcgcgagcttaactggatcttgcaggacacccccggagtgtttcgcggtgagatcgcccaccgctcggcggtctcggtgcggctcgccgaactacttgtcgctgccggtgccgacaatgtgcgccttccgcagtgcccgttgtgtttgcgcaccgtgaagctcggcagccagattgacgggttgcgctgctgccatacctgctggggtcaccacttcagccgcggcacctgcgctcgttgcggttgccagcgtcaccttatcaattatcacggtgccggcgagcgcctctgtcaccgttgtttcgagcatgatccggtcaatcatgagccgtgtacacggtgcggtcgtgtggacttcatcaaccaccatgacggccaagcgaagctctgccggcgctgctacccggcacccaccgcggtctgcagctcgtgcggacgtactcgcccatgcacccgcacccggacgggaaagccgatctgcggcacctgctcggccaaacagcgcccaccccaaccctgttcggtatgcggcaacatccgctccgtgcacacccggactgacgccggtgagccggtgtgtaacccgtgcgcacgaagtcgggaaccgtgcgcgcggtgcggcaaaacgctgggggtctcggcgcggcttgccggggtcgggccgctgtgctcggcctgcctgcaacgtgaacccgcctatttcaccgactgtgtgcaatgcggcgcccatggacggacgtaccaccgtgggctgtgcccggcctgcgcctgtcccggtgagctccgcgaattgttcgccaagaacggcgaattgagcggcgccgccagccgcatcgtcgaggcgttgctgcaatgtgacgccatgccggtgctgcgatgggtcagacgcatgcgatcgaacagtgaactgcccgcgcagctcgccgaactcggcgacaccctcagccaccacgacctcgatgacctcccggccagcaaatccgtggaatggcttcgcaacatcctggtgaccgccgagggtctgccagaccgcgacccctatctgcaccgcaccgagcagtacatcgccgcccggctggccaccatcagcaaccgcgacgatcgcgcggccgtccgcgcattcaccgaatggaatcatttgcgtaaactccgggcccgcgccgacaaaggaccactcaaacgcaaccacggcctcgccgcccagatcatggccgccgccatcaccgacttcgtctccgaactcaacgcgcacggactggccttggcctcatgccagcaggcgttcgtcgacgactggttggtgcgcaaccccactcgccgccagatccaccaattcctcgcctgggcggtccaccgtggctacgcccacgacgtcgcggctcccgtaccgcaaacccgccgcacccgccacaccctgcccggcgacgacgaacgatggcgcctgatccaatacctgatcgaacaccccgacttggagacgcgcgatcgggtcgccgggctgctcgtgctgctctacagccaacccgccgcccgcctggtcaccctcaaggttgccgacgtcaccatcaccgacgacgcggtccaactcaccctcggcgccgtcccgctcaccgtgcccagccccgtcgaccgcctgctcgccgatctcgtacagcagcgccgcggatacgccgcggtcaccgtgggcaccaatccatggctgtttcccggaggacgctccggtgggcacctgtccgccaaccaagtggggctgcggctcaaacgaattggcatctccccccggatcgcccgcaacaccgcgctgatcgacctcgccggcgaactgcccgctgtcgtgctcgccaaactcctcggcttcagcatcaaacgcgccgtcacctggagcgaagaagccggcaacactcgcccccgctacgccgccgaggtcgcccgccgcaactcgtga

SEQ ID NO: 11 - DNA, 264 bp, Mycobacterium paratuberculosis
gtgtcaacatctactgagcgccgtttgcgcttacaggtcgccgttcacgagagctgggcgcgcaccgaaaaccgttccgcgcgaacgcataacgcccgtaaggcggcatgggaccgcttcgaaaagcaggtcgatcccgagggcaagctaccccccgccctgcgcgccaagatggccgagaacgcccgcgcggcccacttcaagaagatggcgttgaagtccgtcgagtcccggcgccgtcgccgggacggggtggcggcgtga

SEQ ID NO: 12 - DNA, 1110 bp, Mycobacterium paratuberculosis
gtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcgaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctag

SEQ ID NO: 13 - DNA, 672 bp, Mycobacterium paratuberculosis
ttggtcattgcgctagctgccttgtggagcatccgtttggcctggcacatcccgttcgagcgagcagcagtgttggcactggcgtttatgtgtgcccagttggtcctggcgctcgggccggtggacgggtggctgagcccattgctccacgacatgacgggcgtgtggaacctcgaagacctcatcggccatctgctctacgtgtacggcttgttctcgatcatgtatctggtcgctgaccactgcgacatgacgccgggtcagctcaggtggttcgttcggaaccggttggaactgccgtcggtcgtgatctgcgccgtcatgatcgcggtcttcgtcgcaggcgacatcggcgagacctgtgttcccgatgttgtggccacagaacacacgccctggctccgcgtctactggttcgtaatgatcgcggctcttgcgtacatcattgtctctaccggtcgaatcctgttgatcctgaggcagcacccacgctcgaggcatgccgccacggcctatctcgtagcgctcggtatcactggcgcgtgctgcgtggttttcatcatcggaatcccttggctgcaatggcttctcgtgcggtgcgaggtagtcggctatgcggtggccgcctcgtactcctggcgtaacaaagtggcttactttcgtggacgctag

SEQ ID NO: 14 - DNA, 372 bp, Mycobacterium paratuberculosis
ttgcacgaaatcctccggtttggcgggaaaaccgacgaattgatcggttttgcccgcgctttgtcggttcagactgctaccctgccgggcatgtcttcgcattcgcctgtgtcggccgccgccctggccagccgattgcggatgatcatgggcgaccgcaagctgtcccgtacccgtctttctcacgagacaggtatcagccgcccgagcctttctagcaagctcgatggcaaggtcgagttcacctacagtgagctacttacgatcgcccaggcggtcgatgttccgctggacaagctgctcgccggagacgacgatgagcggcccttccgcctgagtgacttgagacctcgacccgatcgacctctgtga

SEQ ID NO: 15 - DNA, 600 bp, Mycobacterium paratuberculosis
atggttgcggcgcaaggctcctcgatgctaaccgctgccgatttcgccgcgcaatgggccgatgttcccccgtgggaaccgccggacgaaccaccgcagcgaaacggccaacgacagcagcaggcaagcgccgagccgaccacgtgggaggcgttcgatctcggaccctacctgcgcggcgaaatcgaacgcccacatcccggtatcggcatatcacgctccgacgggcagcggtcgctctaccctggtcgcgagcacgccatagtcggtgaaaccgaaagcggtaaaacctggttcgcgttgggctgcgccgccgcagaactcaacgccggcaacgacgtcgtgtatatccactacgaagaacccgacgcgacgagcaccgtcgagaagctgtgcttgcttggggtcgaccccgcggtgatcaaggcccggtttcggttcgtcgctcccagccgccccgtccgtgaggagtggctgaacgcactacttgacccttcaccgacgctggtcatccacgacggcgtcaacgaagcgatggcgctgcacggcgacgagatcaaggccgtcgagggcgccgcgggcgtttcgccggccgactga

SEQ ID NO: 16 - DNA, 540 bp, Mycobacterium paratuberculosis
atggtgcgcgacggcagccgccgcgatgcctacggttcggtgcataagggcaacgcgctcgacggggctcggttcgtgctcgagaactcggcgccgttcggccggcggctgcgcggcgtctcctacgtcttcgtgaccaaagaccgccccgggcatctacgggccaacgggcgcgcaacgaagtcgcccggcaagacgttcatgggaactctggtcgtcgatgactcgcaggcgttcggtcctgacttcacgatgcggttcttcgcgcccagggacgacgacgtgcctgagagcgatccgaacgccgagctggctgacgctgtctttcgcgtcgttgctgcggctcccgaccacgctgttgggtcgatgcggctgttgttcgctgagttacgcaacgtcgacatccagttccgtgacgacgatgtgcgcgacgtcgtcgatgaccttgtggtgtcaggccgtctcgtagagatatcaggcaagcgtggcgccaaggggttcagggccgttgtggaggacgccgatggggacagcacgtga

SEQ ID NO: 17 - DNA, 291 bp, Mycobacterium paratuberculosis
atgaccaccgacaaccccacgccctctgatgaccaggcactggccgccctctacgccacagcactcggcgtgctcctggccggcctcgtcaacgacggacgcctcacgaccgagatcgagcgcatcatcgccgccggcgagaaagtcaccgccggcgtcctcggcttcctgaccgcagcagccgccaacgcctacgaatacgagcacggcagccgagaagccgccatcgacgcagtcaccgcagacctggccaccgtgctgctcgccgccggagagggacagccctcatga

SEQ ID NO: 18 - DNA, 225 bp, Mycobacterium paratuberculosis
ttgaccgcgttgacggcgttgcgcgacgtcctggcggcggcgatcgatgaatgcgggtcgaaacgtgatttggccgcgttgttgcggcagttcaccgctgtcctggcgcagatcgaggcggcgcgggtacggccaccgcaacgtcggattgccgatgagattgcggcccggcggacagctcggcaggccgcggccgctgccgatgcgaagagcgcggaccgctga

SEQ ID NO: 19 - DNA, 441 bp, Mycobacterium paratuberculosis
atgagcgacgagttacgccagcgctacaaggtgattttcgatgcagtccgggtgagcgaaatcgagatcaccccggatcttgcgcggtgcctcgtgcactggctcggtgattacatccggctcaagcagcagcctgggcagcccggtgtcccggaggggttagttgcggcgcagacggcgcttgccgaggcgtacgccgcggttactcactcgcctcgaagcgagcgggatcgcccgatcggggctggattcgtattctcagcccatgacgcgtgggtgggcactgcggaagccgctgagatgctcgggatcaaggcgggcagcgtcggttggctttgccgggagagtcatcttgagcaccggaaagttggccggcagtacatgatttcgaccgcatcgatcgaggactacaaacgccgcaaggctgaaaggagcgcgtga

SEQ ID NO: 20 - DNA, 726 bp, Mycobacterium paratuberculosis
atggtcaacgtgccgcgtgcggaacttgcgcggctggtgggggtttcgccggacgtcgacgatctaacgttgcagcaggccatcgattccaagctcgcgcagaatgaggccgaaaagcacgctcacgcggtgtctgcggccgagcagcgggcccgcgcggatgaccggcgaatcgtcatcgctgcctacaacgaaggccggattccgcagagccgcatcgacttctggtgcgaagcaatgcaacgagaccgcgccggcaacagggctatcctcgcggctttggcgccgggactggccccgcctgaaaagctccctactgacccgcagatcgaacatgtccacgcgaaagtccttgctcggatgggcatccggccgccggcatctgctcccacatcgcagactgtcgctgcgtcatcgccaccgccgtcaccaggcgtcgatgatttgggcataccgatcgcgccgttgccgccacctgtgcgcatcgtgcgcatcgtgcacggcaaagatccggccacgtggtccaaagaagagcgcgataacgcgctgctgtacgggctcggcccccggttcgccgcagcggcggcggcgcgtgggatcccacgcccacccggaggctccgggtactaccagccgaccggcatcgagccctacgagcccgtcgacctgggtggcggtcagatcgagtggcgcgccaagcccgactaccggccgcggggtgactga

SEQ ID NO: 21 - DNA, 426 bp, Mycobacterium paratuberculosis
atggcataccgaatgagtccccgcgtcgagatgctggccgtcaaggaccagaacgggatcatttggcatcactaccaaagacctgtcgggggtgcccgcaaccttggtccgatcattgcgtggattggccctgactaccgggatcgctggctacgcatgggcctcatcgaggagatccccgacgacgccgcggccgccctgtcacagcccccgcccagcgatgcagtcgccggccccaataccgatctcgtcgacgagtgcatcgccgcgctcgaccgtttcgatgtgccagccgatgccggcgccccgaccgcgcggaaagccctgcgcgacagggggcaagcctggggcaacgagaccatcgctgctgctgtccgcgcgcgcaaggcccgtgccgcgccgtccgggacgccggcagggtcatga

SEQ ID NO: 22 - DNA, 279 bp, Mycobacterium paratuberculosis
  misc_feature (1)...(279): n = A,T,C or G
atgagcaccacgacggtgccagtcggcacgacacccgctgcgatcacagggattccgccggacgtcgactcggtgcaagtcctcaactccagcgaggggctcggtgatgccgccggcgtcgacatcgtcgtcaacaactccggaggctgttcgctggacccgcagacggggatccggctcaaacccggcgagttcttcgtgttctcgctacgccagccacatgggggcccggccgnttgccgctgtacgcggtcgcggccggccctggtggtcagttga

SEQ ID NO: 23 - DNA, 4415 bp, Mycobacterium paratuberculosis
  misc_feature (1)...(4415): n = A,T,C or G
tcaactgaccaccagggccggccgcgaccgcgtacagcggcaancggccgggcccccatgtggctggcgtagcgagaacacgaagaactcgccgggtttgagccggatccccgtctgcgggtccagcgaacagcctccggagttgttgacgacgatgtcgacgccggcggcatcaccgagcccctcgctggagttgaggacttgcaccgagtcgacgtccggcggaatccctgtgatcgcagcgggtgtcgtgccgactggcaccgtcgtggtgctcatgaccctgccggcgtcccggacggcgcggcacgggccttgcgcgcgcggacagcagcagcgatggtctcgttgccccaggcttgccccctgtcgcgcagggctttccgcgcggtcggggcgccggcatcggctggcacatcgaaacggtcgagcgcggcgatgcactcgtcgacgagatcggtattggggccggcgactgcatcgctgggcgggggctgtgacagggcggccgcggcgtcgtcggggatctcctcgatgaggcccatgcgtagccagcgatcccggtagtcagggccaatccacgcaatgatcggaccaaggttgcgggcacccccgacaggtctttggtagtgatgccaaatgatcccgttctggtccttgacggccagcatctcgacgcggggactcattcggtatgccatgtcagtcaccccgcggccggtagtcgggcttggcgcgccactcgatctgaccgccacccaggtcgacgggctcgtagggctcgatgccggtcggctggtagtacccggagcctccgggtgggcgtgggatcccacgcgccgccgccgctgcggcgaaccgggggccgagcccgtacagcagcgcgttatcgcgctcttctttggaccacgtggccggatctttgccgtgcacgatgcgcacgatgcgcacaggtggcggcaacggcgcgatcggtatgcccaaatcatcgacgcctggtgacggcggtggcgatgacgcagcgacagtctgcgatgtgggagcagatgccggcggccggatgcccatccgagcaaggactttcgcgtggacatgttcgatctgcgggtcagtagggagcttttcaggcggggccagtcccggcgccaaagccgcgaggatagccctgttgccggcgcggtctcgttgcattgcttcgcaccagaagtcgatgcggctctgcggaatccggccttcgttgtaggcagcgatgacgattcgccggtcatccgcgcgggcccgctgctcggccgcagacaccgcgtgagcgtgcttttcggcctcattctgcgcgagcttggaatcgatggcctgctgcaacgttagatcgtcgacgtccggcgaaacccccaccagccgcgcaagttccgcacgcggcacgttgaccatgcccatcacgcgctcctttcagccttgcggcgtttgtagtcctcgatcgatgcggtcgaaatcatgtactgccggccaactttccggtgctcaagatgactctcccggcaaagccaaccgacgctgcccgccttgatcccgagcatctcagcggcttccgcagtgcccacccacgcgtcatgggctgagaatacgaatccagccccgatcgggcgatcccgctcgcttcgaggcgagtgagtaaccgcggcgtacgcctcggcaagcgccgtctgcgccgcaactaacccctccgggacaccgggctgcccaggctgctgcttgagccggatgtaatcaccgagccagtgcacgaggcaccgcgcaagatccggggtgatctcgatttcgctcacccggactgcatcgaaaatcaccttgtagcgctggcgtaactcgtcgctcatcagcggtccgcgctcttcgcatcggcagcggccgcggcctgccgagctgtccgccgggccgcaatctcatcggcaatccgacgttgcggtggccgtacccgcgccgcctcgatctgcgccaggacagcggtgaactgccgcaacaacgcggccaaatcacgtttcgacccgcattcatcgatcgccgccgccaggacgtcgcgcaacgccgtcaacgcggtcaacgcatcaccggacttcgccgccttagaaaccgaattacgcggtgttacaacgtgactcgtagttccagcattacgcctgaccatcagtcaatcatccccttgacgtgtggaaatctgccaggggagagaaacaagcgacccggcggcggtcgccgaggggccccctcccctcaagaaaatcggcgggtggggtcgacgtgtgctcctcgggcattacacgtcggtgcttgggcgtgggtccgatcgcaggcgcgcaccgttggtcggcggtggctctgtgttcttctcggcgtgggtcgttgtgtctggtgtcgcgggtgaccggtcgtggccggtagctgttcatgagggctgtccctctccggcggcgagcagcacggtggccaggtctgcggtgactgcgtcgatggcggcttctcggctgccgtgctcgtattcgtaggcgttggcggctgctgcggtcaggaagccgaggacgccggcggtgactttctcgccggcggcgatgatgcgctcgatctcggtcgtgaggcgtccgtcgttgacgaggccggccaggagcacgccgagtgctgtggcgtagagggcggccagtgcctggtcatcagagggcgtggggttgtcggtggtcatggtgtgcctttcgggttggggtggatggggtgttgctttctgggtcggccgcgctgttgggtgcggagctggcccgctacgacgccgtgcggccggtgtctggcgggtagggcgttgaaccatgcgcggcagcggtcggcggccggacaccgcgaacacaggccgaggacctgggcgtggcgctgctcaacgacttcgggggcctcgttcggtgctgcttcgtcgaacaggtgatgccggccgcggcatctggcacctggcaacgacggtgcagcggccagcgcttcgaggaggtggtgcagcgcggtcatcgggtggctcggttcaacggggtcgtccctccgggatcgggttttcttgactgttttccgactgcgtcccgcgaccgcgtcctgcgtcccccctacggggggtgggacgcagtcggacgcagtcgcagtccgcttgaacgccactgcgtccggacgcggtgggacgcagtcggacgcagtcacgtgctgtccccatcggcgtcctccacaacggccctgaaccccttggcgccacgcttgcctgatatctctacgagacggcctgacaccacaaggtcatcgacgacgtcgcgcacatcgtcgtcacggaactggatgtcgacgttgcgtaactcagcgaacaacagccgcatcgacccaacagcgtggtcgggagccgcagcaacgacgcgaaagacagcgtcagccagctcggcgttcggatcgctctcaggcacgtcgtcgtccctgggcgcgaagaaccgcatcgtgaagtcaggaccgaacgcctgcgagtcatcgacgaccagagttcccatgaacgtcttgccgggcgacttcgttgcgcgcccgttggcccgtagatgcccggggcggtctttggtcacgaagacgtaggagacgccgcgcagccgccggccgaacggcgccgagttctcgagcacgaaccgagccccgtcgagcgcgttgcccttatgcaccgaaccgtaggcatcgcggcggctgccgtcgcgcaccatcgggaggtggtcgcacgccagcgtggccgcgccgacacgtaggcatggcaggcatcagtcggccggcgaaacgcccgcggcgccctcgacggccttgatctcgtcgccgtgcagcgccatcgcttcgttgacgccgtcgtggatgaccagcgtcggtgaagggtcaagtagtgcgttcagccactcctcacggacggggcggctgggagcgacgaaccgaaaccgggccttgatcaccgcggggtcgaccccaagcaagcacagcttctcgacggtgctcgtcgcgtcgggttcttcgtagtggatatacacgacgtcgttgccggcgttgagttctgcggcggcgcagcccaacgcgaaccaggttttaccgctttcggtttcaccgactatggcgtgctcgcgaccagggtagagcgaccgctgcccgtcggagcgtgatatgccgataccgggatgtgggcgttcgatttcgccgcgcaggtagggtccgagatcgaacgcctcccacgtggtcggctcggcgcttgcctgctgctgtcgttggccgtttcgctgcggtggttcgtccggcggttcccacgggggaacatcggcccattgcgcggcgaaatcggcagcggttagcatcgaggagccttgcgccgcaaccat

SEQ ID NO: 24 - protein, 322 aa, Mycobacterium paratuberculosis
VRPHTGGRRISIYWTWSYPWESQRDIQTLDNRFSTMTEVRRAAWPRYEGPDWDDAHFLQGIAGTLELFHRSTLAFQELAGEATGQQVAVFQRVDQAGYRLVIDERILADTDTLMVFGLDHLAGEDEAEPGEISAIRAWLEREGTCLLLAPHHDVGGTDDMAQRQVEYLHHGDPLVPRQQRFSAYTRSLMKGLDVPVRNRWGLHPARVAATGQMAPLTCFRDLDAPGLLDDVTTLNFHPHLPHYELTAPESDGLRVLATQRVDPARPHPFTEAGNSEFNALIWMPPHAERAGDIVLVDSTNFTTLFGGSDSLRNFWHNLATMR

SEQ ID NO: 25 - protein, 191 aa, Mycobacterium paratuberculosis
MVATEHEWSKPAALAIPREGYFELERGRYGPLYPRTPACYGFSIIAKVKEGREEAVRAYGKQIEEAIKADPHVLAALRLHYLRWLLFDVGSGLHFQYQGIFDTDFDKYTEDAVQLFSQTGITTVFTNLEGFPEDWRENPDAFVKFVREHQCPSFLEYGEYPYVTADEIKKAYGSSRLPDHAGSDAMTSVRV

SEQ ID NO: 26 - protein, 173 aa, Mycobacterium paratuberculosis
MVVSISAPTVPIPQAMTFSGLRSDIGQKPTRGQHRQRDAAIFELPVRPMRDVGHFDFLPALRFGVRPPDVDDQVAGLVGRVQIRPVRIDTGGHDLEGTDIVRRQRRHPTAVADGGGVAWDAHPHRVARSCPEALHGCSGVGERAQGGMQIEDRSKVICADAKPEAALMRAEPT

SEQ ID NO: 27 - protein, 193 aa, Mycobacterium paratuberculosis
MNTSSSLPVDTLDVTAPPDATEVYGWAAHPDGLAARAFEAAVRDCAGYRVRVRGAQRSNVTCRRWVAIEAAPGADEQALEPEAVRQLAPQMSVTPTTRRTAEMLDDAAFDAIVAVFSQRARCEMQTLSGGKCPRAARWRIDLHGCEQAIVCGQHKKAWLQEALANLWRGIQPRCAHCGRVFNSFQDAVRITAI

SEQ ID NO: 28 - protein, 103 aa, Mycobacterium paratuberculosis
MATNDDQDDGKPPITAAAGGDETAIGAAADETELVAPLTVPASELAWSHEDSDAGDYSWGRAAERASIIVLACAAVAVVIGLLTWLALHLHDQAKPTAGPTAA

SEQ ID NO: 29 - protein, 191 aa, Mycobacterium paratuberculosis
MSARDLINIGVFGALYIATVFAINVFAFINPLVMLVALAVSMIAGGVPFMLFLTRVRHAGMVTVFAIITAGLLALTGHPPICFVITVACALVAEVVLWLGRYRSRTMGVLAYAIYAAWYIGPLLPIFYARDEYFSSPGMAQMGPRYLEEMERLLSPAVLIAFDLSTVVFGLIGGLLGVRLLRKHFQRAGLA

SEQ ID NO: 30 - protein, 157 aa, Mycobacterium paratuberculosis
MAGMPEEVAALLRGFPRIGAREQAFAFLTVDTGGFPHAALLSRCELEPGRDPQTLMAAIASRQTRANLRRSGTAGLLAINGTSCHHLKLRVVASLVGRGILGCVFAVTEHKRDDMGIPLQPTLFRTSAEISVLEDWPRSRAMFDRLAALRSAAREVL

SEQ ID NO: 31 - protein, 185 aa, Mycobacterium paratuberculosis
MRFALPTRILHWLMAPMVIGQLLIGVVMITSLTYYPLLLAIHRPLGALILAFAVVRLANRFTHRLPPFLATMGPVERRVATWSEYLLYALLLAQPLIGWAMLSAARFPVVLVGPVHLPGIAPHNVDVYAALRQAHNVGAFLLFLTFTAHVCAVLFHTLGLRDRLLDRMALWPTKPVASRQDEIKA

SEQ ID NO: 32 - protein, 106 aa, Mycobacterium paratuberculosis
LRRLMAERGLFNTTALRPLLAERGVQLSASQVYRLVTEKPERLSLPTLVALVDILRCAMDELIEIVPATAASAKKAAGAPERSKPVRTRELGGHRPVRAKIVDADS

SEQ ID NO: 33 - protein, 835 aa, Mycobacterium paratuberculosis
MRGNRSEFVTVIVTAVGAIEPHLSHDDVRTAIEGMGLSAAQLQRLSRTLRRDGSVLTGPGGSDCAADIEQLILCLRQLGAMRVRAPRCAQCGRNDSETYSRKLKKRICRACSMQGWQPAVGECPGCGAVDKLIYRPRHGDGLLCRRCKPEPDVDHAAKVRDGIAQLRTGLSATEIDRVASVFGTAVAQRELNWILQDTPGVFRGEIAHRSAVSVRLAELLVAAGADNVRLPQCPLCLRTVKLGSQIDGLRCCHTCWGHHFSRGTCARCGCQRHLINYHGAGERLCHRCFEHDPVNHEPCTRCGRVDFINHHDGQAKLCRRCYPAPTAVCSSCGRTRPCTRTRTGKPICGTCSAKQRPPQPCSVCGNIRSVHTRTDAGEPVCNPCARSREPCARCGKTLGVSARLAGVGPLCSACLQREPAYFTDCVQCGAHGRTYHRGLCPACACPGELRELFAKNGELSGAASRIVEALLQCDAMPVLRWVRRMRSNSELPAQLAELGDTLSHHDLDDLPASKSVEWLRNILVTAEGLPDRDPYLHRTEQYIAARLATISNRDDRAAVRAFTEWNHLRKLRARADKGPLKRNHGLAAQIMAAAITDFVSELNAHGLALASCQQAFVDDWLVRNPTRRQIHQFLAWAVHRGYAHDVAAPVPQTRRTRHTLPGDDERWRLIQYLIEHPDLETRDRVAGLLVLLYSQPAARLVTLKVADVTITDDAVQLTLGAVPLTVPSPVDRLLADLVQQRRGYAAVTVGTNPWLFPGGRSGGHLSANQVGLRLKRIGISPRIARNTALIDLAGELPAVVLAKLLGFSIKRAVTWSEEAGNTRPRYAAEVARRNS

SEQ ID NO: 34 - protein, 87 aa, Mycobacterium paratuberculosis
VSTSTERRLRLQVAVHESWARTENRSARTHNARKAAWDRFEKQVDPEGKLPPALRAKMAENARAAHFKKMALKSVESRRRRRDGVAA

SEQ ID NO: 35 - protein, 369 aa, Mycobacterium paratuberculosis
VPYAESPRTRTGGVFTLEQAQPDDGLVVVRAAGLGQRAIGDDSGVGLDGKVGFEAVLAAVHRLVSVPRVGIDGGDHAIPTDLLRDAPVPVGAIRALDRFNVLTGDQRQQRHRLSSPRREFLVRQIAQHPVSITDQTIHQPIPSGLILPRNRGFPRIVVIMGAAVGFDHRCSARDFAAHSSDRGDQLRHGVLRGHRIVEHRGIQGPPCLARQHPGLGHHRLDRLEDPVGPIRSRQPTPPIRQRRRMKRARRDRQPARCFPAQIESHRIHGLVIRKTVQGLQGDHRGHHLSRHAGPAPLRREQVREHLLGKQLAAVRRQERKHAVGLQKMPGNRLRIQQLTLIIRATLHPTIIPKTPGQLVPPRGINSAGS

SEQ ID NO: 36 - protein, 223 aa, Mycobacterium paratuberculosis
LVIALAALWSIRLAWHIPFERAAVLALAFMCAQLVLALGPVDGWLSPLLHDMTGVWNLEDLIGHLLYVYGLFSIMYLVADHCDMTPGQLRWFVRNRLELPSVVICAVMIAVFVAGDIGETCVPDVVATEHTPWLRVYWFVMIAALAYIIVSTGRILLILRQHPRSRHAATAYLVALGITGACCVVFIIGIPWLQWLLVRCEVVGYAVAASYSWRNKVAYFRGR

SEQ ID NO: 37 - protein, 123 aa, Mycobacterium paratuberculosis
LHEILRFGGKTDELIGFARALSVQTATLPGMSSHSPVSAAALASRLRMIMGDRKLSRTRLSHETGISRPSLSSKLDGKVEFTYSELLTIAQAVDVPLDKLLAGDDDERPFRLSDLRPRPDRPL

SEQ ID NO: 38 - protein, 199 aa, Mycobacterium paratuberculosis
MVAAQGSSMLTAADFAAQWADVPPWEPPDEPPQRNGQRQQQASAEPTTWEAFDLGPYLRGEIERPHPGIGISRSDGQRSLYPGREHAIVGETESGKTWFALGCAAAELNAGNDVVYIHYEEPDATSTVEKLCLLGVDPAVIKARFRFVAPSRPVREEWLNALLDPSPTLVIHDGVNEAMALHGDEIKAVEGAAGVSPAD

SEQ ID NO: 39 - protein, 179 aa, Mycobacterium paratuberculosis
MVRDGSRRDAYGSVHKGNALDGARFVLENSAPFGRRLRGVSYVFVTKDRPGHLRANGRATKSPGKTFMGTLVVDDSQAFGPDFTMRFFAPRDDDVPESDPNAELADAVFRVVAAAPDHAVGSMRLLFAELRNVDIQFRDDDVRDVVDDLVVSGRLVEISGKRGAKGFRAVVEDADGDST

SEQ ID NO: 40 - protein, 96 aa, Mycobacterium paratuberculosis
MTTDNPTPSDDQALAALYATALGVLLAGLVNDGRLTTEIERIIAAGEKVTAGVLGFLTAAAANAYEYEHGSREAAIDAVTADLATVLLAAGEGQPS

SEQ ID NO: 41 - protein, 74 aa, Mycobacterium paratuberculosis
LTALTALRDVLAAAIDECGSKRDLAALLRQFTAVLAQIEAARVRPPQRRIADEIAARRTARQAAAAADAKSADR

SEQ ID NO: 42 - protein, 146 aa, Mycobacterium paratuberculosis
MSDELRQRYKVIFDAVRVSEIEITPDLARCLVHWLGDYIRLKQQPGQPGVPEGLVAAQTALAEAYAAVTHSPRSERDRPIGAGFVFSAHDAWVGTAEAAEMLGIKAGSVGWLCRESHLEHRKVGRQYMISTASIEDYKRRKAERSA

SEQ ID NO: 43 - protein, 241 aa, Mycobacterium paratuberculosis
MVNVPRAELARLVGVSPDVDDLTLQQAIDSKLAQNEAEKHAHAVSAAEQRARADDRRIVIAAYNEGRIPQSRIDFWCEAMQRDRAGNRAILAALAPGLAPPEKLPTDPQIEHVHAKVLARMGIRPPASAPTSQTVAASSPPPSPGVDDLGIPIAPLPPPVRIVRIVHGKDPATWSKEERDNALLYGLGPRFAAAAAARGIPRPPGGSGYYQPTGIEPYEPVDLGGGQIEWRAKPDYRPRGD

SEQ ID NO: 44 - protein, 141 aa, Mycobacterium paratuberculosis
MAYRMSPRVEMLAVKDQNGIIWHHYQRPVGGARNLGPIIAWIGPDYRDRWLRMGLIEEIPDDAAAALSQPPPSDAVAGPNTDLVDECIAALDRFDVPADAGAPTARKALRDRGQAWGNETIAAAVRARKARAAPSGTPAGS

SEQ ID NO: 45 - protein, 92 aa, Mycobacterium paratuberculosis
  VARIANT (1)...(92): Xaa = Any Amino Acid
MSTTTVPVGTTPAAITGIPPDVDSVQVLNSSEGLGDAAGVDIVVNNSGGCSLDPQTGIRLKPGEFFVFSLRQPHGGPAXCRCTRSRPALVVS

SEQ ID NO: 46 - DNA, 18 bp, Artificial Sequence
  Oligonucleotide
cggcggatcagcatctac

SEQ ID NO: 47 - DNA, 20 bp, Artificial Sequence
  Oligonucleotide
cacctcatcgtggccaggtt

SEQ ID NO: 48 - DNA, 19 bp, Artificial Sequence
  Oligonucleotide
accgaacacgagtggagca

SEQ ID NO: 49 - DNA, 20 bp, Artificial Sequence
  Oligonucleotide
cagactctgaccgacgtcat

SEQ ID NO: 50 - DNA, 20 bp, Artificial Sequence
  Oligonucleotide
gcatttcggctcccacggtg

SEQ ID NO: 51 - DNA, 20 bp, Artificial Sequence
  Oligonucleotide
tacgtcggttcggcgcgcat

SEQ ID NO: 52 - DNA, 21 bp, Artificial Sequence
  Oligonucleotide
atgaacacttcttcctctcta

SEQ ID NO: 53 - DNA, 20 bp, Artificial Sequence
  Oligonucleotide
catatcgcggtgatcctgac

SEQ ID NO: 54 - DNA, 20 bp, Artificial Sequence
  Oligonucleotide
atggccaccaacgacgacca

SEQ ID NO: 55 - DNA, 20 bp, Artificial Sequence
  Oligonucleotide
cgcggccgtcgggccggctg

SEQ ID NO: 56 - DNA, 19 bp, Artificial Sequence
  Oligonucleotide
gcaggcgtttgcgttcttg

SEQ ID NO: 57 - DNA, 20 bp, Artificial Sequence
  Oligonucleotide
cgaggtccgaaatagcgtag

SEQ ID NO: 58 - DNA, 20 bp, Artificial Sequence
  Oligonucleotide
atgcgtttcgccctcccgac

SEQ ID NO: 59 - DNA, 20 bp, Artificial Sequence
  Oligonucleotide
tcacgccttgatttcgtcct

SEQ ID NO: 60 - DNA, 20 bp, Artificial Sequence
  Oligonucleotide
tggccgaacgcggactgttc

SEQ ID NO: 61 - DNA, 20 bp, Artificial Sequence
  Oligonucleotide
taggaatccgcgtcgacgat

SEQ ID NO: 62 - DNA, 20 bp, Artificial Sequence
  Oligonucleotide
caaggttcgtgacggtatcg

SEQ ID NO: 63 - DNA, 19 bp, Artificial Sequence
  Oligonucleotide
tgaccccagcaggtatggc

SEQ ID NO: 64 - DNA, 20 bp, Artificial Sequence
  Oligonucleotide
catctactgagcgccgtttg

SEQ ID NO: 65 - DNA, 20 bp, Artificial Sequence
  Oligonucleotide
cacgccgccaccccgtcccg

SEQ ID NO: 66 - DNA, 18 bp, Artificial Sequence
  Oligonucleotide
gcaaggtgggctttgaag

SEQ ID NO: 67 - DNA, 18 bp, Artificial Sequence
  Oligonucleotide
tgcgtgggaggataaggc

SEQ ID NO: 68 - DNA, 18 bp, Artificial Sequence
  Oligonucleotide
ttggcactggcgtttatg

SEQ ID NO: 69 - DNA, 20 bp, Artificial Sequence
  Oligonucleotide
acatcgggaacacaggtctc

SEQ ID NO: 70 - DNA, 20 bp, Artificial Sequence
  Oligonucleotide
atcctccggtttggcgggaa

SEQ ID NO: 71 - DNA, 19 bp, Artificial Sequence
  Oligonucleotide
acagaggtcgatcgggtcg

SEQ ID NO: 72 - DNA, 20 bp, Artificial Sequence
  Oligonucleotide
cagtcggccggcgaaacgcc

SEQ ID NO: 73 - DNA, 18 bp, Artificial Sequence
  Oligonucleotide
cgcggcgaaatcgaacgc

SEQ ID NO: 74 - DNA, 20 bp, Artificial Sequence
  Oligonucleotide
cacgtgctgtccccatcggc

SEQ ID NO: 75 - DNA, 20 bp, Artificial Sequence
  Oligonucleotide
ctacgtcttcgtgaccaaag

SEQ ID NO: 76 - DNA, 20 bp, Artificial Sequence
  Oligonucleotide
tgaccaccgacaaccccacg

SEQ ID NO: 77 - DNA, 20 bp, Artificial Sequence
  Oligonucleotide
catgagggctgtccctctcc

SEQ ID NO: 78 - DNA, 20 bp, Artificial Sequence
  Oligonucleotide
ttgaccgcgttgacggcgtt

SEQ ID NO: 79 - DNA, 20 bp, Artificial Sequence
  Oligonucleotide
cagcggtccgcgctcttcgc

SEQ ID NO: 80 - DNA, 19 bp, Artificial Sequence
  Oligonucleotide
tgggcagcccggtgtcccg

SEQ ID NO: 81 - DNA, 20 bp, Artificial Sequence
  Oligonucleotide
cacgcgctcctttcagcctt

SEQ ID NO: 82 - DNA, 20 bp, Artificial Sequence
  Oligonucleotide
cagtcaccccgcggccggta

SEQ ID NO: 83 - DNA, 21 bp, Artificial Sequence
  Oligonucleotide
tctactgacccgcagatcgaa

SEQ ID NO: 84 - DNA, 20 bp, Artificial Sequence
  Oligonucleotide
tggccgtcaaggaccagaac

SEQ ID NO: 85 - DNA, 20 bp, Artificial Sequence
  Oligonucleotide
catgaccctgccggcgtccc

SEQ ID NO: 86 - DNA, 20 bp, Artificial Sequence
  Oligonucleotide
tggcattggatcgcgtcgga

SEQ ID NO: 87 - DNA, 20 bp, Artificial Sequence
  Oligonucleotide
tcaaacccggcgagttcttc

SEQ ID NO: 88 - DNA, 21 bp, Artificial Sequence
  Oligonucleotide
atcaggctgacgggattgccc

SEQ ID NO: 89 - DNA, 20 bp, Artificial Sequence
  Oligonucleotide
tcaacgagtgcacgggaacc

SEQ ID NO: 90 - DNA, 19 bp, Artificial Sequence
  Oligonucleotide
ttgctgcgggaaggttgcc

SEQ ID NO: 91 - DNA, 21 bp, Artificial Sequence
  Oligonucleotide
cgagaacgagatgtgcgtcag

SEQ ID NO: 92 - DNA, 19 bp, Artificial Sequence
  Oligonucleotide
gcaggcgtttgcgttcttg

SEQ ID NO: 93 - DNA, 21 bp, Artificial Sequence
  Oligonucleotide
cgaggtccgaaatagcgtagg

SEQ ID NO: 94 - DNA, 21 bp, Artificial Sequence
  Oligonucleotide
ccaaggttcgtgacggtatcg

SEQ ID NO: 95 - DNA, 19 bp, Artificial Sequence
  Oligonucleotide
tgaccccagcaggtatggc

SEQ ID NO: 96 - DNA, 18 bp, Artificial Sequence
  Oligonucleotide
gcaaggtgggctttgaag

SEQ ID NO: 97 - DNA, 18 bp, Artificial Sequence
  Oligonucleotide
tgcgtgggaggataaggc

SEQ ID NO: 98 - DNA, 18 bp, Artificial Sequence
  Oligonucleotide
ttggcactggcgtttatg

SEQ ID NO: 99 - DNA, 20 bp, Artificial Sequence
  Oligonucleotide
acatcgggaacacaggtctc

SEQ ID NO: 100 - DNA, 18 bp, Artificial Sequence
  Oligonucleotide
atgcctacggttcggtgc

SEQ ID NO: 101 - DNA, 18 bp, Artificial Sequence
  Oligonucleotide
aagacagcgtcagccagc

SEQ ID NO: 102 - DNA, 969 bp, Artificial Sequence
  75% sequence identity to SEQ ID NO:1
ctgcgcgcgctcagcgggggacgcgggaacaggatctagtggtcgtggtgctttccctgggattcgctgggcgactttctcaccgtgcacaacggctacagcaccttgactgaagagcggaggggggccaggcgcccattccagggcccccactccgacgtcgccgacattgtggaggccatcgcgggctcgttggtgcaattcctgcgcacgacccttgccttcctggtgctggcccgggatgcttccggtcacctggtgggggagtacctgcgcgtcgagcacggcggcatccggctcctgttcgacgaccggatattggccgacaccgacaccctgatggtgttcgggctggtccttctccccgccgaagtcgtggcccagccggggcagaactcggcgatcggagccagggtggatcgcgtgggctccagcctgctcctcgcccggcagcaggacgacgccggctccgacgtcaagcccgaccgggaggacgattagctgcacctcgggcatcggcacgtccccccgctacatcggttatcggcctacacgggctccctgttcaaggcgctggaccttgccgtgcgcatcacgtcggggctgcttccggcgcccctggccgccaccgctctgatggctcccctgagcaggtttcgcgtcctcgaggcggccgcggtcctgcacgttgtctcgaccctcaacattgaccggcaactcccccacttcgacctcacccgccgggtaagggacggcctaggggagctgcccagcctacgggtggacgcgcgccggccccatcgctatagcgagccggccaactgcgatttctacgggtagttcaggatcccgcggctccccgtacgtggcgctgtcctcgagctggtcgtctccacgatctacaggaggctgatcggcagatccgacagtttcagaatctcctagcacttcctgcccaggatgaagtga

SEQ ID NO: 103 - DNA, 969 bp, Artificial Sequence
  80% sequence identity to SEQ ID NO:1
ctgcccccgcactccggccgagggccgatctgcatgtactggacctcgagcaatgcgtgggattcgcaccgcgagattctgacccaggtcaagcggttctgcaccttgaccgatgtgggcagcgcggcgtcgccccgttacgtgggggccgagtgcgacgaggcgcactttctgcacgccaacgccggcacgttgcagctttaccagcgctggacgctagccttcctggagcaggcgggcgtaggaaccggacaggaggtggccgagttcgagcgcgtcctgcaggccggcaacgggctggtgaacgtcgagccgataatgcccgtcaccgtcaccgtgatcgtgtacgggctcgacgatctcggcggggaagaggagggccaggccggggacatctgggccttccgtccctccctggaacccgtgggcacctccctgcacctgggcccgctccacgtcgtcgccggtaccgacgtcaaggccctgcgggaggacgaaaaccagcaccaggggcatcccctcgagccggggctacaagggattaccgcctactccggctcgcagatcaaggcgctcgtcgttgccctccgctacaggaggcgcgtgcatccgcccggggtggccgggacgggacagttggcacggctgagctgctatccccacctcgacgggcccgggcaggtggacgttgtcaggaccctgaacattctccggcatctcccccacttcgtgcacaccgccccggtaaccgaccggcttcgcgtgcaggccaccgaacccgtcgtcccgcccccgccgcatgccttaaccgtggccggcaactgcgaaatcatcgggttgttctgcatgccggcgcaggccgatcgacccggagagatcgtgctggtcgtctccacctacatcacgtcgctcttcggggggtgcgactgccacagatacttcaggctcaagctgcccacgaagagctga

SEQ ID NO: 104 - DNA, 969 bp, Artificial Sequence
  85% sequence identity to SEQ ID NO:1
ctgcgcccgctcaccgcgggagggcggttcagcatctactggaggtggagctttccgtgggaaacgcagcgggacattctgaccgtggacaagcgctactgcaccttgaccgtagtgcgctgggcgggctggccccgttaccagggccccgactgcgacgacgcccagtttcagcaggggatcgccgccaccatggacctttacctcccctcgacccttgcgtaccaggtgctggccggcgaaggaaccggacaggaggtcgcggtgatccaccgcgtcgtccaggcccgctaccgggtggtgatccacgtgcggaaattggccgactccgacagcctgatcgtgttcggcctgcaccaactcgcgggggaacacgaggccgtgccccgggacatcacggccttccgagcctggctcgaacgcgtgggcaccagccagctgctgcccccgctccacgaggtcggccgcagcgaccacatggcgcagcgccaggtggaatacctgctccacggcgatccggtcctgcggcggcatcaacggttttccgccaagaccggctcgctgatcaaggggctcgacgttcgcgtccgcttcagctggggccagcatccggccggggtgggcgcgaccggacagatggctccgcagacctcctttcgggacctggtcgcgcgccggctgcaggaccatgtcaccacgctgatctttcaccggcttctgccgctctacgagcacaccgccccgcaaacggacggcctacgggtggtgggcaccctacgcctcgacccgggccggcgccatcccattaccgtggcgggcaagagcgaatacaacgggttgatgtggaagccgccgctcgccgtacgagccggagacatggtgcacgtccactcgtccatcttcacgacgcagtgcggcgcgtccgacagcatcagaaacttctggcacatcccggccacgatgaggtga

SEQ ID NO: 105 - DNA, 968 bp, Artificial Sequence
  90% sequence identity to SEQ ID NO:1
gtgcggccgcactccggcggacggcggttcagcttctactggacgtgcagctaaccgtggcaatcgcagcgcgacattgagaccgtggacaaccgcatctcgaccatgaccgaagtgcggagggccgcctggccgcgatacgagggcccccactgggacgacgcccactatctgcagcgcatggccggcaccttcgagctattccaccgctcgacgctagcgttgcaggaggtggccggcgaagcaacgggtcagctggtggcgctgttccaccgcgtcgaccaggcccgcttccggctggtgatcgaccaggggatattggccgtcaccgtcaccctgatggtgttggggctggtccatctggccggggaagacgagcccgagcccggcgtgatctcggccaaccgtgcctggctcgaacccgagggcacctgccagctgcaggccccgcaccaccacgtgggcggcaccgacgacttgggccagcggcaggtcgaattcctgcacgacgggcatccgctcgtgccggggcaacatcggtttaccgcctagacccgctcgctgatgaacgggctcgtcgttcgcgtccgctacaggtggggcctccatccgggccgggtggccgcgtccggtcacatggcaccgctgagctgctttcgggagctggacgcgcccgcgctgctggacgaagtcacgacgctcaactttcacccgcttctgccccactacgagctcacggccccggtaagcgacgggctaggggtgcaggccagccaacgcctcgacccggcccgcccccaaccctttaccgagccgggcaacagcgtattcatcgcgttgatctggaagccgccgcacggcgaacgtgccggtcacatcgtgctcctcgacacgaccaacttcacgaggctgtacggcgggtccgagagccacagaaactctggcactacctggcgacgatgaggtga

SEQ ID NO: 106 - DNA, 1265 bp, Artificial Sequence
  95% sequence identity to SEQ ID NO:1
ctgcgcccgcacaccggcggacggcggatcagcatctactggacgtggtgctatccgtgggaatcgcaccgcgacattcagaccctggacaaccccttctccaccaagaccgaagtgcgcagggcgccctggccccgatacgaggggcccgacagggacgacgcccactttctgcagggcatggccggcaccttggagcatttgcaccgctcgacgcttccgttccaggagctggccggcgaagcaaccggtctgcaggtggcggtgttgcagcgcgtcgaccaggccggctaccgctgcgcccgcacaccggcggacggcggatcagcatctactggacgtggtgctatccgtgggaatcgcaccgcgacattcagaccctggacaaccccttctccaccaagaccgaagtgcgcagggcgccctggccccgatacgaggggcccgacagggacgacgcccactttctgcagggcatggccggcaccttggagcatttgcaccgctcgacgcttccgttccaggagctggccggcgaagcaaccggtctgcaggtggcggtgttgcagcgcgtcgaccaggccggctaccgggtggtgatcgaggagcggatattggccgacacccacaccctgatggtgttcgggctggaccatctccccggggaagacgaggccgtgcccggggagaactcggccatccgtgcgtggctggaacgcgagggcacctgcctgctgctggccccgcaccacgacgtcgccggcaccgacgacatgggccagcggcaggtggaataccagcaccacggggatccgctcgagccgcggcaacaacggttttccgcctacacgcgctcgctgatgaagcggctcgacgttcccgtccgcaacagctggggcctgcatccggcgcgggtggccgcgaccggtcagatggcaccgctgacctgctatcgcgtcctggacgcccccgggctgctggacgatctcacgacgctgaacattcacccgcatctgccgcactacgagcacaccgccccggaaagcgacgggctacgggtgctggccacgcaacgggtcgacccggcgcggccccatccctttaccgaggcgggcaacagcgaatacaacgcgttgatctggatcccgccgcacgccgatcgagccggtgacatcgtggtcgtcgactcgacgaacttcacgacgctgttcggcgggtccgacagcctcagaaacttctggcacaacctggccacgatgaggtga

SEQ ID NO: 107 - DNA, 969 bp, Artificial Sequence
  99% sequence identity to SEQ ID NO:1
ctgcgcccgcacaccggcggacggcggatcagcatctactggacgtggagctatccgtgggaatcgcagcgcgacattcagaccctggacaaccgcttctccaccatgacggaagtgcgcagggcggcctggccccgatacgaggggcccgactgggacgacgcccactttctgcagggcatcgccggcaccttggagcttttccaccgctcgacgcttgcgttccaggagctggccggcgaagctaccggtcagcaggtggcggtgttccagcgcgtcgaccaggccggctaccggctggtgatcgacgagcggatattggccgacaccgacaccctgatggtgttcgggcaggaccatctcgccggggaagacgaggccgagcccggggagatctcggccatccgtgcctggctggaacgcgagggcacctgcctgctgctggccccgcaccacgacgtcggcggcaccgacgacatggcccagcgccaggtcgaatacctgcaccacggggatccgctcgtgccggggcaacaacggttttccgcctacacccgctcgctgatgaaggggctcgacgttcccgtccgcaacaggtggggcctgcatccggcccgggtggccgcgaccggtcagatggctccgctgacctgctttcgcgacctggacgcgcccgggctgctggacgatgtcacgacgctgaactttcacccgcatctgccgcactacgagctcaccgccccggaaagcgacgggctacgggtgctggccacccaaggcgtcgacccggcccggccccatccctttaccgaggcgggcaacagcgaattcaacgcgttgatctgcatgccgccgcacgccgaacgagccggtgacatcgtgctcgtcgactcgaccaacttcacgacgctgttcggcgggtccgacagcctcagaaacttctggcacaacctggccacgatgaggtga

SEQ ID NO: 108 - DNA, 25 bp, Artificial Sequence
  Oligonucleotide
aatcaactccagcagcgcggcctcg

SEQ ID NO: 109 - DNA, 24 bp, Artificial Sequence
  Oligonucleotide
ccgctaattgagagatgcgattgg

SEQ ID NO: 110 - DNA, 200 bp, Mycobacterium paratuberculosis
cagacggtctggccgcccgtgcattcgaagcagcggtgcgtgactgcgccggctaccgggtccgggtgcgcggtgcgcaacgctccaacgtcacctgccgccgctgggtggccatcgaagccgcacccggcgccgacgagcaagcgttggagcccgaagcggtgcggcagctggcgccgcagatgagcgtcacgcctacc

SEQ ID NO: 111 - DNA, 200 bp, Mycobacterium paratuberculosis
acgcgccggacagctgagatgctcgacgacgccgccttcgatgcgatcgtcgcggtgttcagtcaacgggcccgatgcgagatgcaaacgctgtcgggaggcaagtgcccacgggctgcgcgctggcgcattgatttgcacgggtgcgaacaggccattgtgtgcgggcagcacaagaaagcgtggctgcaggaggccct

SEQ ID NO: 112 - DNA, 200 bp, Mycobacterium paratuberculosis
agccaacctctggcgcggcattcaacctcgctgcgcccactgcggaagagtgttcaacagcttccaagacgcggtcaggatcaccgcgatatgagcgccgcactacggctagtcacagatacgggcactggcacgagcgacggcgagctaccgccattgcaacggtacgagatctggatgaagggccgcggcctgtcagc

SEQ ID NO: 113 - DNA, 200 bp, Mycobacterium paratuberculosis
ccgcaccatcaccgactccatgctgacgctgcggcgccttgaacgcgtcactaggcggccggcacacgcggttgcggcactggcgatttcacggttcctcgccgacgaggcgctgggcccgcggtcacgctacacctaccacgtccagttggcagggttcttccgctggctggccaacgaagacggcgcccccaacatca

SEQ ID NO: 114 - DNA, 200 bp, Mycobacterium paratuberculosis
tggcgcagatcccgcgtccgcggctgccgcgcagtgttccgcgacccatcaccactggtcagcttcaagcgctgttggcggtccgaatgcacaagcgcaccagggtgatgatcttgctggcggccttcgccgggctgcgggcccacgagatcgcgaaggtgcgtggccaagacgtcgacccggacgctcggacgctgcac

SEQ ID NO: 115 - DNA, 200 bp, Mycobacterium paratuberculosis
gtggtcggcaagggcggtcatgcggcgacgattccgctgcatccggtgctagttgaagcggctgagacgatgcctcgtcatggttggtggttccccgccaattcccggcgccccgggcagcacgtcctgtctcggggcgtcgtcgatgccatcggcgatgcgatgcgccgggccggcattcccggcggcacggcgcaccg

SEQ ID NO: 116 - DNA, 200 bp, Mycobacterium paratuberculosis
gctaaggcattggtacggaaccactctggtcgccagcggcacggacctgcgcacagcgcagacgctgttgcggcactccaatctggcgtctacggcgatctacacagaggtctatgacgaccggcgaattgaggcgatcgaccggctgacgataccgctgcccggcgaagccgagcgggcgcaggacgaccggctgcggc

SEQ ID NO: 117 - DNA, 200 bp, Mycobacterium paratuberculosis
ggcaggtggatcgttgtaagcagtccatcatccgcctgctgggcggcctggagcccggcgagcacatgtcgcgcacgaagctcagtcaagcactacggtccgacgtccggcctcatatcaacgaggcgatcgacgagctgaccgcgggcggcatgttggtcacggtcatagctggccacggccgccactacaggctcgat

SEQ ID NO: 118 - DNA, 200 bp, Mycobacterium paratuberculosis
gatcggggcggccgctgatgaaaccgagctcgtcgcgccgctcaccgtgcccgcgtccgagttggcctggtcccacgaggacagcgacgctggtgattactcgtggggccgggctgcggaacgcgccagcatcatcgtgctcgcctgtgcggcggtcgctgtcgtgatcggtttgctgacctggctcgccttgcacctac

SEQ ID NO: 119 - DNA, 200 bp, Mycobacterium paratuberculosis
acgaccaggccaagccgacagccggcccgacggccgcgcgtccggtcacgatcgagccggcggcggcgcttcccacggtcaccgcggtgcaggcgccggccgccgcgcctccggcgacggtcacggtcacacccccaccggcgccgcctgcgacggtgactgtgcaagccgcgccggcaccggcgcctacggtggtgaag

SEQ ID NO: 120 - DNA, 200 bp, Mycobacterium paratuberculosis
ccagctcccgcgcttccgccgccgggcggcacgaccgtcttctccatctgcccggacgggcacgagggtgtcgtcggtggccacacttcttgtgcgttcgccgagaacgtccgccgcaccttctacgcctcaggcatggccgacacgttcaccgcgttctcgcccgtcaccggtgacgcgtacgaaatgacgtgcgccgg

SEQ ID NO: 121 - DNA, 200 bp, Mycobacterium paratuberculosis
caggtatccggcctatttcgaggacgggtcgacgaaggtctcgacgcgctgctacggcggcaacaacgccgaagtggtcatctggtagttgatcgatcaccttcgagtacgagggcactgtctacggctcgaacgcgtggaagtcgaacagccgcgaccgccgctactaccgccaaggaggcacggatgggtaagagtct

SEQ ID NO: 122 - DNA, 200 bp, Mycobacterium paratuberculosis
tgaggatcggctcgccgcgatcggcgacgcagccgaagccggcgaagcagaccagaccgaccgaccgatccctgcgcacgtcaaagtcacccgcggtaacccgcggagcaaggtgctgcaggtgcggctgaacccggaggagctggcggcgctggaggcgatcgctgaacggcgcgacctgccggtgtcgacggtggccc

SEQ ID NO: 123 - DNA, 200 bp, Mycobacterium paratuberculosis
gcgagcagctcttgccgctggtggcagaggagttgaatcggtgactaccgatcaccccgaccagccgcggcgggaactcccaaacaccctcgcgggtcacaacctcgtcttcatctacgacgatgacgacgacgattgggatgacgaggatttcgacgcggaccatggcgactgcgcattctgtcttggccgcgaagccg

SEQ ID NO: 124 - DNA, 200 bp, Mycobacterium paratuberculosis
cccaccgcggcgaaagcgaagaccagaacccctactcgaagaccggcgcgcggcccggctcaaccgaatggtacgaaaccgactacgggctgtggctcctcggccacgacgtcggaactaagattgaccctgaaatgagttgaggtcaaacagttctgggcaagaaggcgcgtcgccaagcttgatccgcccatctgtcg

SEQ ID NO: 125 - DNA, 200 bp, Mycobacterium paratuberculosis
cgccgccgatgaacggacccatgggaagtggtttaggtccactaggaagggggccaccgcttcctgcaccgcccagcatggactgctgctgctcaaggggggacttcatcggaccgggcggagccgggggcgctacatgaaccgggccccagcgccaatccgagccgtgcgacggcggcccgtatgcgttcggggacggc

SEQ ID NO: 126 - DNA, 200 bp, Mycobacterium paratuberculosis
gttgggacgggcccgagtggagtcggataccaagtgcggtagaaggagtccgatgcgccttggccgtaccagctcttgtaatccgccggtggcggggcgctatccggcgcgggcggccgggcaagcggtcccagaggtaatccgggcttcgacggagacttcacgaactcgaattcactgcctcccccagcaccagcgcc

SEQ ID NO: 127 - DNA, 200 bp, Mycobacterium paratuberculosis
cgaagatgtcgttggcagccatggagccggccgccgcgatgccgagggggccggcagcagcggcgagtcccgcaccgccggtcctgccgccggacaatgccgcgttggcttcgccggctgccgccgtgacgcggccttcggcggcgacttcggcgtccgcggcggccagcacctcggcttcacctgccatggccgcgggg

SEQ ID NO: 128 - DNA, 200 bp, Mycobacterium paratuberculosis
cccatgttgcgcatcgccgtgctggctgtggtggcctgggtctcgacgctgaacagcttgtccttcaacatgcccagacccgtcccgatcggtgacaggatcgtcgaggcgatgttgtagcccttgatcgccaaccatgccgtgcccattgcacccacaccgacggtcaccgcatccagcaacggcttgtgctcggtgag

SEQ ID NO: 129 - DNA, 200 bp, Mycobacterium paratuberculosis
ccaatgcgccgactccccaagcaccccaacgacttcagtcatcgctggcagaaagtcctggccgatctcgatgcgggctgcgctcaacgcccccttgaagtccttcatcttggcgttgtaggtctcctgggattcggtgaatcccttggtattgcccgcaccgtcggcctgcgcctgactgacctccttgaccgcggcag

SEQ ID NO: 130 - DNA, 200 bp, Mycobacterium paratuberculosis
cggctttgggcccgttctccccgaccaactgcaataccgtccgcagattgtcttggccgccgaccatgagggccagcgcttggatcatcgactggacatcacccttgccggacttgagctgattgttgaagcctgtcaatgctttttcttggttccaccactgctcgacaaggttggcttcctcaacgctcaagccgccg

SEQ ID NO: 131 - DNA, 200 bp, Mycobacterium paratuberculosis
cggtccttgcggaactgcttgtacgcctcagcattgttctggatcgccgtcgcgaccgcctgcgcctgcgcgggcagcttcgagaacatctcattagcgctgtcggccacctgcttgctcttgaaccaggcgtccagcgtgaccatccccgacgggccaagcttcgactggatcgtgtcatacaacaggttcgcggtgcc

SEQ ID NO: 132 - DNA, 200 bp, Mycobacterium paratuberculosis
gatcaggccgcgctccccgaaatgctcctgaatgtcacgggcatccaaaccgagctgtcccatctcctgggacatttgctgggttggcttggccagcgacgtgatcgcgtgcgtcatattctgggtggcctgatcagcacccatacccgactgagtgagcatcgccaacgacgcatacaggtcattgacgctttcaccaa

SEQ ID NO: 133 - DNA, 200 bp, Mycobacterium paratuberculosis
ctccggccgcgaccggctcgacgttgtgcaacgcccccgcgaagtcttgcagcgaaaccttcgacaaccccacggccacattcaatttcgaggtgacgttggcggcctgctcgaccgggatgtggtagtcgtgcatcgtggtcgtgaccgcgctgatcgtctcgcccaggtccgcgccctcttcggacgcaagctgcgct

SEQ ID NO: 134 - DNA, 200 bp, Mycobacterium paratuberculosis
gaagccgtcaacaccttgatcgcatcactgccccgatagccggccttctcgacacccagcgcagcgtccatcagcttttgaggcgcataaccgaccacgctcgacagtttcagcacgccatcgctgatcgccttcagattggccggcgactcctcggccaccgtgtgcagcctctgcaacgactgctggaaattccccgc

SEQ ID NO: 135 - DNA, 200 bp, Mycobacterium paratuberculosis
tcgcgtcggcgcgagcggtgcgcgatgatcgccggtatgcctagcggaattgagcatctacgagcgatgactgaagaggagctcatcgcggcgcacgacaacatcaactccaacagggcccttccctcgagttacttcctcgacgaattacgtcgcagagaagctgagcgcgccgagttagcgagctacaaacttgcagc

SEQ ID NO: 136 - DNA, 200 bp, Mycobacterium paratuberculosis
tgagagccacaacctggcacgacgcgttttttggctgactgtcgtcagcaccgtgttcgctggattcgctgccatcgtcgcgatcatcgctctatttctacggtaaagacccaaccgaaactattgacgatgtctcgtgtttaccggttacccttgacaggtcgcaagggaaacgaggaccatgaacagtgacatcgcgg

SEQ ID NO: 137 - DNA, 200 bp, Mycobacterium paratuberculosis
acatcgccaagtgggcgcgatcgcagggatggacagtttttgacgactcaaagggctacacccggttctacaacccgcaaggcgagtacatcaccaactacccggccacaccgagccgccccaaccgacggatggccgacctgaaagtggacctgaagaaagccggcctgccgatcccaccgccgagcaagaaagaacaa

SEQ ID NO: 138 - DNA, 200 bp, Mycobacterium paratuberculosis
cgcgcacaacgcaagaagggagacacgaagtgacgaaaaccgattgggtcatcacgttcaccttcgacgtcgacccaccgatcgagacgatggacgaatgggagtccaggctcgacggattcgacgcgtcggtcgcgcgcatcccagaccgcggcgtggacctcacggtctacgcacccggcgacctgtccatgttcgac

SEQ ID NO: 139 - DNA, 200 bp, Mycobacterium paratuberculosis
gcactcaacaagacgatcaacgaggtcgcccacgtggtgcagtccgggccgccgatcggcctggaggtcgtcaccgagcgtgagcacacgcgccgcgccgaagctccgagcatgcccgaactgatgtcggcagcagaaatcgccgacgaactcggtgtccgccggcagcgggtgcatcagctgcgcgctacttcggcgtt

SEQ ID NO: 140 - DNA, 200 bp, Mycobacterium paratuberculosis
ccctgccccgctcgcagagttgcgcgggggcgccgtgtgggacgccgccgcggtgcgcaagttcgcccaggattggcaacgcaagcccggccggccgcgaaacagcgccgtcgacagtcagcagagggactacgcgctgggacactgagcggtcggacttcaccggtcaggtttgcgttctgcacacgagcagtcgaact

SEQ ID NO: 141 - DNA, 200 bp, Mycobacterium paratuberculosis
ccctgcggccgagcccaccgagcggtcaagtcgccgtagcagcagaactcgatacgctcgcctgtatcactggtgagcgcgacttcgtgccagtcctcgtagaacgtgcggaagaacgagcgccgaaatgcgagcatcgcaggggacgccccccgctttttcttggaccacccccacccccgagcgaccgccgcgccgtc

SEQ ID NO: 142 - DNA, 200 bp, Mycobacterium paratuberculosis
gcttttttgtgtgtacggagcgaaaaaattcgggggaacccctaatgcgaggcagaaactcgccaggtcggaagtcgctttagggccttcgtcagtccgggatcaaccgtcaccatcgacggcaagcgttgggctgtcgccgccgacatctgcgccgccctcgacatcaggaactcccgcgacgccgtaacacgcctcga

SEQ ID NO: 143 - DNA, 200 bp, Mycobacterium paratuberculosis
cgaagctgatgtcgctaccaccgacatcaggtccggcggccagatccgcaaggtcaccgtggtctccgagaacggcgccaccgatctgatactcgactcccgcaagcccgaggcgcgcaggttccgccgctggctcacccacgaggtatggcccgcgatccgcgacactggctcctattcgacagccccaccgctgacag

SEQ ID NO: 144 - DNA, 200 bp, Mycobacterium paratuberculosis
atcagaacgggacgtgcatgtagtccatgcccgcatcttgcccggcccgggcacgacggcattggttgagtagcgcggtaatcgggtcttggcgaagctgtccggggtgctcgctcatgccgtcgagggcatggtgtgtggccagcgccaccaagcgctggcattggatcgcgtcggagtccacgatgctcagactcctc

SEQ ID NO: 145 - DNA, 200 bp, Mycobacterium paratuberculosis
tcgggaagcgcggcacggtaactgcgccggacgccacgactacgaaatccattgctcagcttcccttctccgttttggggttccggcaccggccaccgcgccaggggacgcgccgacgaggattacgttcccgtcgcaggcagccggtgccgcctgtccgagcgctacccgagaatgacgcacggaccaggtttatggcg

SEQ ID NO: 146 - DNA, 200 bp, Mycobacterium paratuberculosis
ccggcggcatcaccgagcccctcgctggagttgaggacttgcaccgagtcgacgtccggcggaatccctgtgatcgcagcgggtgtcgtgccgactggcaccgtcgtggtgctcatgaccctgccggcgtcccggacggcgcggcacgggccttgcgcgcgcggacagcagcagcgatggtctcgttgccccaggcttgc

SEQ ID NO: 147 - DNA, 200 bp, Mycobacterium paratuberculosis
cccctgtcgcgcagggctttccgcgcggtcggggcgccggcatcggctggcacatcgaaacggtcgagcgcggcgatgcactcgtcgacgagatcggtattggggccggcgactgcatcgctgggcgggggctgtgacagggcggccgcggcgtcgtcggggatctcctcgatgaggcccatgcgtagccagcgatcccg

SEQ ID NO: 148 - DNA, 200 bp, Mycobacterium paratuberculosis
gtagtcagggccaatccacgcaatgatcggaccaaggttgcgggcacccccgacaggtctttggtagtgatgccaaatgatcccgttctggtccttgacggccagcatctcgacgcggggactcattcggtatgccatgtcagtcaccccgcggccggtagtcgggcttggcgcgccactcgatctgaccgccacccagg

SEQ ID NO: 149 - DNA, 200 bp, Mycobacterium paratuberculosis
tcgacgggctcgtagggctcgatgccggtcggctggtagtacccggagcctccgggtgggcgtgggatcccacgcgccgccgccgctgcggcgaaccgggggccgagcccgtacagcagcgcgttatcgcgctcttctttggaccacgtggccggatctttgccgtgcacgatgcgcacaggtggcggcaacggcgcgat

SEQ ID NO: 150 - DNA, 200 bp, Mycobacterium paratuberculosis
cggtatgcccaaatcatcgacgcctggtgacggcggtggcgatgacgcagcgacagtctgcgatgtgggagcagatgccggcggccggatgcccatccgagcaaggactttcgcgtggacatgttcgatctgcgggtcagtagggagcttttcaggcggggccagtcccggcgccaaagccgcgaggatagccctgttgc

SEQ ID NO: 151 - DNA, 200 bp, Mycobacterium paratuberculosis
acgtccggcgaaacccccaccagccgcgcaagttccgcacgcggcacgttgaccatgcccatcacgcgctcctttcagccttgcggcgtttgtagtcctcgatcgatgcggtcgaaatcatgtactgccggccaactttccggtgctcaagatgactctcccggcaaagccaaccgacgctgcccgccttgatcccgagc

SEQ ID NO: 152 - DNA, 200 bp, Mycobacterium paratuberculosis
atctcagcggcttccgcagtgcccacccacgcgtcatgggctgagaatacgaatccagccccgatcgggcgatcccgctcgcttcgaggcgagtgagtaaccgcggcgtacgcctcggcaagcgccgtctgcgccgcaactaacccctccgggacaccgggctgcccaggctgctgcttgagccggatgtaatcaccgag

SEQ ID NO: 153 - DNA, 200 bp, Mycobacterium paratuberculosis
ccagtgcacgaggcaccgcgcaagatccggggtgatctcgatttcgctcacccggactgcatcgaaaatcaccttgtagcgctggcgtaactcgtcgctcatcagcggtccgcgctcttcgcatcggcagcggccgcggcctgccgagctgtccgccgggccgcaatctcatcggcaatccgacgttgcggtggccgtac

SEQ ID NO: 154 - DNA, 200 bp, Mycobacterium paratuberculosis
ccgcgccgcctcgatctgcgccaggacagcggtgaactgccgcaacaacgcggccaaatcacgtttcgacccgcattcatcgatcgccgccgccaggacgtcgcgcaacgccgtcaacgcggtcaacgcatcaccggacttcgccgccttagaaaccgaattacgcggtgttacaacgtgactcgtagttccagcattac

SEQ ID NO: 155 - DNA, 200 bp, Mycobacterium paratuberculosis
gcctgaccatcagtcaatcatccccttgacgtgtggaaatctgccaggggagagaaacaagcgacccggcggcggtcgccgaggggccccctcccctcaagaaaatcggcgggtggggtcgacgtgtgctcctcgggcattacacgtcggtgcttgggcgtgggtccgatcgcaggcgcgcaccgttggtcggcggtggc

SEQ ID NO: 156 - DNA, 200 bp, Mycobacterium paratuberculosis
tctgtgttcttctcggcgtgggtcgttgtgtctggtgtcgcgggtgaccggtcgtggccggtagctgttcatgagggctgtccctctccggcggcgagcagcacggtggccaggtctgcggtgactgcgtcgatggcggcttctcggctgccgtgctcgtattcgtaggcgttggcggctgctgcggtcaggaagccgag

SEQ ID NO: 157 - DNA, 200 bp, Mycobacterium paratuberculosis
gacgccggcggtgactttctcgccggcggcgatgatgcgctcgatctcggtcgtgaggcgtccgtcgttgacgaggccggccaggagcacgccgagtgctgtggcgtagagggcggccagtgcctggtcatcagagggcgtggggttgtcggtggtcatggtgtgcctttcgggttggggtggatggggtgttgctttct

SEQ ID NO: 158 - DNA, 200 bp, Mycobacterium paratuberculosis
gggtcggccgcgctgttgggtgcggagctggcccgctacgacgccgtgcggccggtgtctggcgggtagggcgttgaaccatgcgcggcagcggtcggcggccggacaccgcgaacacaggccgaggacctgggcgtggcgctgctcaacgacttcgggggcctcgttcggtgctgcttcgtcgaacaggtgatgccggc

SEQ ID NO: 159 - DNA, 200 bp, Mycobacterium paratuberculosis
cgcggcatctggcacctggcaacgacggtgcagcggccagcgcttcgaggaggtggtgcagcgcggtcatcgggtggctcggttcaacggggtcgtccctccgggatcgggttttcttgactgttttccgactgcgtcccgcgaccgcgtcctgcgtcccccctacggggggtgggacgcagtcggacgcagtcgcagtc

SEQ ID NO: 160 - DNA, 200 bp, Mycobacterium paratuberculosis
cgcttgaacgccactgcgtccggacgcggtgggacgcagtcggacgcagtcacgtgctgtccccatcggcgtcctccacaacggccctgaaccccttggcgccacgcttgcctgatatctctacgagacggcctgacaccacaaggtcatcgacgacgtcgcgcacatcgtcgtcacggaactggatgtcgacgttgcgt

SEQ ID NO: 161 - DNA, 200 bp, Mycobacterium paratuberculosis
aactcagcgaacaacagccgcatcgacccaacagcgtggtcgggagccgcagcaacgacgcgaaagacagcgtcagccagctcggcgttcggatcgctctcaggcacgtcgtcgtccctgggcgcgaagaaccgcatcgtgaagtcaggaccgaacgcctgcgagtcatcgacgaccagagttcccatgaacgtcttgcc

SEQ ID NO: 162 - DNA, 200 bp, Mycobacterium paratuberculosis
gggcgacttcgttgcgcgcccgttggcccgtagatgcccggggcggtctttggtcacgaagacgtaggagacgccgcgcagccgccggccgaacggcgccgagttctcgagcacgaaccgagccccgtcgagcgcgttgcccttatgcaccgaaccgtaggcatcgcggcggctgccgtcgcgcaccatcgggaggtggt

SEQ ID NO: 163 - DNA, 200 bp, Mycobacterium paratuberculosis
cgcacgccagcgtggccgcgccgacacgtaggcatggcaggatcagtcggcggcgaaacgccgcggcgccctcgacggccttgatctcgtcgccgtgcagcgccatcgcttcgttgacgccgtcgtggatgaccagcgtcggtgaagggtcaagtagtgcgttcagccactcctcacggacggggcggctgggagcgacg

SEQ ID NO: 164 - DNA, 200 bp, Mycobacterium paratuberculosis
aaccgaaaccgggccttgatcaccgcggggtcgaccccaagcaagcacagcttctcgacggtgctcgtcgcgtcgggttcttcgtagtggatatacacgacgtcgttgccggcgttgagttctgcggcggcgcagcccaacgcgaaccaggttttaccgctttcggtttcaccgactatggcgtgctcgcgaccagggta

SEQ ID NO: 165 - DNA, 200 bp, Mycobacterium paratuberculosis
gagcgaccgctgcccgtcggagcgtgatatgccgataccgggatgtgggcgttcgatttcgccgcgcaggtagggtccgagatcgaacgcctcccacgtggtcggctcggcgcttgcctgctgctgtcgttggccgtttcgctgcggtggttcgtccggcggttcccacgggggaacatcggcccattgcgcggcgaaat

SEQ ID NO: 166 - DNA, 200 bp, Mycobacterium paratuberculosis
cggcagcggttagcatcgaggagccttgcgccgcaaccatggccgctgccgatggatatcctcgtggtcccggttccgtcgcccgatgcgagtccagtccgccgcagccgaaaccgcctgggacgcttcagccatggccgtttgagctgtctcgacgcgcaggacatgatgctcccccgcgacagctaaggcgagcaact

SEQ ID NO: 167 - DNA, 200 bp, Mycobacterium paratuberculosis
tccgcggatcgccatcagccagtgccgaccaggccggtgtgcccgccggcggcaaggggccggtattcgcctgcgtgattagcgcttcgatgaactgatgagtttcccaccacgacacttgccgggaattggttgtacccggcgtttctgccgacggtgcagtaagctcagtcgtgcggttgtaggcggttgcgtggctg

SEQ ID NO: 168 - DNA, 200 bp, Mycobacterium paratuberculosis
ccgaccttgctggttgagggtcggtcccggtggtgcggggctcggccctcgacttctatcggtggaccgtttcggttctgcgtcacgacgcgccaccgaacggcttcatcgccgcgtcgagctcattaagatcgacacgcactagccggttgccgctgcgatagccggccaggcgcccgtccgcgatcatttggcggaca

SEQ ID NO: 169 - DNA, 200 bp, Mycobacterium paratuberculosis
gtgcgatcggtgacgcctaggtactcggctgcctgttgaagcgatgcccatctgcgcgcttggcgggccggagaaatagtggacgacgaaggcacgacgaaacaaaacctttcggagtgtttcggttgccgaagccgagtcccgatctagcgatccgggttccgcgcaccgcggggcttgaccggcagcctacacggaag

SEQ ID NO: 170 - DNA, 200 bp, Mycobacterium paratuberculosis
tgccccgaaatatacggaacgtgcgccgctttgcgtgtgtggtcggaatcagttgaccgcgcatcgcggcaaccgtggtcgcgggatcgggtagtgcaacggtgccgtgatccgggcagacgatatagccgatccactcaagaggcattgcgaccgacgggtccgcatgccgtctcgagacgcgccgggtcttatcgacc

SEQ ID NO: 171 - DNA, 200 bp, Mycobacterium paratuberculosis
gaacggatagtcagggagtccacttcacgctgccggcgctggatgtgctcggctagagttatcccgctcgcgtcatatagttctgttgccggcggcaggccgagcgctgcgagacgttcgtcgtctatgggctcgtagtgcggcacggtggtcttgccggacttgtggtgcatgagcgcgatagcgacaccgggatccgt

SEQ ID NO: 172 - DNA, 200 bp, Mycobacterium paratuberculosis
tttgtcggatttgacgatgccgacgcatattccgcaaccgccaatcccgcaccgcagcaccagtgttggcggcatcgcggcattcgtgagccaccactcgcgctgctcaggcaaaaggtagtcgaggttgtcatcggccatcaggccccccggttctcggcgatcttcgacagcagcgctgcaatctgtttgtcgcggcc

SEQ ID NO: 173 - DNA, 200 bp, Mycobacterium paratuberculosis
ttgcgcggcgtgctggtagcgcatcgctgcctgtggcgtcgaatggcctagccgggccatgagttcggcgaggctggcgccggtggcggcggccaggactgcgccggagtgccgtaggtcgtgccaacgcaaatcgtcgcggccggctgcggcccgcgctttgtaccccaatgccggttgagggtagacggttgcagatg

SEQ ID NO: 174 - DNA, 200 bp, Mycobacterium paratuberculosis
cctgccgcgctcgttcggaaatagcagtgaatcgcgcttcttgccaacatatttcgctaggtgtgcttcgatggccgatacgaggtgcggtgggattgcgacgtcgcggataccggcgtcagatttaggcgtggtgacttcgaatgtgccgccatgtgtgcgtaccgctgcgcggcgaatccgaatcacttcatcggcca

SEQ ID NO: 175 - DNA, 200 bp, Mycobacterium paratuberculosis
gatcgatatcgccgcgctgcaattcgatcgtctcgccgaatcggagtgcgcaccaactcgcgagtgcgaccatgagccggagacgctcgggcattgcttcggtaaggatcgggagttcctcgactgtcgcgggccggatcttgtggacgcgcttggcccgtccggcacccacgatgcggcacgggttggcgtcgatcagc

SEQ ID NO: 176 - DNA, 200 bp, Mycobacterium paratuberculosis
tcgtcgttgaccgcgctacccatgatggtgcgcaacaggctgtaggcgtggctgcgcatcgtgggtcggtttgtcagagtgcctgagtaccattcgcggacatctttcggggtgatcgaggtgagctgacgactcccaaacgctggcaagagatggtcatcgaggatggcttgatagtgctctcgcgtgcgggccttgat

SEQ ID NO: 177 - DNA, 200 bp, Mycobacterium paratuberculosis
agcggacctgaaaccgccctgagggcaactttctgatgttcccgaatgcacgcttatcccgtttcgcgtcggcatcacgtgccagactgcgtgccaattcagaccgcctcaatcgggtcgaatgggatgaacccagtaccccattccgtgccaaatacgtgccacatgagcatacggcatgttccgcttgcttccgcttg

SEQ ID NO: 178 - DNA, 200 bp, Mycobacterium paratuberculosis
ttggctgctggacggccgggtcggccgccagtggtgggccggggtggccatcgggttgacgctcaccctcaagccggtgctggggccgctgctgctgctgccgctgctgaaccggcagtggcgggcgctggtgcccgcgttcgcgatcccgatcctcatcaacgcggcggcgtggccgttggtcagcgacccgatggact

SEQ ID NO: 179 - DNA, 200 bp, Mycobacterium paratuberculosis
cgctcgccggtggcgaccagcacgccggagcagtcgggaaacgcggtgtcgcccggcaccgcgagcgccagcaccaccgacgacgcggcgacgacgcggccggcggcggcggcgctgcgcggggcgatcccggccagcagccgcgcgacctcccgcgccggcacggccaggatcaccgcgtcggcgtgccggcgggcacc

SEQ ID NO: 180 - DNA, 200 bp, Mycobacterium paratuberculosis
ccggcagagcgagaatccgccggtggactccgaaccgccgaacggaccgccgccgccggcgcggtggagccggcgcaaaccggaggcggccgcgcggctggaggccgcgcgcgcggcgctggccgaggtgtccgaacgcgtgcacgtccccaccgagaacctggtcgcgccggacctagtgcgacggctgtgctgggact

SEQ ID NO: 181 - DNA, 200 bp, Mycobacterium paratuberculosis
cgggtgagccggcgcagatacccttgggcccccatggccactcctgacaatgctgataagcctcgacgcttccatttatgccaacggacaccgtagacctcttggttcccccgcgccaaccgactcaaacaccccggttggagccccggtgaacgccggggcactatcaaggggtggtggtcgatctgcgcggcgtcagg

SEQ ID NO: 182 - DNA, 200 bp, Mycobacterium paratuberculosis
cgcgcggtcgcggcgttaaggtgggcggacagcccagtgacgccgaggagattcgatgaccagcaccgactcgaccgcgcacacccccgccgccccggccgccggcccgccgccgcggcgcggcttcggcgtcgacgtcggcggcagcggcatcaagggcggcatcgtcgatatggacaccgggctgctgatcggcgagc

SEQ ID NO: 183 - DNA, 200 bp, Mycobacterium paratuberculosis
gcgggcagggtggcgatcagccggcgcagcggccccgggtcgcgggccggcaagccgatctcggcccgcgccgcggcgcgctgccgcagcccggcccgccaggagcgcgcggtcagcgcgcgcatggtggcgtcgcgcagccggccccgcaggccggtacccggggccagcccgctgccgatcggcggcaaccccttgga

SEQ ID NO: 184 - DNA, 200 bp, Mycobacterium paratuberculosis
aggaggagccgggcaatctgaccccgcccggcgacgatgcgcgccgtgcggccgcgtcaggcgaccgcacgcagcgccagagccagatccccgcggtcggcgacgctgagcccgcccagccccagccaggacgccatggaccacaactcaccggccagcaccgcggcgacccggggccgcggcgcctgcggctcggcgaa

SEQ ID NO: 185 - DNA, 200 bp, Mycobacterium paratuberculosis
ggcgccgaggacgcgcagcgtgccctcggcccggtcggccttcaggtcgacgcgggccgccagccgcccgtccatcagcagcggccacacgtagtagccgtaccggcgcttggcggccggcgtgtaaatctcgatgcggtaatggaattcgaagagccgctcgacgcggggccggaagaagatcagcgggtcgaatgggc

SEQ ID NO: 186 - DNA, 200 bp, Mycobacterium paratuberculosis
acagcagcgcggtgccgcggtccgtgcgcggcacggcgcggccggcccgcaggtaggccggcgccggccagccggccacctcgacccgttccaggtcgccggcggccaccagctcggcgatcgccggcttgacctgcgcggcggacagccggaagtagtcgcgaatgtcggcctcggtgcccacccccagcgcaccggcg

SEQ ID NO: 187 - DNA, 200 bp, Mycobacterium paratuberculosis
gcccgcagcgtcagctcccggatcgcctcgtcgtcgtcgacccggcgggccagcacgtcggccggcagcacccgttccaccaggtcgtagtggcgggcgaagccgacccgggtggcggtggtgagcactccggcggcgaacagcgcctcggcgacccacttggtgtcgctgcggttccaccaggcgcccttcctgcggcg

SEQ ID NO: 188 - DNA, 200 bp, Mycobacterium paratuberculosis
cggctcggccgccagatgcgcctcgatctggccggccgtgctgggcccgagctcggcgacggcggccacgaccgcgtcggcgagccgcggattggcctgcacgatgtgggttccccaccggccgtgccggtactgacgcatccgccagcgcagcaacggccaatcctcgacggccatcagcgcggcctcatgcgcccagt

SEQ ID NO: 189 - DNA, 200 bp, Mycobacterium paratuberculosis
actcgaccagcagccgcgacgagcgcgggccccacgcggcgcggtcgagcacctcgcggtcatacgggccgagccggctgaacaccggagcgtagtgggcacgcaccgtcaccgacaccgaatccaattgcagcacttggattttggatatcagccggttcaggtgcgcgcgggtgacggcacccgcgggccggggctcg

SEQ ID NO: 190 - DNA, 200 bp, Mycobacterium paratuberculosis
gcgtcggcgtacccgggcggcgggtagtgcggcgacggcaggatggtgggctgatagctgacgtaaacgtagtgggcgccctgcttttcggcggccgagcgggcggcggccgcggccggcgggaagccggccaccaccagggcgtcgcattcccgggcggcggccgccgcgtcgaactgggcggcgatgagcccgtccag

SEQ ID NO: 191 - DNA, 200 bp, Mycobacterium paratuberculosis
cgagtccggcgacggcgccgagacaacggtggacctgggcagccccgccgcccgggcgatctgggtgacggcataactcgcctgttgagccctcgcgctttcgcgcctcgcgccccgcgcctcgcgccgcgcctctccccccgccgagcgtgcactggttgcgattccgccgccgttttttcgcgcgccgcgcacgttcg

SEQ ID NO: 192 - DNA, 200 bp, Mycobacterium paratuberculosis
cgcgccagccgcaccgccgcgctgcccgggacggccaccgccgccgccaccggggcggccgcggaaaccaccgccaccaccgggcgaggcgccgacgccgccgccgcggtagttgccgccgccgccgtcacgaccgccgggcccaccgggccggccgccgccgggccgcggggctccgggccgcgccgggcggcccgggc

SEQ ID NO: 193 - DNA, 200 bp, Mycobacterium paratuberculosis
gcgcccgggcggggcggttgccccggggcgggcggcttgggctgcccgggagccggcgccgacggccgcgcggccgcgggccccggtcgggccggggcctcgggcgtggcctgcgcggccggggtggtcgcggtgccgccgggctgggcgggcggcgcggccgcctcgccgttgccgccggccttgatcgcgttgtccag

SEQ ID NO: 194 - DNA, 200 bp, Mycobacterium paratuberculosis
cggcctcccactcggccgaggcgatggggtgcccggagttggcgacctcgagggcggccagttcgtcgcggtgggcgtcgacggcggcggcgaaggcccgcagcccggcggcccggtcggccggggcgagccgggcccaccgccgctgggccgcccgcgcccggtccaccgcgtcgtcgacggcggcggcgtcggcgtgc

SEQ ID NO: 195 - DNA, 200 bp, Mycobacterium paratuberculosis
cgccgtaatacgccacgtacagcccgaccagcaccagcaccgcgccgctgatccggtcgacgaacggcagcatccgccgcagccggtcggccgtcgccgcgccggccgtcgccgcggcgacggccggcacccccaccaccagcgtcaggcccgcgacgtagccgaggtagaccgcggcgccggtcagcagcgagccactg

SEQ ID NO: 196 - DNA, 200 bp, Mycobacterium paratuberculosis
ggttcaccgcccggccccgcctgctatcccttctcgaaggccagctacccgccttcggcggcgagctgtccgcaggcccaggcccgatcgcctgcgctccagctacccgccttcggcggccagctgtccgcaggcggcgctgatctcgcggccgcgggtgtcgcgcaccgtgcaggacaccccggcggcgcgcacccgcc

SEQ ID NO: 197 - DNA, 200 bp, Mycobacterium paratuberculosis
cgtgacgacctgacccgggagggccaggcgcagcaggacaaggccgaagcgcagcgcgacgcggcgaagaaggaagccgaggccgaggccgcccgcggcggcgccgaggccgccgaggagcgccagagggccaaccagtagctcgctggaaaagatgggtccggtccgtgaaaatgggccgggcccatcgcttttctggg

SEQ ID NO: 198 - DNA, 200 bp, Mycobacterium paratuberculosis
cgacgaacaccaccgtggacgtggcgtccactggcggaaggcacgtattcgaagggtgcgctattcgtcgcgtcaacatctgagtccgggttgagccgtggattggcatgcctggaggtaggcggcccagctgctctgggcgtactgcgcccactggtaggccgttgtcgggtgtatcccaaagagttctgcaacgactg

SEQ ID NO: 199 - DNA, 200 bp, Mycobacterium paratuberculosis
gtggtggaagtgtggcggcgttggtgatcatggcggtgttgcgtgcgtggatgaccggcagtccgtgtttcgtcagccgttgctgcagggagcgcgggtttacgggcctgctcggcggccggcctgccaataggtaggcgggattgtctgcagacccgttgcgcagcagcgtgtttaccgggcctcgtgcgatgagttgt

SEQ ID NO: 200 - DNA, 200 bp, Mycobacterium paratuberculosis
tcgatgaggcgggccagggttggtggtagcaggaccgggtggcggccgatggtgagatatgagccgtcatcgtcggtgtgataccggtcggtggtcagttcggcgatgcgcaccaggggtggggcgtagagcctgatcaacgctccgaccacgcgaacatcgagcgggagtgtgtcatcggtgaggcaccgcttgagttg

SEQ ID NO: 201 - DNA, 200 bp, Mycobacterium paratuberculosis
ctgttcgagttcgtcgtcggagagcaggcgcgacgggagctgggatcggcgttggggaacgacgagctctgcttgtgtcaggcgctgcttttccagccagccgatgaatgcggccaggtatttgtgtttggtgggatgggcgtccagccagcggtccaggtgaagttgggtgacggagtccagcgggatttcctggtcat

SEQ ID NO: 202 - DNA, 200 bp, Mycobacterium paratuberculosis
cgagccaggtcaagaatgcgatggtggtgctgatcttttggcgatcgttggctgctgagccgatggtgtagcggcgtcgtgcggcgcgttttctcgcgtcacggatgacgcgccattcggcgaacggtcggacgacacgggattgatgcggtggaaggtgttgaattttgcggctcgcccagatctgcagttgcgcgaac

SEQ ID NO: 203 - DNA, 200 bp, Mycobacterium paratuberculosis
tcttcttggcgcgacgtcaggatcccggtagtgaccaaaagttggcggatatagcgggtggcgttgtcctggtcgagttcatcgaggagctcatgggagatcgcgcggcgctcagcgactagctgcgcgagcagtcgggcagacgaacttgcttgcagccaggtctgcaccgattcgggattggccgccgaaagagcatc

SEQ ID NO: 204 - DNA, 200 bp, Mycobacterium paratuberculosis
cgccaacggctgcagctgcggcaccaccgtaccgtcgtcgaggctgagtaggacgttgacgcggtcagtcattacgcagcacgtgcacttcccgtcggcgtagttcaggccctctatcccgcatgtcctgcaggaaaagtcgaggtccaccccgcagcacggggcgcagatgtcctggccgtccgggttgcggccaacca

SEQ ID NO: 205 - DNA, 200 bp, Mycobacterium paratuberculosis
tcaccgcggtgcgatgacagttagcgcaaggttgcgggtgcaggcgtcgacggtgatagcagtcccggcatacggtccctaatggccatgtggcgcaagcaatccctggcttttcgcagctgtcgcagtgccgcgggtggtgcggccagcaggtaacgcagtgcaacgaccctccgcgatatttaccgccggcgcgggtt

SEQ ID NO: 206 - DNA, 200 bp, Mycobacterium paratuberculosis
cgcccgcagaccacacactcgccgatgttgcggtagcaccgcacgcaggtatcggggtgcgtgtcggtggcgcgagcctggatctgcgcgatctcgccgcatacaccacatttccttgctggtgatcggtagcaggtccgacagatcgggccgtctgcggtctgggcgtggacccggcgcacattgccgcagcggcaaca

SEQ ID NO: 207 - DNA, 200 bp, Mycobacterium paratuberculosis
cgattgtgtgggcggcaggctgcacctttggcagagcacagtgccgtcgtcgcggcgagcattgggcgggcgtttccgtccgcagccggcgcatacctgaaggaactgggggtctttgttgtagcagcgacgacaaaccgggccgtctgcacgacgagcgatgatgtatccgtcttcgccgcagcgcgcgcatggccgta

SEQ ID NO: 208 - DNA, 200 bp, Mycobacterium paratuberculosis
gttcggtgcggatcacacaccagggacagcagcgcccctcggggctgtttcgccgcagcgccagatcggtgcgaccgcatttcgcgcatcccagcagactgaccgcgtccgcgtgcccggccgcggcaagcaaggtcaacaggcggggaaaggctgccgggcactcatgagtgggcgcggtgaaggcgcccggattctcg

SEQ ID NO: 209 - DNA, 200 bp, Mycobacterium paratuberculosis
ccgagatattcgtgaaggtgccgggcgttggccgtggaccatcctttggcttccactagcagctgctgtgctcgctgccgggtcatgcccgaaccgacagcgctgatcaccgacgacaccaaagactcgcgcacgtgcgcgatcggcgccgtcgagtgtggccgtgtcatgacttgccaggccgtcgtacgactgttttt

SEQ ID NO: 210 - DNA, 200 bp, Mycobacterium paratuberculosis
ctgggcgtgaccgccggcgcaccactccccccccgcgccggcggtcttgcggacgggtttgttgacgacctcgaggacgatgaggtcattgggtgtgcatccgaggatgtcgcacaacgccaccaacgtgtccatgctcaagcgctgaggaggctgtgtcaccaatcgaaaaacctgctcgcgtgagagcgtgatcccgc

SEQ ID NO: 211 - DNA, 200 bp, Mycobacterium paratuberculosis
gctccaccaggtgcggaatcagatcagtggtcttaaacatctgctgatcggccatcaagtcacgcagccgccagcgataacccatcttcttgatcatgtcggtgctccatcccagtggtcgccgagacggcccatcagcgaggccttcagcagcttgttgcggtattcattagagacatgggtgtagatcgacgtcgtcg

SEQ ID NO: 212 - DNA, 200 bp, Mycobacterium paratuberculosis
aagcatgcgcatgacccacctgttcctggacaaaccttgcgggataaccgaattcggtccagtgcgttactgcagagtggcgaaggcaatgcagattcagtgaacggtctaacctcgcgtcgtcacgagcggccacaaacgcttcgttgatcgatcgtggagatagccggcccccgcgctcggtcacccacagcgccggg

SEQ ID NO: 213 - DNA, 200 bp, Mycobacterium paratuberculosis
tggcgatccggcggtgaaaaccgtggacggatctcggtgagccactggtccaatgtctcgaccacccagtccatctcggggacgagcagcacagtgcgccgcttaggcggtgctcccttcggggccttgccgtagcggaccatcaccaccccgaagccaccgaattgtggtgcttggctgttacggcgcagatcgaccag

SEQ ID NO: 214 - DNA, 200 bp, Mycobacterium paratuberculosis
gtccagccgagacgcctcggttctgcgaaggccaaaggcgtagatagttttcaaaaccgcggcatcccgcgcggctcccaacgcgcccttcacgccgcgaccctggattgtgcctgagcgggcatccgctgcgtcaaagagcgcttggatctcgtcatagctaagcgggcgacgccggggatcaccctcgtagtccagct

SEQ ID NO: 215 - DNA, 200 bp, Mycobacterium paratuberculosis
tgtgctgaatcgaattgccctcatggaagatcgcctgcgggacatcgccgaactgatcggcacacacaccggcccagccgtagcggggatccagcaagtactccataaacaggctgatatcgatctcgtaggacctcgccgtcgacaccgcctccaccgtcgtcgaccgcaagtgatcgatgaacgcctcgccgtcggcc

SEQ ID NO: 216 - DNA, 200 bp, Mycobacterium paratuberculosis
ggcgcccattgccacggatacagcccgctgaacgcttccagccggcgaatcaaccgcagcctggcgccgatcgtgcccgctcgcaggaaacgcgctgattgctggcggcgccagccctccaacatcgcctcgaacaccgccgcagcctgatcgaggtgaaccacgttctgcgccaacaccagatgcgccgaaccaggcgc

SEQ ID NO: 217 - DNA, 200 bp, Mycobacterium paratuberculosis
cgataacgtcaccgctctgttgtatcagatgcaatgacgatgcgttggaagtgacatggctgatcacggccccaacgctccgatcccggaatccaccaccggtctccaccacctagcactacgctgatcccgcaacagtcccgaaatgttgcatccaatgcaattccgcgcatttgtcgcaggcgatgatgtcgagttct

SEQ ID NO: 218 - DNA, 200 bp, Mycobacterium paratuberculosis
ggtgtccatcaccatcgacgtgcgcgcggtgtgcagccattccagcatcgagggcaccagcggcgccttggatatcgccgccgaggccgccgtcgccgccacggccggcacccgcaccggccgcccgcccagcgccttggccacgtcggccaccgtcaccaccccgtcgccggcgatgttgtacgcccccgggggcgccg

SEQ ID NO: 219 - DNA, 200 bp, Mycobacterium paratuberculosis
aaccacaaataggcggtcagtgcgtcaacctggaccgttcgccggcgaattcaggccgcggttgactcgtcgccaccgattgtttgcccgaccgcgggcccgaccgcctaaccgaagaacgcggcggcgtcgtcgtagcggctttcgggcaccagcttgagctgacgcaccgcgtcggccagcggcacccgtccgatgtc

SEQ ID NO: 220 - DNA, 200 bp, Mycobacterium paratuberculosis
cggtcaacactttccgcacgctgatcccacattcggcgaaccaggcattagcgcgtgtccagaactcggcggcggtttctttgatctcatcgtcgagtacctcgctgtaggccagccgggaatatccatcgatggcggtgtggagatagtgatatccccgtattgggttgcggtgcttgctgaacaccccgctgctcttg

SEQ ID NO: 221 - DNA, 200 bp, Mycobacterium paratuberculosis
cgtcgagggatgtatccccagcagatacccgatgcgcgctggtccccaccggcggatcacccggactttgatgatgcgccgctcggtgcgcgtgggcgtgcggttggggctgtgatgcggtcgtgagctgcggtcggccattccggcctcgcccagctcgcggtagcgcctggcccagcgctctgcggtggttaccgaga

SEQ ID NO: 222 - DNA, 200 bp, Mycobacterium paratuberculosis
cgtcgccgaacgggcgggacaaccagtcgatcgcgttcttgatgaccgccgggatgctgccgttgtactcgggggtgaccaccagcgcggcgtcggcgtcggccgccgcggcgcgcagcgcggccaccggggccagcggcggcgcgtcgctggtcatcgcgtcgtcgatctcctcgttgtagaacggcagctcgccgagc

SEQ ID NO: 223 - DNA, 200 bp, Mycobacterium paratuberculosis
tctagcagctcagtgagctagccgccgggcaaccgccaaacgcggcttccagcggctaactccatttaattcggccgattgtttgaccagtcggatcgattctgcgttggccgacgtggcgccgcaaacgggtttgcaccatgcacttatttgcgttgtgccactcaatcaaagccgcgtcccatcctgggcaaattatt

SEQ ID NO: 224 - DNA, 200 bp, Mycobacterium paratuberculosis
aatttagccgcgctgcatgtgcgtcatttcagctacgccgccggagctggaacctgttgtgctgcagcgattaactctgcactcatgctgccatcgagccgctattgaaatcagaatttgggtctttacgcatgtctaataggcgctataacattgcttcgtcgggcaaactacatgccgagtatgccctggatgggaag

SEQ ID NO: 225 - DNA, 200 bp, Mycobacterium paratuberculosis
gatctgaatatgaattcaattggggtaaaacagctccttaaagttgccgcagcggccacaggatttaccgtgatgctgttcgtcccgaccggatgtttggagaccacaggagccgccacaggcgggacgaccggcggcggcctctgcattcccctgctgacctgctgaccaaccaagacccgcggcccgccggatcccct

SEQ ID NO: 226 - DNA, 200 bp, Mycobacterium paratuberculosis
caacccggacagcgcgacgcacgccggcgggggttcgacgtcacgacggtcacggccgccagcagcacggcaatggttgcggcgggccgcaatacggtgcccgccgcgaccgcgatcagggccgcggccgccgcgacggccgccgattccggccggccgccggcggccaatcccaccatgagcagaccgaacccgggcgc

SEQ ID NO: 227 - DNA, 200 bp, Mycobacterium paratuberculosis
gcgacgaccatcaacagcatcgcgaccgtgccggcgagcaggatgcccaacgtgtcctgcgacccgtcgcgcgggcgctgcgggtgctgcggcggcggcgccgggggtgccgccgggtgcggtggcggcgacgcaccggtgccgggcggcggggcgggcgagagcccgtgcgacgcgaacagccgggccagcagcatcac

SEQ ID NO: 228 - DNA, 200 bp, Mycobacterium paratuberculosis
ccacgtacggtgtgccgcaccgcgccacaccgatgttgcgcgccgctgcgccggcgttgcggctcagcggtatgacggtcacccggccggcggcggcgatgcggctggcggcggcgaccgagtcgtcgcgggatgcgttgtccaccacgatgatcgggcactcggtggtgtccagcaggcgggtcagcgtgccggtcagc

SEQ ID NO: 229 - DNA, 200 bp, Mycobacterium paratuberculosis
ggcccggaccagcgcgtgcaccgtgtagggcgtccgcgccaacaggctgctcagcaggaacggccccaggaaaccggtcgccccggtcagcaggatgtcggtgggcgtgcccgcgcgggcgggcgccgggtcgggcagcggcagcgccgcgtcggcgcgcatctgggcggcctcgtgcgcctcgtactcggcggaaatct

SEQ ID NO: 230 - DNA, 200 bp, Mycobacterium paratuberculosis
acgtggggcgcaagctcggtgagaaggtcgtcgcggcgaccaccgcggggcatgccgaggcggtgatgtgggcccgggaacgcttcggaaccgaggtggtgtgggcgatcgaggattgccggcatttgtcggcccggttggagcgtgacttgatgggctttggccagtcggtggtgcgggtgccgccgaagttgatggcc

SEQ ID NO: 231 - DNA, 200 bp, Mycobacterium paratuberculosis
gcacgaactcgatcccgaccacgcacctaaggctggttcgctggatctggccaagcatcgccgcatcctgggtgactggctggtcacggtgcccggcctggtcgccgaactcgcccgtgacgagctggccgacatcacccggctcaccgagaccatcaacgcgttggccaaacggattggcgagcgtgtccgcgttgtgg

SEQ ID NO: 232 - DNA, 200 bp, Mycobacterium paratuberculosis
atggccacggatcctggtgacttcgggtccgtggccatctggggaaaaccgggctggtgcttaccttgccttcggcgggcccccgactcgtacggacgcgtcggtcgcggcggcggcgcgatgcttacgcgcgggcgccagggcggcggcgtgcgcggcgggaaggccggccgcggacagggcgggacgggtcgcgcaag

SEQ ID NO: 233 - DNA, 200 bp, Mycobacterium paratuberculosis
gctgggcgctgatcgacaaggcgctggggctggacgttcccgagcccgccgagacctactccaattcgccgcacctgtacgaagagctgggcatcccggccggtgccgggggccgggtgggcgccgcccgcaagccgcagggcccgcgccgcagcgccgagcgtgcgaccggaaagccggaccagaagtcggagacagcc

SEQ ID NO: 234 - DNA, 200 bp, Mycobacterium paratuberculosis
cgagcttctgcttccagggcaccgtgtgcagcgcgggccgcacccgcggaccgggaccggcatcacgcctcggcgtcaggccgcgccacggggcgaaatcccgtgcgtccacgccgctctgtcatggcattacctcgcgccggtcggttcgccggaggaaaccgcttagacgacccacgggaaccgtcaccgaaacggtc

SEQ ID NO: 235 - DNA, 200 bp, Mycobacterium paratuberculosis
gcaggaacaggtcgagcatgccgccagtgtggcgggcgggggtgacaggtggcgccgctagcgatcgccgctaggagcctgctgaattaggggattttttggggcggggcgtctcgaaccgtctagcggcgtgttgtagtcagaccctgtgggtcgacagaaaagagatcgccccgccgttgttgagcgtggcagcggtc

SEQ ID NO: 236 - DNA, 200 bp, Mycobacterium paratuberculosis
ggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccacc

SEQ ID NO: 237 - DNA, 200 bp, Mycobacterium paratuberculosis
atgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtcc

SEQ ID NO: 238 - DNA, 200 bp, Mycobacterium paratuberculosis
agccgggcaggtcacgatgcgggcgtcgaaatcgatgaggaaatcgtcgctggtgaagccacccggaaccggcgagcgtagcggtagcggtttgatcaccgcgacatggccggcgtcggccagtgccgcccgggcggccccggtgccatacgccgaatcgcccaggacccgcaccgggggtgtgttcaccctcgagcagg

SEQ ID NO: 239 - DNA, 200 bp, Mycobacterium paratuberculosis
ctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcg

SEQ ID NO: 240 - DNA, 200 bp, Mycobacterium paratuberculosis
tccccggatcgtcgtaatcatgggcgctgcagtgggcttcgatcaccgctgcagcgcccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgt

SEQ ID NO: 241 - DNA, 200 bp, Mycobacterium paratuberculosis
cttgaccgcctcaaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggcca

SEQ ID NO: 242 - DNA, 200 bp, Mycobacterium paratuberculosis
tcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatcccca

SEQ ID NO: 243 - DNA, 200 bp, Mycobacterium paratuberculosis
gcacgggctggtgcaggccgccgccggggtagacggatccaacgtcggccgcgacgagctggcgctgctgccgctggaccccgacgccagcgccgcggcgctgcgcgcgcggctgcgcgagctactgggcgtcgaggtcgccgtgctggtcaccgacaccatgggccgcgcctggcgcaacggccagaccgacgccgcgg

SEQ ID NO: 244 - DNA, 200 bp, Mycobacterium paratuberculosis
ccccgttggggatcaggcgggtgaccgcgacgcagcgctgccaggtgccgtcgggctggacggggccgtcacacttgctcagcacgggcccgccgtactggcagccggcccgggccggcggggccgcggcgatcaccccggcggccagcagcagggcggccgccgctgcgacggtgccgtgcctcatggttgcctcccgt

SEQ ID NO: 245 - DNA, 200 bp, Mycobacterium paratuberculosis
aagtcgacgaggcgttgtcggccaaggccgaagacgagctggccgaggagcgcgacgacgaggagaccgacgaggcggacgaggccgccgaggcgccggccgacgcgaccgagccggacgaggaggccctcgaggccgacgaggccgacggcgaaccggacgacgacgccgacgaaaccgagacccgcgcggccggcgac

SEQ ID NO: 246 - DNA, 200 bp, Mycobacterium paratuberculosis
caacttcatgtccagccacactatgcgtcaaacgggccggttgcatcgaccgccgcccgtacccgcggtgccgatgacaccggcggtcgcagacgacgcgacctggtctaggcgggccaagacgtcgacctacaggcgcggcatgtcgacgtccgtcctaattttcgcgttcacgtcgcgggtgtgagtgcaggcggcgg

SEQ ID NO: 247 - DNA, 200 bp, Mycobacterium paratuberculosis
tcgaggcgtgggcccctcattgagcggggtggcgaagcggatcgtctagcgtccacgaaagtaagccactttgttacgccaggagtacgaggcggccaccgcatagccgactacctcgcaccgcacgagaagccattgcagccaagggattccgatgatgaaaaccacgcagcacgcgccagtgataccgagcgctacga

SEQ ID NO: 248 - DNA, 200 bp, Mycobacterium paratuberculosis
gataggccgtggcggcatgcctcgagcgtgggtgctgcctcaggatcaacaggattcgaccggtagagacaatgatgtacgcaagagccgcgatcattacgaaccagtagacgcggagccagggcgtgtgttctgtggccacaacatcgggaacacaggtctcgccgatgtcgcctgcgacgaagaccgcgatcatgacg

SEQ ID NO: 249 - DNA, 200 bp, Mycobacterium paratuberculosis
gcgcagatcacgaccgacggcagttccaaccggttccgaacgaaccacctgagctgacccggcgtcatgtcgcagtggtcagcgaccagatacatgatcgagaacaagccgtacacgtagagcagatggccgatgaggtcttcgaggttccacacgcccgtcatgtcgtggagcaatgggctcagccacccgtccaccgg

SEQ ID NO: 250 - DNA, 200 bp, Mycobacterium paratuberculosis
cccgagcgccaggaccaactgggcacacataaacgccagtgccaacactgctgctcgctcgaacgggatgtgccaggccaaacggatgctccacaaggcagctagcgcaatgaccaacgtggctgtggcgatgatgctcacagaggtcgatcgggtcgaggtctcaagtcactcaggcggaagggccgctcatcgtcgtc

SEQ ID NO: 251 - DNA, 200 bp, Mycobacterium paratuberculosis
tccggcgagcagcttgtccagcggaacatcgaccgcctgggcgatcgtaagtagctcactgtaggtgaactcgaccttgccatcgagcttgctagaaaggctcgggcggctgatacctgtctcgtgagaaagacgggtacgggacagcttgcggtcgcccatgatcatccgcaatcggctggccagggcggcggccgaca

SEQ ID NO: 252 - DNA, 200 bp, Mycobacterium paratuberculosis
caggcgaatgcgaagacatgcccggcagggtagcagtctgaaccgacaaagcgcgggcaaaaccgatcaattcgtcggttttcccgccaaaccggaggatttcgtgcaatagtctccgccgtggctgaattggacatgcatacaacaccgcgatccgggacaccgcagcagaagtcggtggccgcgggcggggcgcccac

SEQ ID NO: 253 - DNA, 200 bp, Mycobacterium paratuberculosis
tcgtcggccccggtgtgcaaacgtcgtcctggtctggcattcgccggctgggtcggcgttgacgacggcgcaaggacggtcgagcgatgatccatgacgcggtcacctaaggaggccgccctgttcacgtttctgttgacccccgcgttcgtcggggcaagcgccctgatcgcggtcgtgaccctggtcgtgttggtagc

SEQ ID NO: 254 - DNA, 200 bp, Mycobacterium paratuberculosis
cctgctgctgaacgagcacaacggcgacgacaaggacgttgacatggaagacacctggtggtgacagggagcataaccacgccgaagcgaatcgcgtttgcccgcacggcaattggagcgatgcttacggacccgagagtggcggattaggcggatgacggtgagcttcagcgacggcatggactcgctgcgccagtacg

SEQ ID NO: 255 - DNA, 200 bp, Mycobacterium paratuberculosis
cccagttctacgactatcactagggacgaagccatcgacatcatcgagaaggcagagcttcagctagagcagctgcgcacgtacgacgcttcgccgctcaccgaaattgtgcgcgagctgatcgcagagctgcggcgggcccgcgccgaggtagcgcggctgcggcacgtcggcgtggagacagccctaaagctgggcat

SEQ ID NO: 256 - DNA, 200 bp, Mycobacterium paratuberculosis
cgtcaaacgcgaactgacgctcaagcggtccgaatgcgagcgattgaggagacagcatgatcacggagacgtaccaccccacggtgacggttagcggagcagccgaagaccgcgcacggccgctcagccgatcagcaccgcgtaccggggtttgatcacctcgtcgataatggccagccgctcgtcgaacgggatgaagg

SEQ ID NO: 257 - DNA, 200 bp, Mycobacterium paratuberculosis
ggccgccaccaaggcatggccggacgcccgccccgcaccgagtcgatgggcatcccggtggccgcccacccgcccgcacccgcggcctggtcggcccaactggcgccgccggtcgccgccccgcccccgccggccgggcgcacccccaactgggccgcgccaccgcgccgcccgcagcccgcgccgcgccccggcccgcc

SEQ ID NO: 258 - DNA, 200 bp, Mycobacterium paratuberculosis
gttgcggcgctgacgcgctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtg

SEQ ID NO: 259 - DNA, 200 bp, Mycobacterium paratuberculosis
gtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgac

SEQ ID NO: 260 - DNA, 200 bp, Mycobacterium paratuberculosis
gcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctgg

SEQ ID NO: 261 - DNA, 200 bp, Mycobacterium paratuberculosis
gcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccgg

SEQ ID NO: 262 - DNA, 200 bp, Mycobacterium paratuberculosis
cgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgca

SEQ ID NO: 263 - DNA, 200 bp, Mycobacterium paratuberculosis
gcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcaaagatccggttgggccgatccgaagccgccaaccgacgccg

SEQ ID NO: 264 - DNA, 200 bp, Mycobacterium paratuberculosis
ccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcga

SEQ ID NO: 265 - DNA, 200 bp, Mycobacterium paratuberculosis
acatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagc

SEQ ID NO: 266 - DNA, 200 bp, Mycobacterium paratuberculosis
cgtcatcaaattcaccgaggcctgctaccgggaaaacgccctccagcccgacccgcggttcgccgcggccgtacagaccgcacagcggcggatcgcgccgcgcgccctcggcggcggcgcggcgaccatcccgtccggctgacggcagcccgagcccatttccggcggggcggctactcccactcgatggtgccgggcgg

SEQ ID NO: 267 - DNA, 200 bp, Mycobacterium paratuberculosis
cgtcgtgggagttccaccgcgccaacgtcgacccgcggcgggcgcagacggtggtgacctgtgcgcggcgcgccgcctcgctggaacggctggtgtcgcggccggccgcgcaggcgcgcgcggcgttgacgtcgctgccgggggtgggggagtggactgccgccgagacggcgcaacgggccttcggcgacgccgacgcc

SEQ ID NO: 268 - DNA, 200 bp, Mycobacterium paratuberculosis
gcgctggccgacccggacccggctcccgccgatccgggcgcggtggcagccccgcccggcccgccggctccgccggatccgttggcgcggccgcccccgcccgacccgttggcaccaccgccgccgaccgccccgccggcgccgtggctgccccccgccgcgcaaccggccgccgccccggccgccggacaggaccccac

SEQ ID NO: 269 - DNA, 200 bp, Mycobacterium paratuberculosis; identical to SEQ ID NO: 268

SEQ ID NO: 270 - DNA, 200 bp, Mycobacterium paratuberculosis
tctgggcctcggtcggctggttgggccgggccgggatgcgggtggtgctcgcggccggttcctgcgcgggccgaggctccgcgggagcggggcgcgccgcccgcgacggctccggcgccgcggggtgggtggggtcgtgcggcgggcgcggcgccgcggcgaccaggctggccgccaccggcggacgggcgggccggccg

SEQ ID NO: 271 - DNA, 200 bp, Mycobacterium paratuberculosis
tcggcgcgtggcgcgaacgcttccacgccgagccggttggccggcgtgtgcgacggcaacgccgcacccgtgaccgcggcgaccagccagggcagcgccgccgccgccgcggcgccgatcgccgccgcggcgcacacccaacgccgccggcccgcaccggccaccggcacgcaggccagcgccaccgccgccgccagcag

SEQ ID NO: 272 - DNA, 200 bp, Mycobacterium paratuberculosis
gccaggcgctaccgcgagctgggcgaggccggaatggccgaccgcagctcacgaccgcatcacagccccaaccgcacgcccacgcgcaccgagcggcgcatcatcaaagtccgggtgatccgccggtggggaccagcgcgcatcgggtatctgctggggatacatccctcgacggtccatcgggtattgacccgctacgc

SEQ ID NO: 273 - DNA, 200 bp, Mycobacterium paratuberculosis
accgcaacccaatacggggatatcactatctccacaccgccatcgatggatattcccggctggcctacagcgaggtactcgacgatgagatcaaagaaaccgccgccgagttctggacacgcgctaatgcctggttcgccgaatgtgggatcagcgtgcggaaagtgttgaccgacaacgggtcctgctaccgatcgcgc

SEQ ID NO: 274 - DNA, 200 bp, Mycobacterium paratuberculosis
acttggcggccaaccacccgccagccgcgtacctaacctctcaggtcagtacacctaacgctctcggcgcgcgcacgccccttcgcgagcgcctgcccttcgcgagcgcctacccctcggcgagcgtctgcccctcagcgagcgcctctctcggcgagcgcctgcccctcggcgagcgcctgcccctcggcgagcgtcac

SEQ ID NO: 275 - DNA, 200 bp, Mycobacterium paratuberculosis
gcccagcgcataccgcagacccagcgcggcgcccagcaccgccaccccggccgccccggcgatcaccgccccggcggccagcgccgggaccgccgcccacaccccgggccgccacggccgcgcgggcgggtcgtgggtcccccgtttccgggtgcgccagcacgccagcagcgccagcaccggcagcagcgccagcccga

SEQ ID NO: 276 - DNA, 200 bp, Mycobacterium paratuberculosis
cggtgccgcgcaacatctccaccagcgacgaccattgcgtcgtcacacccgaggattcgatgaagtccaggaacggcgggctgatggcgcgcagcatcaccaggcccaccacccaccacagcgtggccagcaccagcgccaccagccaccacccggtgtagcgccaccacaaccggttcgggcggtggcacgcccaccag

SEQ ID NO: 277 - DNA, 200 bp, Mycobacterium paratuberculosis
tccagctcggcgatgtcgaacagttccagcagatcgggccgcatcggcgtctgctctttcttcgtgatggtgatgtcggggatcaccgcggcttcaacgtcgcctggctcggcgactgcctcgcagaccagcaacagcttgcgccacgacgagtccatcgacgggtggtcgtcgcgggtgtgcccgccccggctctcggt

SEQ ID NO: 278 - DNA, 200 bp, Mycobacterium paratuberculosis
actgctgcagctcgagctgcagggtgtaggggttctcgccggggccgccgcccgccggcgcctcgaagggggacagggcccgcttcgccgccgcctcgacggcgctctcgccgatcgtcggacggctgctcagcgcgcgcacgtagtcggcggcgcccagcccggcccggcggccgaacaccagcaggtccgacagcgag

SEQ ID NO: 279 - DNA, 200 bp, Mycobacterium paratuberculosis
gccggcgccggcgcgaccggccgtaggcgacggcagcccgacgaattcgcggatgactccggcaccggtacgacgagtcaattcagcggtccccctcagtggcgtagatggcccggtaatagatgttggccagggtttggatgcaggcctcgtcgtcgggttccccgcaacgtgccgaaccgagctggacgtagcagaac

SEQ ID NO: 280 - DNA, 200 bp, Mycobacterium paratuberculosis
gtgcgggtttggcccgcgcaccggctcgagggccggacaactgtatcccgagttgcgggcgtagcgggccgaatcggcgataagtcgtcgcgaatcgaccccgcccggcgtggccagggccgttgagggggaaaagattactgcaccgccggcgatctcgcggcggaattcgagtcttgacaaaaccgcgaaatattcgc

SEQ ID NO: 281 - DNA, 200 bp, Mycobacterium paratuberculosis
ctgcgtcagctagcgtccacagcagcgacataggggtatgaccggcggggtagttcaccaacacaggcgaaagtccgtcggacaatttcaagcgcgacacacatcgacgatcctcgaaaagccaagcgccaaccgcacttccagcacccccagaccgccccgcaaacgtcgtcgtctcacagcacaaggactcgaggaaa

SEQ ID NO: 282 - DNA, 200 bp, Mycobacterium paratuberculosis
gagttccaccgccacctcgggcgggggcggctgtcacggcgagtcgagcgctccgccttgccgtttggccgtcatcgctgggtggcggccgccgagtgctcccccttggagatcgtcgcgccgccgcgggagcgcgaggacatcgacgcgtggctcgacgagcagacccacaagcggccggacgccgagcgcgggcccgg

SEQ ID NO: 283 - DNA, 200 bp, Mycobacterium paratuberculosis
acgacgcgctcgatgtcggccgcgccgtcggtgccgcggcccggatgctccggcagggccgcgacggcaccgcgtccgtcgccccgccacgcgggaagcggcccgcgccgccggccgcgcccgacgaccgcattgccctgccgatggagacgatcttcgtcagcgccgacgactgggacgcgcgcgcaaccgccttgggc

SEQ ID NO: 284 - DNA, 200 bp, Mycobacterium paratuberculosis
tatctgccgcggttcatccggcagttcccgttcaacgtcttgctgcacgacctggaccgccggatcaagaaggggcggccgctggtgtagcggcccggcgagcgcggaagcccatgaactgcgggctgtatttctttatggccgatcctggaaacatgcatcgtgaatgtagccccgcaggggtagggacctggcgcttc

SEQ ID NO: 285 - DNA, 200 bp, Mycobacterium paratuberculosis
cttgcgtcgccttctccctggccgggtgatcgcgccgtcggggtagtggcccgctacggtcgtctcggtctgttgctcctcgatgagcttggctacgtccaaaccgactctcgcggagcagaattgctgttcccgatcatcaccgaacgcgaagaatgagccagcatcgggctggcgagcaagcttccgtttagtcactg

SEQ ID NO: 286 - DNA, 200 bp, Mycobacterium paratuberculosis
gggagagaccttttccgacgacgttgttgcggcggccatggtcgaccgcttggtacaccacgcggaggtgctcactctcacccgcagactcctaccgtacccatcagcgccgacgactgctcacaaaagaaaatcgcgccgccaacgatcaacacccatatcccgcttgggatttcgagcaatcggtggggcgggtgaac

SEQ ID NO: 287 - DNA, 200 bp, Mycobacterium paratuberculosis
tccattcgactccgttgtcgagacctcgacgcacctgctgggaggcaggcacgacgctgagtgcccacctcccgagtctcgctttacctttggcggttggattgaggtctggggtgtcatcggcgctttttgctggctctgcgcccagatagcccgtcaacggtcacagcttgccctgaatgatccatcgccagacggtg

SEQ ID NO: 288 - DNA, 200 bp, Mycobacterium paratuberculosis
acgagcctgcctctcagtagtgccactggttagtggaaacccaagcttgcccacgccttggtcgtatcgatgccgccgcgaagcggagacttcagatgattcaccgtaattgcggagctaattcacagttgagaacgtatttgcggtaagaatagccgcgtatcctacgtgcatgcggtcgacctattacctgcagctcg

SEQ ID NO: 289 - DNA, 200 bp, Mycobacterium paratuberculosis
gcacctgcggagtgtgggggtggaggcaccgaccgcgtggtgaacctgcgcgaatgccagtgcggtcccgttgattaccacgatagtgcgaccggccgattcggtgtcgctgcgtgacggtgctgctagggcggcctgtctgacttctggatcaagacgatgactgccccgatctggatggcgtttccgccggaagtcca

SEQ ID NO: 290 - DNA, 200 bp, Mycobacterium paratuberculosis
ttcggcgttgttgagcagtgggccagggcccggcccactgctggcctctgcgggtgcgtggaattccttggctgctgagtacacctcggcggctgaggaactcacggcggtggtggaaggcgtgcaggctggggcgtggcagggccccagcgcagaatcgtatgtggccgcccacgcgccctacctagcgtggctgacac

SEQ ID NO: 291 - DNA, 200 bp, Mycobacterium paratuberculosis
gtccaggcggccaccaccatgacgacgtatcaggcggtgtcgaccgcggctgtggccgcaactcctcagaccatgcctgcgccgcagatcgcaaagtccaccgccgccaccattcctttccagcggccctaccccaaccccaccaacttcagccaggtctgggcggatctgtggtatgacatcccgtattcgatcgagac

SEQ ID NO: 292 - DNA, 200 bp, Mycobacterium paratuberculosis
cttccagggcccagtcgatcccgccaactggacgcaattgttccagttctggaatgtaacgtttgccaacctggccgggacccctgccaagctggctcagatcttttcgaatccgtcggtgttgttcagctggcccacgctgctgtgggtgttggatttcatcgccggccgcatcttcgacatcctggtcaccctcaaat

SEQ ID NO: 293 - DNA, 200 bp, Mycobacterium paratuberculosis
ttcttcttgagcagccgttgctgtacgtggtggggctcggcatggcggtcaccagcttgggtgcggccgcgggcgcggcgggtgggttggtcgggctcgccggcctggcgagcccgggcccgctgcccaccggggccgagatggtcccggtgaccgcaccaccacccggcgctacgccggcgccaaccgcgccgctgatt

SEQ ID NO: 294 - DNA, 200 bp, Mycobacterium paratuberculosis
ggcggtccggcctcggcgccggccacgattcccgtcagctcggccgctgctgcccccaccgcgccagcgccggcacccgccgtcgcggccgccggctcggctgcgccgccgccggcgggcccgggcggctttccctacctggtgggcggcatgagggtgagttcggcggccagcgcatcagcccaaagccgcaaaccgaa

SEQ ID NO: 295 - DNA, 200 bp, Mycobacterium paratuberculosis
atccgctgccgccgccgcggctcgggccgccgctgccgccgcggctgaaacacaccatgcccgccgccgcctgagggtgaaggcgaaaatgctcggtcgtggttatgaatatatggatctcgaggacgaccacctgagctcgagcgccgcgtcggagcatggtgcggggccgctggggtttactgggacgatgcgagaat

SEQ ID NO: 296 - DNA, 200 bp, Mycobacterium paratuberculosis
ccggtgctgcgaccccggcgggtttgaccgcgctgggcggcggctcgttcggtggcggctcgaagatgccgatgctgccgaccagctgggtcaccaacggatcaggcgaggcctagcggttgacgctgatcaagcggtgtgtccgcgggaatggttggcgcacaacgctgctgatgctgttgctgctgaccgcggtggcc

SEQ ID NO: 297 - DNA, 200 bp, Mycobacterium paratuberculosis
gcatcgctgatggtggggcgctacccggtgggggtgggcgcgatggccgggatgctgtttggtcgtcttcctctgctggacactagctttactccggtggatcagacggtgctgacccagatccggttaccgcgcatcggctgcggggtcttagtcggtgcggggctggcggcctcgggtgcgggctatcagacgatgtt

SEQ ID NO: 298 - DNA, 200 bp, Mycobacterium paratuberculosis
ccgcaatccgctggtgtccccggacattctgggggtgtcggcgggcgcaggcttcggcggagcgctggcactgttactgcatgcgccgtactggcagctagaagcgatggcgttcgccagcggattgctggccgcggcgttggcactgatcatcgggcgcggcatcggccgcgattcggcgatactgctggtactggccg

SEQ ID NO: 299 - DNA, 200 bp, Mycobacterium paratuberculosis
ggatggtgatcgccagcgtgttcggcgcgttgatctcggtgaccgaatacctggccaaccccgatgacaccctgccggcgatcgtgttctggctgatgggtgggctgggacgccaacacctcgacgggttgttggccccggcgctgatcatcgccgccgcggtcctggtgctctacgcgttgcgatggccggtgacggtg

SEQ ID NO: 300 - DNA, 200 bp, Mycobacterium paratuberculosis
gtggtatccggggatgaagacgcacacaccctcggcgtcgacacccgacgcacctgggctgcggtggtaggcgtctatacgttgatcaccgcaaccacagtgagcctggccggcatcgtgggctgggcaggcctgttgattccacatatcgctcgagcgttggtcggcccgggattcggtcggctgctgctggtgtcggc

SEQ ID NO: 301 - DNA, 200 bp, Mycobacterium paratuberculosis
ggcgctgggcggggttttcgtggtcggcgtggacgacgtggcacgcgcggcggccagcgccgagatcccgctaggcatcctcagcgctctcatcggggcgccgttcttcctggtggtgttggccaagatgcgccggcaatggacgtgagcagcgcggcgatcgccgccgaacagctgtcattcggctaccccggcgacgg

SEQ ID NO: 302 - DNA, 200 bp, Mycobacterium paratuberculosis
cgcaacgcagcaacaccccgttcccgttttccaccctggacatcgcggtcaccggccgcaccccgtatctgcgcgcgatgacgtccccgtcggcgacggaccgccgggcggccgccgcggtgctcgaccggctggggatcggcgcgctggccgatcgaccgtatgcggtgctttccggcggggaacggcggctggcgttg

SEQ ID NO: 303 - DNA, 200 bp, Mycobacterium paratuberculosis
ctctcgcgcgcgatggtgcaggacgcgccggtgctgatcctcgacgaacccatggcagcactggatttcggcaacgagagccgcatcctgcaggtggtggccgagctggccgccgccggccgcgccgtgctgatgaccactcatcagccctggcatgcgctacacagcggcgatcaggcagtgctgatcgccgacggccg

SEQ ID NO: 304 - DNA, 200 bp, Mycobacterium paratuberculosis
cctcatcgccgacggccccgtcgagcaagtcgtcaccgcggccgccctcagcgagctgtatggggtgccggtgcgggtgctgaccgctaccgacgacgccaccgggcgcccggtctacgcctgcgcgccggtggccgcgggggatgaccgatgatccgggcggtgctggccgccgtctgcgtcgccacctcggcggccgg

SEQ ID NO: 305 - DNA, 200 bp, Mycobacterium paratuberculosis
ctgcggcgccgcacaccattccccggcggagccgacgcgcaccgtggtggatatgaccggacaacacgtgcagatcccggccaccgtaacccgggtggccaccaacatcccgctgatcccggccaccatcgaactgctgggcgggatcgacaccgtcgttgcggcggcccgcggctcgttcaacgctctgttcaccacca

SEQ ID NO: 306 - DNA, 200 bp, Mycobacterium paratuberculosis
tcgcgccggcaacccaacagattccgcggtccccgcctaccagcctcaacgccgagcagctgctcgacctgcacccgcaggtctttttcatgaccgacctgaccccaggcctgctgccgatgctgcagcggctgcagatcccggtcgtgcagatcaccgccttcaccagcccgcaggatctgcagaaggcggtgaacctg

SEQ ID NO: 307 - DNA, 200 bp, Mycobacterium paratuberculosis
gtggcccaggtgctcggcggggcggcacccgcgcgggcccggcaatatgacacctatttcgacgccgtgatccagcaggtgcacgccggcgcccaaaccgaccggcccaccgtgtattacgcccccggaccggaccccaccaccaccgtgggtgccgacaacatcatcaccgcatccatcgaggccgccggcggccgcaa

SEQ ID NO: 308 - DNA, 200 bp, Mycobacterium paratuberculosis
tatcgccgtcgaacacggcatcggcgggcatcagccgggtgcattcgcgttcccgaccatcacggccgaaaccttgctggcctggaaccccgacgtaatagttgcgagcaacgcccgagtcgccgaccagcttgcgaccgaccccacgttcgccaccctgaacgccgtccgcgatcaccacatctacacctgcccggtgg

SEQ ID NO: 309 - DNA, 200 bp, Mycobacterium paratuberculosis
ggatcttcccgtggtgcgcctcgagcagcgaggccgcgcttgcgccgctgttcctcgccaaaaagctggaccccgaacgcttctcggatctaaacctcgccaacaaggtggccaacttctacatccagttctacggctacagcctcaccggaccgcaagtgaccgcgatcctggacggggcgggctaatgccgttgagcc

SEQ ID NO: 310 - DNA, 200 bp, Mycobacterium paratuberculosis
tgcgccctgccgcggcgttattcggcgccgagatcggcgggatcgatctgcgggcgcccctgacccgcgagcagcgcgatgaactccagcgactgctacaacgctaccgggtgttgttctttcgcgggcagcagctttccaccgcgcaccagatcgagttcgctgaagctttcggcccgatcctgatcttccgcagcgtc

SEQ ID NO: 311 - DNA, 200 bp, Mycobacterium paratuberculosis
gtccccgccgacccccagcatcccggagtgcacaacgtggacggcagcaccgtgggctggcacctggacgccagcggtctcatcgaacccccggtggccagcgtgctgcgggcggtcgagatccccgaccgcggcggtgacacagtctgggctgacggcatggccgcctacgacgggatgcccgatgatctcaagtcccg

SEQ ID NO: 312 - DNA, 200 bp, Mycobacterium paratuberculosis
gctggaaggtttgtcagcgacccacaccgcaccgaaccagcatccgctggtcgcgcacccgctggtgtcccaccaccccgacatcggccggcgctacctgaacatcaacctggcgccgtgggtggacacccggatcctagggatgagcaccagccatagcagcgccctcgtcgagcagctgcgggcgcaccacctgcgat

SEQ ID NO: 313 - DNA, 200 bp, Mycobacterium paratuberculosis
cggactaccaacttcgattccggtggagcgccggggcggtcgtgttgtgggacaaccggggtatgcagcacaccgggatccgcgactacggcgacgacacacgccgtcggctgcagcgcatctgtatcgcccacttcaccgaaggcgttactggccgtgcataacggccgcgccagtaatcacacaccagcaaccgccca

SEQ ID NO: 314 - DNA, 200 bp, Mycobacterium paratuberculosis
agcaacaaagcgccgaaccatctacctagatcgaatcatcaagctcggtccgcctaggacaaatcgttagacacagcccaactgggtagccggcgcgcaggaaacccacgatcttggcgataacctcggaaacaggcatcgggacccctcgcgcactgcagctgtcggcaccttgacgcaccggcttggtgattagccaa

SEQ ID NO: 315 - DNA, 200 bp, Mycobacterium paratuberculosis
tactccgagcagtccgccgatcagcccgaataccaccgtggacaggtcgaatgcgattagcacggctggcgacaacaaccgttccatctcttcgaggtagcgcggacccatctgtgccatgccgggactggagaaatattcatcgcgagcgtagaagatgggcagcagcggcccgatgtaccacgccgcgtagattgcgt

SEQ ID NO: 316 - DNA, 200 bp, Mycobacterium paratuberculosis
acgccagtacacccatggtgcgggagcgatagcgtcccagccacaggacgacttcggccaccaacgcgcacgcaactgtgatcacgaagcagatcggggggtgcccggtcagtgcgagcagtccggccgtgataatcgcaaacaccgtcaccatgcccgcatgtcgcacccgggtgaggaacaacatgaacggcacgccg

SEQ ID NO: 317 - DNA, 200 bp, Mycobacterium paratuberculosis
gcctgggagaacttcgtcatgaacctcatggatcaactgttcggtgtcgatagcccacccgacctcgcttcggcggtggcggcattcttggcgaatccgtccccggcactctttagcgcgctcctgtttgcgctggcctacgaaatcgcctttgacacgctgttcttctcgcccgtggcattgttggccgctccgttcct

SEQ ID NO: 318 - DNA, 200 bp, Mycobacterium paratuberculosis
gccgtttgtcggtctggccggcctggcgggtctggcagggttggctgggctggcccctgcgcccgagccggttccagcaaccgtcgcggacgtgccggccccgacgtcccctccgaaccaggccctaccggtcgcggggatcccatcggcgtccacgccggcatctgctcctgcatccgcgcccgcgacgagcgcgacgg

SEQ ID NO: 319 - DNA, 200 bp, Mycobacterium paratuberculosis
caccggcatccgcgccggcgccggcccccgcatcggccggttcacccgtgttcggctacctggtcggcggcggtggcggtggggaatccgggcccacgctgactggccgctccaacgcaacagcacccgcgggtcttgccgcggcctcagcggccgcagcgaaagcgccgacacgtgaccagacgcggtcgcgacggcgc

SEQ ID NO: 320 - DNA, 200 bp, Mycobacterium paratuberculosis
cgccgaaccgtaatgcgggaccacggcgatgaatttatggatctggacatgggcgcgccggtcgactccccgcccggcggaacatttgtgtcggggcaaggtgcgggttccctgggattcgccggaacggtagcgaacgcggccggtgcacgggcagcgggtttggcaacgctggatgccgatggcttcggctcgagtcc

SEQ ID NO: 321 - DNA, 200 bp, Mycobacterium paratuberculosis
caaagcgccgatgctgccgggtagttggcatggcgacgcgacccaggaatcgcagggaagcggtgacgacgagcacccgaccgagggcaacgctggaaccgagtaatcgtccagatctggtcggcatcctctcgtcagcgtcgagcccagaactcgattatctcgcgctcatcgtgtctcgcgctcaccgtgggtgcagc

SEQ ID NO: 322 - DNA, 200 bp, Mycobacterium paratuberculosis
acaccgatgatcgggtgtagctgctcaaaggtcatgtcgtgtgcttcggcctcgtgggcgagttcggcgaggcccacggtgtgccacgtgtgttcggcggtgaattctctggtgaccttgtcgccttcgctcaccacatagcgcatcgtccagtgttccgcgtcgctgccggcgggctggcccgatatgcgaacttcatt

SEQ ID NO: 323 - DNA, 200 bp, Mycobacterium paratuberculosis
gtgccgcacaccaatgcgctgttgggcaatggtcatctcgggcaccggcatgggctggtcgagggccatgacttcgacgatcaccggtgcgcggggggtgagacgtgggcgtagcgctgcccaaaagtgttggcgggcttgcttgtccatatacccgatgacgccaaacaacaccacggccccaagacgctcgggaaggt

SEQ ID NO: 324 - DNA, 200 bp, Mycobacterium paratuberculosis
cgagttcttcgagattgaccgggtgcacggtgacccggtcaatcaaatcaggccggctgaggatcctggagacgagcgcggcgcgcatcgccgctgacggctcgaccgcgtggatggggacgtctgcgatggtgtcagcaacggtcactgtcgagagccccgtacctgccccgatatcaagcacgtgatctttcaccggt

SEQ ID NO: 325 - DNA, 200 bp, Mycobacterium paratuberculosis
ccacgtgcggtcaacgcggataccagcacttggcgcttcatatcccaatgtgggatcgccatcacctcgtagaactccgccgacagggcgtacggatcggcgccaggtgtcacgctcattcggtcaccgactccgggctttcagcggccacacgtggacgatgtgtgatgagcgcgcccgacaaccccgccgcgaccagg

SEQ ID NO: 326 - DNA, 200 bp, Mycobacterium paratuberculosis
gcggcgcatcctgcaattccgaagatcaggcgaagcgcatcggtgaacgcagaggtcgcgaacgcggtcattgcctgggtgggaaacctcaacacccccgcaacgatggcggacgctacggaatctgcactgtgcaccgggataacccctgaagcagcgactttcgcatgcacgaacgatgacaacacgacaccaaaggc

SEQ ID NO: 327 - DNA, 200 bp, Mycobacterium paratuberculosis
ggccacgcctgtcgctgtccccagtggaaacgcggtgtttgcggcaccggtcgccatgccggccttgttggagggcacgacatcgaccgcaaggttcatcaggtggggcatcgcgacgccgttaccaacccctagcacggcaagagccggcaggatcgtcgtccacgacccgtctcccctgatcagcgtggcaaggaaaa

SEQ ID NO: 328 - DNA, 200 bp, Mycobacterium paratuberculosis
gtcccgcggctgttatcaccatggcgatcgacatggtcgcgcgcactccgacagcgcgggcaaccgacgtgctgaggactgcgcaaaccatcagtggcagggcgagtgccgacaggatgagtccgatgtcgaaggcagagcgaccgtgcgcgccggcgagccagaggatgaggaagggaaagacaccaaagctcaaggcg

SEQ ID NO: 329 - DNA, 200 bp, Mycobacterium paratuberculosis
cgcacggtgaatcccaggacaatagctgccaggaatgtggggattcgaaacaaggtgaggtcgagtgtggcctcggagccccgccgcagctggtgcaggacaaacccgactccacccgccagtccgatggccagtgccgcgagcacatcaccgcggccccagcctttggcggcgccggtcaacagaccgtagttgagggc

SEQ ID NO: 330 - DNA, 200 bp, Mycobacterium paratuberculosis
gaacaacaccactatggcaacgacggctccaaccgagtccacccggctgttgtcagctgcgtgcggcgcgtggggttccctgactttgagtgcggtgcatatcgccaaggcgacgccgacgggcacgttgatggcgaagatccattgccacgtcccgatttcgacgagcccgccgccgatcagcggtcccagcgtcgccg

SEQ ID NO: 331 - DNA, 200 bp, Mycobacterium paratuberculosis
cggcggcgcctgcggccatcgctagaccgaccgccttacggcgttgctcttcctcagcatcggtgtaggcgtcggcaatcaacgcaaggcacgttccgaacaccagcgccccgccgatcccctgtagggcacgggctgcaatcagggggctttcggtgcgcgaagccacgcacaacgccgatgcgacggtgaacacggcc

SEQ ID NO: 332 - DNA, 200 bp, Mycobacterium paratuberculosis
acgccggtcaggaacagtcgttttctccccaaacggtccgacacactgccgacggtcagtaagagtgcggcaaaggccaagacgtaggcgttgacgacccactgcaatccctccagcgaggcaccgagatccttctggatcgacggcagcgccacgttgaccacggtgatatcgagggtcatgaggaaacatgccaatgc

SEQ ID NO: 333 - DNA, 200 bp, Mycobacterium paratuberculosis
ggcgacggccgttgtccatgtttggttcgatctggcatggtcgagcatttgagcccctatcgacaatgaaaatcgttttcagtaaggtgcatcctagctcatgcgtcaccacatggggggaccgcgtcctgctcggctaaacgcaagatcggcaggcttccctgcgcgatgaaatgctttgcaggacaacagaacagtac

SEQ ID NO: 334 - DNA, 200 bp, Mycobacterium paratuberculosis
ggagaccggcgccgaaaatgatgagctcgacacctggcccaccagcactgcacgacggtgatcggagtgttcctgccgtattcgcggaatgggttggacggcgaccagacgccgttgcgctgcgaaccgttgccgcaaccgggatcgacgactggacatatcaacggctctgggatcacgtgcgcgagatccgggacgtc

SEQ ID NO: 335 - DNA, 200 bp, Mycobacterium paratuberculosis
gccttctccggactctccgcaggtatacggatcccgatggccttgccgggcggcgccgattatgtggcaggcatgctcgccgcgctggcggcgggcctgatcccggtaccggtgtacctgccctcgactcgcgaaccgcagcggtttctggcccgcgcgcagcacatattgcgcgactgcgaaccctcagcggtgtacac

SEQ ID NO: 336 - DNA, 200 bp, Mycobacterium paratuberculosis
ctgcggcgagttggtcgaggtcctcgagcgtgatcccatcctcggggcgctgccaatccgcacaccggcctcgacggccgacggtctcgccccccatccaggtggcacaaccgccgacgccgaccatggagaacacgtcgccttcctccagtattcgtccggatctaccgggaaacccaaaggtgttgtcaacacccatc

SEQ ID NO: 337 - DNA, 200 bp, Mycobacterium paratuberculosis
agtcgattctgcggcaggcggccttcgccgcgaatgtgtggaacggcgacgacgacatgcacatggtcagctggttgcctctctaccacgatatggggatcttctggggcgtgttcatgccgctgctcaacggcggttgcacgacgctcatcccgccgcacgatttcgtacgcaatccgcgaatctggcttgagacagtc

SEQ ID NO: 338 - DNA, 200 bp, Mycobacterium paratuberculosis
agcaggttccgcggaaattggatcggcggacccgatttcgcgtatcgccgctgtatcgaagcctttgacggtaccgcgctgcagagtctggacctgtcgtgtctgcggcttgcgaccaatggcgccgaaccggttcgcggaaccacgttgcgggacttcactgcgaaattccgggcggctggtctgcgggatgatgtcat

SEQ ID NO: 339 - DNA, 200 bp, Mycobacterium paratuberculosis
ggcgccgcagtatggcctcgccgaggccggtctgggagtgacaggctctcagactgttcgcgtatgggtcgaaaagagcttcgacgctgacgcattggagcgcggcatcgccgtcgaagtggcgcaacccaacccggcggacggtcgctcccgcgccttggtcagctgcggcgatggcgccttcggctgggatatccaga

SEQ ID NO: 340 - DNA, 200 bp, Mycobacterium paratuberculosis
ttgtcgatccggaccgccatatgacgttgaccgatggcgaagtcggcgaaatatgggtcggaggtccgggtctgcctgacgggtactggcggcagccggaacagacggcgacaacattcggcgccaggaccgcagacggcctcggtccatacttgcgtaccggggacgcgggattccgctaccaaggcgaactctacgtc

SEQ ID NO: 341 - DNA, 200 bp, Mycobacterium paratuberculosis
tgcggccgataccgcgacctgatcatcgttggcgggcgtaaccactttccgaacgacatcgagaagaccgtcgaggaagcccattgcggggtggcgccggggggcgcctgcgccgtgcagcccgacgccccccaggcaaacggcgagtggtggctggtgttggaaaccggctctcccgtcgaagacctcgacgacctgag

SEQ ID NO: 342 - DNA, 200 bp, Mycobacterium paratuberculosis
ccgcatcctgcgccgtcgcatcttggcccaccacgagaccgctcccgagcgcgtggtgtgggtgccgtgtcgcacgcttcccaccacgacgtccggaaagatcagacgacgcgagacgctcaaccgtctcaccgcgggccaactcgaggtcgtccatgaggtatcgccgcgagcgcaggcgccggacactcccgccgcac

SEQ ID NO: 343 - DNA, 200 bp, Mycobacterium paratuberculosis
ccgacgacccacccaccgagctggctcaacacctcgcagccatgctcggcgtcgagccttacgagctggcgcccgacgccgacttgaccacgctgggcctgacctcgatgatgaccgcccagatcgtcgaatggtcgtcgtcgcagtcgcggcgcctggacttcgccgacctgtacgccgagccgacgctgcgcagctgg

SEQ ID NO: 344 - DNA, 200 bp, Mycobacterium paratuberculosis
cagcggctcttcgacgcggcgcccccggtccagaccggcacgagcagcgtcgccgcatccggcccgtggcccacgacaccgctgcaacaggcctactgggtcggtcgcggggccgagcagccgctcggcggtgtggggtgccaaacctacttcgaactcgtcggcgcgcgcgtcgacgccggccgactggcagccgctct

SEQ ID NO: 345 - DNA, 200 bp, Mycobacterium paratuberculosis
cgacgcgctgacccggcgacacccgatgctgcgcgccaccttccccgaccccggccgatgtctcatcacgcccgaggccgtccgcctcccgctcgcagtgcatgacctgaccgacgcccccgtcaccacccgcgacacccaccttgccgagatccgccgccgactgcgcacgcaccgcttcgacatcgaaaccggggaca

SEQ ID NO: 346 - DNA, 200 bp, Mycobacterium paratuberculosis
cctggacggtcgaactcacccgcctgcctcacggctgcatcgtgcattttgcggtcgacctcatcatcgccgacgtgaccagtatcggcaccatgctgcgcgacctcgccgcgtcgtaccgcggcgagaagcttcccgcgccctccgccacgttcgccgatctaatacaaagcacgtcaccgccaccccaggcgtgcgcg

SEQ ID NO: 347 - DNA, 200 bp, Mycobacterium paratuberculosis
gaccggctccccgaaggcccgcagctaccccgagttcaggaagctgacatctccttcctgcggcaccaacacacgctgagcgccctcgcgaccaaagccatcgacgacgcgtgccacaaccacggcgtgacccgggccgcggtattgctggccgcatacacgttggtgctgcgacgatgggccagccaggacgacttcct

SEQ ID NO: 348 - DNA, 200 bp, Mycobacterium paratuberculosis
ggtcaacgtgaccacctttggccgctcacccgaagtgtccgatgtcgtcggtgatttcaccgagacccatctctatcgtgctcagcttgacggccagatcagcttcgtcgaccaggcgcaggtcacccagaaaggcctgcgcaccgcactgcgggcagcaccggccccggacctgctcgccacccaattacgctcgggca

SEQ ID NO: 349 - DNA, 200 bp, Mycobacterium paratuberculosis
ccgggcattccggaatcgtgccggtggtgttcacctacgccgcggacagccccctactgagcgccgaggatgcgaacaccctcggcgccatcgacgaagtggtatcgatgacgccacaggtgctcatcgaccaccaagcgtgccgcctcggtgacgatgtggtgctgtcttgggattaccgcgcgggctgcttccccccg

SEQ ID NO: 350 - DNA, 200 bp, Mycobacterium paratuberculosis
ggtgtggtcgacgacatgttcgaggcctatgtgacgctgctggagcgcctcggcggccacgactggtccaccccagcgacgccggggctgtcagcgcactctcggctggcccgagcgcaccgcaacgcgaccaccacgccggcaccggcagggctgctctacgacgccttccgggagaacgccgccacccaccccgcccg

SEQ ID NO: 351 - DNA, 200 bp, Mycobacterium paratuberculosis
tctcgccctgcgctggcggcccgacgactaccgaggtgaacgccacggcgacgtgatcgcgcaggacagatcccagttgacgtacggcgaactagacgaactggcacgcagcgtcgcgcgggccgtagccgcacgccacgctgcgggctcggtgatcggtatccagctgcccaagggaccatcccagatcgttgccgtgc

SEQ ID NO: 352 - DNA, 200 bp, Mycobacterium paratuberculosis
tcggcgtcatgatggccggctgcacctatctacccgtcggtgtcgaccagcccgcggagcggctcagccgtatctgcgccagatccgcgatggcgggactgatccgcaccgacagcgacacacaggacgcgggggtcgcggtctctgacatcacggcaatgatcgagtgcgcaccgaccgatccgatccggatcgaccca

SEQ ID NO: 353 - DNA, 200 bp, Mycobacterium paratuberculosis
cacgacgccgcatacgtcatctacacgtcgggttccaccggcgaacccaagggcgtcctggtgtcccatgccgcggcgttgaacacgatcgtcgacgtcaaccgccgcaaccgcatcgacacccacgaccgcctactggccttgtcggcgttggacttcgatctcagtgtctacgacactttcggcgcactcggctgtgg

SEQ ID NO: 354 - DNA, 200 bp, Mycobacterium paratuberculosis
cgctcagctggtgaccatccccgaacacgcacgccgcgacgcattccactggctctcgctgacaacggaattcggtatcacagtgtggaattcggttcctggtctgatggacatgctgctgatcgccgcgggggacaaggcgggatccctgccgacgttgcgctcggtcttcctgtccggcgactggatcccgttggact

SEQ ID NO: 355 - DNA, 200 bp, Mycobacterium paratuberculosis
tgccgcggcggctgcgtcgcgccgcccccggtgtgcgcctggtggcaatggggggagcgacggaggcggcgatctggtccaacgagttcgtcgtcgacgacgtcgacccggactgggcttcaattccctacggatacccgttggccaatcagatgtttcgggtcgtcgacgacaacggcgacgaccagccggactacgtc

SEQ ID NO: 356 - DNA, 200 bp, Mycobacterium paratuberculosis
gcgggcgagctgtggatcggcggggccggcgtcgcactgggctatcacaatgcaccggagctgacctccgatcggttcgtgcacgacccgaccggatcacgctggtaccgcaccggcgacatggggtgctactggcgcgacggcacgttgcaatttctgggccgggcggactcacaggtcaagatccgcggacatcgggt

SEQ ID NO: 357 - DNA, 200 bp, Mycobacterium paratuberculosis
ggagtgcggggagatcgagcacgcgctgcgcggccacccgctggtcgccgccgcgacggtggtccccatccacaactgcactgcgctgggcgccgggatcgtcgtaaccggcagcggcgcagagcaatttgacgactccacacccggcgcgctgcgcgcccatctcgccgtccgactcccgcagtacatgatccccaagg

SEQ ID NO: 358 - DNA, 200 bp, Mycobacterium paratuberculosis
tgttcgtctcatgccccgagctaccgctcaccgccaacggcaaggtcgaccggggcaaaatcgcggcgcgcctcgaagcggccgcgcgggcaccccagccgctcgacacgtcatccaccctcactgtggtcgagcggctggtcgccgaggtctggtccgatgtgctgggcgcgccgatcaccggccgcgaggacaatttc

SEQ ID NO: 359 - DNA, 200 bp, Mycobacterium paratuberculosis
ttcgcccagggcggcgatagcctgcgcgccaccgaagcggtcgcccgactgacgcgcaggggagtggccggagcggaggtgggccagctgctcagccaccagacgcttgggcagttcagcgcggcgtgtgtgctcgccgacccggcatccgaggcatccgagtcggcggccgatgtcggcgaacccgtgacaccgggcga

SEQ ID NO: 360 - DNA, 200 bp, Mycobacterium paratuberculosis
ggggttcccgctcacccggttgcagcaggcctacacgctgggcgcggccggactcaatgggagcacctgtgcaccaacgtatttcgcggtggtgctggccgccgcgcccgagtctgccggtatagacctggatcggtttgcccgtgtggtcaccagatgcgtcgacgaattcgcgatgctgcggtgcgcgctggacgccg

SEQ ID NO: 361 - DNA, 200 bp, Mycobacterium paratuberculosis
acaccacccaacgggtgcaggtcgacgccgggccggtgcccgtccatgaccttgatatacaagacgaccccgacctgttactgcggcgcatggcggccgccccgttcgatccgcattcggttccggtgatccagtgcttcgcaccgtcgaggtcaccccgtcacgtcggtctgctgatcagctatctgggcctcgatgcc

SEQ ID NO: 362 - DNA, 200 bp, Mycobacterium paratuberculosis
cgcagcctgtccaccgtcgtcaccacgatcatcgccgaataccagtcgcaaccccggccgcggcaggtcgacccgaccgcggcggtcttcgcccggtttgcctccgaaagcgcttggggcgaaaacgatgtcgacaacagcgttgccggccctccgctgctgccgctgcacgaccagcgacgtgaccccttcgagcgggt

SEQ ID NO: 363 - DNA, 200 bp, Mycobacterium paratuberculosis
caccttcgcgcggcgcagcttcaccatcgaagaacaggctgccgccacgctgcgtgagcacgccgcacacctcggcgtcacccccaccgcgctggtcttcgaagccttcgcacatgcgctggcgtcgatcggcgccggtcagcgattcgcggtgacagtccccaagtcgtaccgtcccgactacgcccccgcggaccgcg

SEQ ID NO: 364 - DNA, 200 bp, Mycobacterium paratuberculosis
aggtgttgggcaacttcacccgcctggcgctgtgcgaggtcgactacggcgccgtgagaccgggatctgccgaagcggttgccgcggcgcagcgggaactgtggcgcgcggtgagccacgacggtgacatcaccggcgggctggccgcaacgcggaccgcgggtggctaccccgtggtgttcaccagcaccctggggctc

SEQ ID NO: 365 - DNA, 200 bp, Mycobacterium paratuberculosis
acccatcaggacgccagcgggctgaccaacgtgcggacattgacccagaccccgggcgtctggctggactgccagaccgaggacgaggtcgccggaattcgtatgagctgggacatagctaccaatgtggttgccgcggaatcgatctcggtggctttttcccgattcgaggaggcggtgcggcgccacgcggggcaagc

SEQ ID NO: 366 - DNA, 200 bp, Mycobacterium paratuberculosis
cgagccgccgggcacggccgttgctccggcggtgggcgggtcacccgggcccgagtgggcgagcgcggtgatcgccgccgcgctgcgccactgccgacccgagcaggtgctgccgcaatacaccatgctggtgcggcgctgggaggcactgcgatacgtcccctcaggatacgccgcttccgacgtcgaacgggcggctc

SEQ ID NO: 367 - DNA, 200 bp, Mycobacterium paratuberculosis
gccggttggccggcatcgtcaccggagccgtgtcaccccagacgctgatcggagacccgcagctgacgcccgaggcgctgctgctgcgtgacgaccgcatgcggatggccctcgacgacctggccggggccatcttcgggcacgcgcgcacgctggggcggcggcttcgcgtcgtggaagtcggctcccggaccggcctg

SEQ ID NO: 368 - DNA, 200 bp, Mycobacterium paratuberculosis
atcaccgaacggttgaccgagctggtgggcgtggtggtcgaggaatacttgtgcctggagccaaacccgacgctcgccggaatcgccgccgggcggcgcttcccggccccgacccgccacgtcgacgcacccgacgcggcgtcgggcgtcgacgtggtgatctgctgtgggtcgctgcatcagctgcccgacgcggaggc

SEQ ID NO: 369 - DNA, 200 bp, Mycobacterium paratuberculosis
ggtcctcgaggcgatcaccgtgtccgacgacggttggctgtggatggtggagaattccgaggccacccaagcgacgctcatcagcgcggccgttctcgaccccggcctgctcgcgtccgattcgaagacgctgcgtccggccgatcggtggtggcggctcatcgccgaccacggttggcgaccgacgcacatgatccagg

SEQ ID NO: 370 - DNA, 200 bp, Mycobacterium paratuberculosis
acggacccggcctcacgctcatcgcgcaccgccccgacaagcccggcatgccgacaccgccggccgaacagcgccgcgacggtaggtggtcgcgaccggctgtgccggcgtcgtcgctgccgaccgacgccacggtggtggccacgcttgccgagatctggcagcgtcatctcgccattccaacacccggcgtcgacgac

SEQ ID NO: 371 - DNA, 200 bp, Mycobacterium paratuberculosis
gacttcttcctgctcggcggtgacagcctcgtcgcgacccgggtctacgccgaccttcgggccgccggtttcggccaactcgctttcgtcgacctgttcaaccactcgacgctcggtgagctcgcggcacacgccggcccgcgcaccggcccggaagtgtcggtggcggctgagtcgacccggggcggcacccacgaccc

SEQ ID NO: 372 - DNA, 200 bp, Mycobacterium paratuberculosis
gaaccgattcccgctcaccgtcgtgcagaacgcgtatcgggccgggcgagaaggcgcgttgatcctcggcggcgtcgccgcgcactgctacttcgagttcgagctcgcggacttcgaccggccgagattcgattcggccgcacgccaactcgtagcacgccacgccggactgcgcaccacggtgtcaccggcgggcaccg

SEQ ID NO: 373 - DNA, 200 bp, Mycobacterium paratuberculosis
acgcggcctcctcgggtgaggtcgccgtcgtgcacaccgcgccgatcgagcccgtcgtgcgagaccacgacgacgtgcgagccgcgatgcgcgaccagatcatcgacttgacggcccgcccgggcatcgacttcggggtgcaaacccgcggcgacgggcgcaccgtcgtcggcatcagcatggacaacaccatgctcgac

SEQ ID NO: 374 - DNA, 200 bp, Mycobacterium paratuberculosis
ggcgccagcatgatgatcgccctgtccgaactcgatcacctctatcgcggcgaaaccgttgaccaattgccgccgctggaaacgtctttcgcgcactacgtgtggaaccacccggagctgctgcccgacgccgacgaggcggtgctgccgcggctggccgccagccgagactattggcgcgcacgcctgccatctttgcc

SEQ ID NO: 375 - DNA, 200 bp, Mycobacterium paratuberculosis
gccggcgccgaaattggccgacatgtcactgctgttcgagatcgaggagccgaggttcgaacgggcaaccgcgaccattcccgccgtcgactggtcgcaggtaacgcgatcgtgccgtgccgagggcgtcaccgtcgcgtcatttctgctcgccaactatgcacgggtgctgtctcggtggtcggggaccgaccacttct

SEQ ID NO: 376 - DNA, 200 bp, Mycobacterium paratuberculosis
gcatcaacgtcacgctattcgaccgcgaccccgatgtcgtggggatcgaaaacgtcgtcggagatttcacttccctggtgttgttggagtgccgagtcgatgagcccgcctcgatctgggagagcgtgcgcgctctgcagcggcaattgatgaccgacctgccgcaccgcggcgcggacgcggtgtggctgcaacgcgaa

SEQ ID NO: 377 - DNA, 200 bp, Mycobacterium paratuberculosis
ctgctgcggtttcacggcaacccgacggccgcgctgtttcccgtcgtcttcaccagcggactgggccttgtcgacgcctcggctcgggcggcggtccggttcgccgaaccggtattcgccgcctcgcagacaccgcagacggtgttggacttccaggtgtgggaaagcgcgggggcgctgaagctgtcgtgggacttcgt

SEQ ID NO: 378 - DNA, 200 bp, Mycobacterium paratuberculosis
cagtcaggcggtgtcgccggccaccgcgcgcactcagctcgagtcgttggtggacggcatcaccggtgtcgccacacgcagccgccgcatcgaacacaagttgggcgagggggcatccaatgacgagctcctgcaacgtgtttcgaggatctgcgcgtccgccctgggtcagccgagggtcgaacctcacgacaatttct

SEQ ID NO: 379 - DNA, 200 bp, Mycobacterium paratuberculosis
tccagctcggcggcgattcggtcagcgcgaccaaggtggtcgaacagatcggccgtgagctgtcagcctcggccacccttcgactgctgttcgccaatccggtgatcggcgacttcgccgccaaaatcgccgacactgacaacgccgacgaacccgacctgaccgttgaggagggcatgttatgaccgcggccgagctcg

SEQ ID NO: 380 - DNA, 200 bp, Mycobacterium paratuberculosis
tcgaccacctgcggggtatcggcgtccaactgtgggccgacggtgagaatttgcgctaccgagcaccgcaacaagtcctcaccgcggacctgaaagctcaactggcggcggtcaaaacggacgtgattaccctgctggcggaagagacgaccctgctgcgcgcgccgcaggaccggttcgagccgtttccgctcaccgac

SEQ ID NO: 381 - DNA, 200 bp, Mycobacterium paratuberculosis
gtgcaagccgcatatctggtcgggcgcacgtcggcgtttcagtggggcggggtaggctgccacggctacgccgagttcgcggtcgaccacaccgtggcaacaccgagcgccgagcaatatcgggaggcgtggcgcaaggttgccgaccgccacgacatgttgcgctgcgtcgttcatcccgaggggtatcaggtgatatg

SEQ ID NO: 382 - DNA, 200 bp, Mycobacterium paratuberculosis
ccccgacgtgcccgacgacgggctggtcatccatcagtgtcacacggtcgaagacgttgccggcgtacgtgccggggtcacggaacatctgcgtaaccggatatatccgctgggcgaagcgccgatgtatgacctggtgatcacgatgggccctgacgacaccgtggtccatctgtccgttgacctgctgatcgccgact

SEQ ID NO: 383 - DNA, 200 bp, Mycobacterium paratuberculosis
tcgtcagcatctccatcctgatgaccgactttcagcagtgcttgcttgaccccgaatgcgaccttgcgcccgtcgatttcagcttccgcgactacctgctgaatctcgctcgcgagcgaagctcggccgccggtagtgcccgccgggaacgcgatctcgcctactggcgggatcggctcgatcagctgccgtcaccactg

SEQ ID NO: 384 - DNA, 200 bp, Mycobacterium paratuberculosis
tcgttaccggtgctgcccgacgactagacgccgtcagcgtcgcggacggcaccgaccttttcacggcgttcgatgcgcctgtcggccgagcgtttcgaggtgctcagccggcgcgcggcagagcacggagcgaccgtcaacgtcgccatcgtgacggcattcagccgggccatcgcacgctatggcgatcgcgaccattt

SEQ ID NO: 385 - DNA, 200 bp, Mycobacterium paratuberculosis
cctgctgaccctgacgaccatggaccgccacgcgttcactcccgccgtcgggcagttggtcggggatttcaccggcaccagcgtgctcgaagtcgatgtccgcggacagcgcaccttcgccgaactgctgcacggcgtcggtgatcgtctcttcgacgacatggaccattcgaccaccggcggcgtcaacgtcgcccggc

SEQ ID NO: 386 - DNA, 200 bp, Mycobacterium paratuberculosis
tcctggggcagcgcgacgacgaccgaggtgagcagacgcccgtcgtgttcacctcgacactcggcgccacgacccgaatcgacagcggcgcaacatctttgttgcacccgattcaaggtcgcggtctgagccagactcctcaggtgctgctggactgtcaggtcgccgaaatcgacggcatgcttgaggtcaactgggac

SEQ ID NO: 387 - DNA, 200 bp, Mycobacterium paratuberculosis
acccgcgatcaggccgtgcccgccgaggtcctcgaccgcgcgttcgccgacttccgccacgccctggatctgctcagcaccgacgcctcggcctggcaccggccgctattgccggcccagccccccgagaccacaccggtcgaggggccacgcacacaccatgaaccggcgctgatccataccgggttcctgcgcaacgt

SEQ ID NO: 388 - DNA, 200 bp, Mycobacterium paratuberculosis
gctggtgacaccggatgccgtcgccatccgccacggtgatcgggccaccacgtacgccgaattgctcgctgccgcgaccgcggtggccgacacgctggccgcgacgggggtgcggccgcgtgactacgtcggtatccggttgccgcagggccccgcccagatcgcggctctcctgggcgcattgctggcccgggccgcct

SEQ ID NO: 389 - DNA, 200 bp, Mycobacterium paratuberculosis
atgtgccgttggacgtcggctggcccactcaccgcgtcgaccagatcgcggcccaatgctcgctggcagcgctgtgcgagccggacggagaggtggaccggctgcttgccgacccgcagacctggtcaccgcgcgcggcggtggtgccggagccccacagcgaggtgctcgccccggacgacacggcctacgtcatcttc

SEQ ID NO: 390 - DNA, 200 bp, Mycobacterium paratuberculosis
acgtccggctcgaccggtgtacccaaaggcgtgatgatggcccacggggcggtggtgaacacactgaccgacatcaacgaccggctggccatccgcgcaagcgactcggtgctggcggtgtcgcagcacaccttcgacctctcggtgtacaacatcttcggagtcctcgccgccgggggcaccatcgtgttcgccgacgg

SEQ ID NO: 391 - DNA, 200 bp, Mycobacterium paratuberculosis
aaacgaaacaagcaacccgcaagcctggtgcgacgccatcaccgaccaccgcgtcaccgtgtggaactccgtcccggcccagatgcagcttctgctcgaccacgtcaacggcacacagaccttgccgtcactgcgcaacgtcatgctgtcgggagactggattccggtgtcgcagccccccgagatcgcggcgctcgccc

SEQ ID NO: 392 - DNA, 200 bp, Mycobacterium paratuberculosis
cgaacgcgtcgatgctcagcctgggcggggcaacggaagcggcgatctcgtcgatctgtcatccccttgccgcgcaggtctatcagcgcagcgttccgtacggaaccgcgatgcgcaaccaaagtgtgcgcgtgctgacccaccgcggcgaacccgcgtcgccctggcagatcggcgagatacacatcggcggactgggc

SEQ ID NO: 393 - DNA, 200 bp, Mycobacterium paratuberculosis
ttggcacagggatacctcggcgatcccgagcgcaccgcgtccgcattcgtcgtccatcccgtcagcggggagcggctgtaccgcaccggggattacggccgtctcatccacgacggggtcatcgagttcctcggacgccgcgacaaccaggtcaagatccacggtcaccgaatcgaattagccgaagtggactccgcgtt

SEQ ID NO: 394 - DNA, 200 bp, Mycobacterium paratuberculosis
aagtgcgctcgccggcgtgcacgccgcggtcagcaccgtcgtcggtcagggtccgcacgaccggctcctggcggccgtcgtcgtcgccgacgcggccgacgacgacgaaaaacggcaacgccgcgacatcgcggccgcggtgagatgcgctgccgccgacgcgcaccgcaacagcaccgccgacctcgacggcgacaagc

SEQ ID NO: 395 - DNA, 200 bp, Mycobacterium paratuberculosis
tcggccatttcgccagcacggcacgagcggtggcgatcgagagcatgtgcgcggcgctgcgaaccgtaatggacgtcggcgaacgaatcgatttcgccgaactcgccggacggttggccctaccgcaacggctggaacggttgctgcgccgatggctcgacgctcttgaggaagcgggcatggtcgtgatgcaccgggga

SEQ ID NO: 396 - DNA, 200 bp, Mycobacterium paratuberculosis
cccagtatcgaattacgcgggggacctgagctttccgcctgctcggcccagtggcagcacgtacgggcgctgggagcggccgtcgactacggcgacgaactgctggactacgtcggccagtgcgtcgagaatctgtccggcctactcgccggaaccgtcgacccactcgctttgctgttccccgagggaacgttggacac

SEQ ID NO: 397 - DNA, 200 bp, Mycobacterium paratuberculosis
cgctaccgccgcctaccgggacaacctggtcagcaggtacaccaacgggttggtgatcgccggggtggccgaacgtgcgcggtgggccaccccgacgcggccgctgcgagtactcgaagtcggggcgggtgtcggcggcaccagcgtcgggctcgttgcggcattggcccatcaccacgtccggtataccttcaccgacg

SEQ ID NO: 398 - DNA, 200 bp, Mycobacterium paratuberculosis
tctcccactttttcctcggccaagccgccaaaatgttcgccgagcacgacttcatcgactaccggctcttcgacgtcaaccaaccgcctgccgcacaagggctcccgccgggatccttcgacgtggtcgtgtgcgccaatgtcttgcacaacgccgtcaacgtcgatgacaccctggccatgtttgagcggttactggcg

SEQ ID NO: 399 - DNA, 200 bp, Mycobacterium paratuberculosis
ccgggcggctcgctggtcttcatcgacgccaccgccaccaatcaccccttgatgatctcgatggagttcaaggagggactgcacgggttcaccgacgcgcgcgcgggtaccaactcagctttcctgtcctatgcgcagtggggagacgcgttagagcgatcaccgttcggcgaggtatggagctttccgccaccggagca

SEQ ID NO: 400 - DNA, 200 bp, Mycobacterium paratuberculosis
agtcgcttcgcgccgcggcccggcggttcggccgcggcggagacggcgtgtcggccagtctggatgcgatgcagacgcgtatcgccgaggtctgggtcagcgtcctcgggctgccgtcaaccgaagccctgtcaccaaactcggatttctttgctttaggtggagattcgctgctgttggcgcaaacgatcggccgcatc

SEQ ID NO: 401 - DNA, 200 bp, Mycobacterium paratuberculosis
cgtcgagagatcgacgaagccgccggcatcgcgtgggacgacctgctgcgcgcaatggtgtctgatcccaccctggccgcagccgcgcaggcggttcagggatgcggtccgacagcggattccggggattacagcgctgaacttgactcgcccttggtgtatcttggtgcgggacaaggttttaggtcagggaccgagat

SEQ ID NO: 402 - DNA, 200 bp, Mycobacterium paratuberculosis
cgcggtttgcgtccacgacggaagcggtggcctggcgccgtacgagcagctggtgtcggagttgcggtcggctgctgacggcgcgcccgagctctacggcctacgcagggtcgccggtgacgcgtactcgcgtatcgcaccgccggagctgttcaccacactggcgtcgcgctacggcgccgcgatcactgctctggcac

SEQ ID NO: 403 - DNA, 200 bp, Mycobacterium paratuberculosis
ccagcaaggttcatctggtcggctactgcatgggtggcctgttggcgacagaaatcgccaaatgtctcgaggaatccggcattgtcgtcgcacccgtgaccgtggtcagctcctaccgcgtgccattcgacatcgaagacgacgacatcctcgactactgcttcgcccagatcatgggtgtatcgcccagcgatctagga

SEQ ID NO: 404 - DNA, 200 bp, Mycobacterium paratuberculosis
ttgcgggtcgcggatgacgccatccgcgcggcattcgcggccgtccggtcgcgccatgccgacctcataccgcccggcgctttgcgcgcggtcgccgcgccggagctcgccagcgccctcgatcagagcgccgctccgggggagcagcgattgaaactgcttgcacaatcgggcgttctgggggactcgtggaccgccga

SEQ ID NO: 405 - DNA, 200 bp, Mycobacterium paratuberculosis
gtcgctgaccgagctgcgggcgatctttgtgcatagcctgcggtcggtagtccagggggcggcggacccgtttttgggcgacgtccacttcctccggcagcgcggcgatatccatttcctgcccaccctcaaggaggacatgaccgaattctggcgtggctactgtcttggtgaattgaccatcacagagatcgacggga

SEQ ID NO: 406 - DNA, 200 bp, Mycobacterium paratuberculosis
accatttcgactgtctcaccggcgaaaacgcacgctctgtagccggcctgctcctagggtcttgggtggtgcgcacgtgaggaaggtgctgctgttaggcagtaccggagcggtcggatccggttgcctcgacgtcctttcgcggcgggacgatctcgcgatcgtcattgcgggacgcgacgaggcacggctgcgcgcgg

SEQ ID NO: 407 - DNA, 200 bp, Mycobacterium paratuberculosis
tcgcttctacgaaacggtcaggtgtcgaggttacgcgactggacatcgccgacgtaccggccgtcacggcgaccgcagcgcactgcgacattgtggtcaactgcgcgggtccgtcgtatcggttcagttcagacgtcgctcgcgccgccgtcggtgccggtgcggcttatgtcgaccccggtggtgaccagacgttgctt

SEQ ID NO: 408 - DNA, 200 bp, Mycobacterium paratuberculosis
gacagcctcgccgcgatcgaaacgaccgcccccgttgtactccaaacaggcgtacagcctggcctatcgggcctgctgctgcgggctctcgcgctgcgtcaccccgaacggatcgaaaacatgcatgcgtggtgcggtggattgcagcccctgacggcggcggcggtgcacgaatacctcgccagcctggaaagtccgca

SEQ ID NO: 409 - DNA, 200 bp, Mycobacterium paratuberculosis
tagctatcctgccagtgcactgcgcggcggcgccgtccgacgtgtccgcaacgaagagtgcgtaccggccccggcgcagtatttccccgacaccgcgtcagtgcatccacatctggactccgaaaccatcgcggtggctgcccagttgggtatcggaaaggtgtggtgggccaacgtgttagacggtgcacgcaccatac

SEQ ID NO: 410 - DNA, 200 bp, Mycobacterium paratuberculosis
gagcgatacatctcttggccgccgaggacagacaagggtgccgtgacaaggacctgcgggaagtgctggcagctgtcaagctcgacctgttcggccgcgccgcgtacttcgccatcgtgtgcgctgcgcaaagcgactccgtgtctacgactttggcggtgacatgcgaaaacagctatcgcgtatctggtgctctggct

SEQ ID NO: 411 - DNA, 200 bp, Mycobacterium paratuberculosis
gcctttgccgcacaacgtgttacgcgcatgaccgccggagtgcacccgttctggacagtggatgacccatgggatgtgctcgcgttcctggccgcgaccgtaccgtgactttgcggtatcattcgcgggcgatgcctcgcccgtcccgcatagcgcgctgtcggcggccgaggagggttcactgtgaccactcggccgca

SEQ ID NO: 412 - DNA, 200 bp, Mycobacterium paratuberculosis
ccgtcctcgggcgatcgtggtgggttcgacattcggcgccgtgtacgccgaagcgctggcggcgccggaatcgccggtggaactcgtcggattgttgtcgaccgggtctcggcaatccgccgatctagcctcgcgccttgccattccgctctataccggcatgaacagcctcccgcgcgtcgacatcgcgtttgtggtgg

SEQ ID NO: 413 - DNA, 200 bp, Mycobacterium paratuberculosis
tgcggtcaggagttgtcggcggtgagggaacacgagtgtgcaaggagttgctctcacgcggcgtgcatgtggtccaagagcagcccgttcacgctgacgagattatgtccctgctccacgtggccgcggaaaatgcggttctctacacggtgaacgacttctacagccgggtcgcgccgatgcgccaatttatctgtgcg

SEQ ID NO: 414 - DNA, 200 bp, Mycobacterium paratuberculosis
gccaagactctcgatagcctggcgcgtatcaggtacgttcatgcacgggcatcgctgcacgttgtctaccccttattcaccattctggcgagcatcgtcggcccgctgaccccggcccggatcgtcatgccggaacagaccggaggcgccttcgtcgccggccggattgtgctcgccgacgtccctgtcgacctgctgat

SEQ ID NO: 415 - DNA, 200 bp, Mycobacterium paratuberculosis
ccaaaatgagttgtgcgccagcgaaccagacaactacgcacggttgttgcacaccctcacggtagggtccgacgccggcgaactcgtcctcgaccacacccacgggccaacacggtggcatccgcgtccgtaccccgatagctgggcgtcgcagtccggctgtcctatctccgaacgtgtcggtatcgactttgacccga

SEQ ID NO: 416 - DNA, 200 bp, Mycobacterium paratuberculosis
cgacggcgacggtgcgcaacgaactctggcccgacgcggtccggttggccgcctccgaatttctcggatcgatcggccgcgtgcgcgcaggggttacgcaacgattcgtccgggccacccggctgtggtccgaatttacgtcggcgatggggcctgccgcaccgatcaatccggtgacatcggcaaggctttcggcctcg

SEQ ID NO: 417 - DNA, 200 bp, Mycobacterium paratuberculosis
gagctggttgccttatgaccgtgcgtatcggagcactgaccgaaccgacacccggcaaccgcaccgtcgtcgtcttcccgcacgcgggcgccagcccgcgcttctacgcttcctggtgccgcctactgcccgctggcgtcgatctctacggtgtcacctatccgggccgggacatgctgctcgacgagcccgtacccgaa

SEQ ID NO: 418 - DNA, 200 bp, Mycobacterium paratuberculosis
acgcttgctgacttggcctgcaactgcgcagtagagctgaagccgatcatctactcgtcgagttctgttgtggtctttggtcattcgatgggcagtctcgtcgcgtttgaaaccatccgagaacttgaacaggatggagtatcggtgactgctctggtcgcttcaggggcggacgcaccgcatctggaaaccgaccagtc

SEQ ID NO: 419 - DNA, 200 bp, Mycobacterium paratuberculosis
gtggcaccgtgctgcggacgaggacctgatccagcacctggccgaactcgacagccgcagtcgcgacgtgttcgccgtacccgaattgcggcggatgttattacccaccgtccgcgaggacttccgcctcgtcgaaagttatcgcgccgagctgcacccgccggtttcctgtcccatccatgtcatgaccggggatgcgg

SEQ ID NO: 420 - DNA, 200 bp, Mycobacterium paratuberculosis
acggaaaatgcttgacccgatataccctacgggggtagtgtaatatgcatgaacgacaacctgaattgcacgtgtaggtccaccggatgtacgtgcggggaatctggctgcacccaagcgcatggctgcaaatgcggtcacccgaattgcacgtgtaacgactgatcgccaacagttaccgcctcgactctcgttgaggc

SEQ ID NO: 421 - DNA, 200 bp, Mycobacterium paratuberculosis
ggtaactgtttcgcgtgagatgcccactcgggcggaatgcacagcgatccgtcttagttctgatggctgactcgggccaggttcaggtcggcccgcaatcgggccggtagatctgcgctttcccagcccccggcggcgacccaccggcaggcaaccctcgcgtcggcatcggtctcaataggtccaacccaaaccatcgc

SEQ ID NO: 422 - DNA, 200 bp, Mycobacterium paratuberculosis
ggcgctgggcgtccggtcaaccgtgcacggctgcaggaccatgatcgggctgcgactgggatgcatcgttgcacaggtaaattcgccgaggaggcactgagtctgtaccagtacgccgtgcggagaccggcgtacgagccgacgcagcagcgtcatgatcaggggctcctgctccgcggtacaccgcctgcataccgcga

SEQ ID NO: 423 - DNA, 200 bp, Mycobacterium paratuberculosis
cggtgaacggtcgatatgtccagcatcggtccgacatgtcgccgtctcctcctttttcactgtgacgctttacaacctgcgctcattcgcggtaggccaaccaggtgcgaccatcaagacgtgtctccgatcctgtcgtcggcgccgtgcccacgaatgatgtctggatgctcgccggcagagccataggaaaccgactc

SEQ ID NO: 424 - DNA, 200 bp, Mycobacterium paratuberculosis
aaatggaccagcgcgccaatcaccaaagggatcggcatagtttgcccaccggccgggctgagaaaactcttcgtcggtcagcagtgcccatcgtaggattcggaggatctcaccgggatcggcgccacaagtgaggatggtcatcgcgacatgtcggtctccgtgctggtcgtcccagcgcgccgcggccatgatacgtc

SEQ ID NO: 425 - DNA, 200 bp, Mycobacterium paratuberculosis
gatcggcatccgcggcggccatctcggacgcgtccatggctgccagccaacggccgacgttgcccacgcgcagttccattccagccgattcgatccataccactgtgtcgggctggctggctagccatactcgaccgcgagttctgaccacgccctcgagcagcacatcgatggcggtgtgcaatcgggcgggatgaaat

SEQ ID NO: 426 - DNA, 200 bp, Mycobacterium paratuberculosis
ggccgcgttgcagtgaaatcgagaagggaaacgcctgcctcggatacgagcggcggctgtccggtaaggagcgattcatgcgggtcgaagtcggcgcctcggcgtgcgaggggatgcaggttgcgcaagattgattcgatactcgttatgtcgcaggtgattcgcgacctcggcgccagtcgccgaagcacggcctcggt

SEQ ID NO: 427 - DNA, 200 bp, Mycobacterium paratuberculosis
cctgcgttcgggtttggacaacaccagcacgtcggcgaattcggcttggtcgaccaccgcttgggcggcgctgcgatggtcgtccagttcgtcatcgcccatggcgtgggccagccagctatccgtgtcgacacacgtcaccacagaactgatgtgcacatcgagggccgcgggtccgtcagcgtagccggggccaacgc

SEQ ID NO: 428 - DNA, 200 bp, Mycobacterium paratuberculosis
acaccggggtgtgattgatcgcgtagcaaatcagctcgagttcggtccgctcgtcgagtagcacgacgacacggtccacgtcctgtcgacgatggacacgccgcaacaggatgagcaagtcgtcgtggatcgtacgccctgggtctgcgttgcccagctcgaggatccaatcactgtcccacggtgcgcccgcgcgcagc

SEQ ID NO: 429 - DNA, 200 bp, Mycobacterium paratuberculosis
atactcacccgtcgtcgcaccacatgtccgtcgagggtgtggctaatcactgcggtgcccggtgtttccctcagggcggcggcgacccggccggtgcagcctcgtccggtcaggagcaccacgggagtgtgcatacccctccttatcgacaatcgttttcatctagccgagtttcacggtacagtcccagcggaatgttg

SEQ ID NO: 430 - DNA, 200 bp, Mycobacterium paratuberculosis
ttggactggtagtaggcccgagattgcgggtcgcagcggatcgcggtcagcgcggacatgtacatcactgggcgcaggcgacgactgtaacgctgcggtgtgtgcagtcgtccggtgcgtttacccgaatcgctagggactggggccaggccggcccaggcggcgagctggtcggccgacccgattctggcggggtcgcc

SEQ ID NO: 431 - DNA, 200 bp, Mycobacterium paratuberculosis
tgctgacgcagccggttgatggtgcgggtgcggtcggcgaccaggtcggtgcgatgggcggtcagcatccgcagttcggtgatcaggtcatcgtcgggcgccaggaccggcagatcggccccacgcatccgggattgatcggcgatcacccgggcgtctttggcgtcagtcttggcctcaccgccgcgatagaccgccga

SEQ ID NO: 432 - DNA, 200 bp, Mycobacterium paratuberculosis
ggcctgccacaccgcccgaccgctcaggtaacgcaccggcgtatcggcagcagccaacgctgtcaacaacaacgccgcatataccgtggtcagatcgaccgtccaggacacctcctcagccagttggtcaatctcggcgacgagttcacggatgggttgctcgtcgttgacgagcttgcgcgacaacaccaccgcaccgg

SEQ ID NO: 433 - DNA, 200 bp, Mycobacterium paratuberculosis
gtcctctcaagccgcacactaggccggcaagacacatgcagcctcacccgacccacccgggttgcagcacaacgtaacaacacgaagtaactgcacctacgaacttaaggaggatccatgggccgactggccggcaaggttgcgctcgtgacaggtggaggtcgcggccagggccgcagccatgcggtgcacttggccga

SEQ ID NO: 434 - DNA, 200 bp, Mycobacterium paratuberculosis
tgaaggcgccgacctcatcgtcgtggacatcggcgaggacattcccagcaatcagtacgcactggccacacgggctgacttggacgacaccgcgaagctcgtcgagaaggccggtcgccgcgttgtcgccgcacaggtggatgtccgcgaccgggtcggtctgaaggcgctcctcgatgaagcggtcactcaactcggcg

SEQ ID NO: 435 - DNA, 200 bp, Mycobacterium paratuberculosis
gcctgcacgtcattgtggctaatgccggaatctgcccgcttggcaacgacattcccgtccaaggcttcgtcgatgcctttgacgtcgacttcatcggtgtcgtcaacaccgtccatagcggactaccacacctcaacgccggtgcttcgatcattgtgaccggatcagtagccgggctggtgccgcaagctggcggcgtt

SEQ ID NO: 436 - DNA, 200 bp, Mycobacterium paratuberculosis
agcggtcagggcgggctgcagggacccggcggcgacggttatggcctggcgaagaaggtgattcgtgattacacccggtcgctggctctgacattgggtccacagcagatcagagtcaacgcgatacatccgacaaacgtcaacaccgagatgctgcacaacccggccatgtaccaaacctttcgtcccgatctaaccaa

SEQ ID NO: 437 - DNA, 200 bp, Mycobacterium paratuberculosis
tccgagtcgcgaagacgccgaagtaacttttcccttcatgcaggccatgccgattccctacatcgatccttgcgatgtgtcgcatgccgtggtgtatctggcagccgacgaatcgcgttacgtcaccgggcagcagctctttgtcgatgccggggcttcactgaagctcggcatgtaagggttatgtcctggttcggcat

SEQ ID NO: 438 - DNA, 200 bp, Mycobacterium paratuberculosis
gagtggaacacgaccggcgtgggcaatgcgggcctaccacggcgatctcgagactcgtcgatccgttgtccgaaggtgatcgggtggcacgtattccagtcgccaagatggtgaagaagctttggatcgtgctggtcatcgtagccgtgatcgcggtggcgggactctgtgtctcgcgcctacgtgccgccttcgccaac

SEQ ID NO: 439 - DNA, 200 bp, Mycobacterium paratuberculosis
cgcgacgaccggccgatcagcagcggtgccgctgacgacatcaagccgttcaatcccaagcgggtggtctacgaggtctacggcccgccgaagacggtggccgacatcaattatctggacatcaatgcccagcctcagaaagtcgccaatgtggcgctgccgtggacgctttcggtgatcacgacgcttccctcgatgag

SEQ ID NO: 440 - DNA, 200 bp, Mycobacterium paratuberculosis
cgtcaacgttgtcgcgcaggcagacaccgatcagatcggctgccggatcatcgtgaacgaagtggtgaaagacgaaaggtcggctgacggcgtgcgcgctcaaaccttttgcatagtgaagtcggcatgagcatcgaccacttcgggcagccccccaaaccccagacgttcgcccgcgcggtccgtaggtttgcggtgcc

SEQ ID NO: 441 - DNA, 200 bp, Mycobacterium paratuberculosis
tgggcgacaatgcgcatcacttctacgatcagatcgtccacatgctcgagcaggaccacaagcatatccagcatgtccaggacttctggggcgatccgctcaccgcagccggatcgcaaagctccgacggcaaagccgcctacgtgcaggtgtatctcgctggcaatcagggtgagagcctggctaacgaatccgtcgcc

SEQ ID NO: 442 - DNA, 200 bp, Mycobacterium paratuberculosis
gcggtccgcaagaccgtgggcagtgtgcccgcgccgccgggaatcaaagcctatgtgaccggccccgcggcactgctggccgatcaatcctcggcaggcgagaggggggtgcagaaggtcacgatgatcaccttcggggtgatcatcgtgatgctgctgtgggtttaccgctccatcgtcaccgtgctcattaccctgat

SEQ ID NO: 443 - DNA, 200 bp, Mycobacterium paratuberculosis
ccatgtttcacgggacggcccacgttgtcttgggctcgggtctgaccatcgctggggcgatgtactgcctcagcttcacccgcctgccctatttccagacgctcggagtgccctgtgcggtcggcatgctcgtcgccgtcttcgccgcgctgactctcggaccggccgtcttgacggtgggcagccggttcggtctgttc

SEQ ID NO: 444 - DNA, 200 bp, Mycobacterium paratuberculosis
gcggcacttccccaacgcccggatgaatcccgagttgctgttggtcgaaaccgatcacgacatgcgcaacccggcgggcatgctggtgctggaccgcattgctcggggcgtcttccaccttcccggcgtggcgcgcgtccaggcgatcacccggccgttagggactccgatcgagcacacctcgatcccattccagatca

SEQ ID NO: 445 - DNA, 200 bp, Mycobacterium paratuberculosis
gcatgcagaacacgattcaggtggaaaaccaggagtacatgaagcagcggatgaaggacatgctgcagcaggccgacgccatgcagcagaccatcgacacgatgcagcggatgtacaacatcacggcccagctggtcgccaccacacaccacatgacgggcctgacacacgagatgacagatatcaccaaggaattgcgt

SEQ ID NO: 446 - DNA, 200 bp, Mycobacterium paratuberculosis
ggcgcagatgccgccgatgatcgcgcccatgacgacgatgaagacgatgatgctgaccatgcacagctcgatgtcgtcgctgtatgaccagatggacgtgatgagccagaactcgaccgccatgggacaggcgttcgatgcgtcgaagaacgacgactcgttctacatcccgccggaggtcttcgacaaccccgatttca

SEQ ID NO: 447 - DNA, 200 bp, Mycobacterium paratuberculosis
agcggggcctgaagatgttcctgtcgccggacgggcacgcggcccgattcatcatctcccatgagggggaccccgctacccccgaagggatttcgcacgtcgacccgatcaagaacgcggccaaggaagccatcaaggggacgcctctggagggtgcgaagatctggctagccggaacggctgcggtctataaggacatg

SEQ ID NO: 448 - DNA, 200 bp, Mycobacterium paratuberculosis
aaggtggccccgccggataccacgaccgtgtcgtggctgccgttttatcacgacttgggtttaattttagggatctgtgcgccgattttggccggagtccgcagtgtttttactagtccggtggccttcttacagcgcccggcgcgatggatgcagttgctggccaacaatagtcgggtcttttcggcggcgccaaactt

SEQ ID NO: 449 - DNA, 200 bp, Mycobacterium paratuberculosis
cgctttcgacttggcggcgagaaaaacgactgacgaggacatggccgggctggatttaagggacgtgctcattatccaaagcggcgcagagcgggtgcagcccgcctcgatgcggcgattccaagaccggttcgcgaagttcaacctccgcgacacggtgatacggccttcctatgggctcgccgaagcgactgtttacg

SEQ ID NO: 450 - DNA, 200 bp, Mycobacterium paratuberculosis
tcgcgacccgcacaccggcgctaccgccccgagtcgtctactttcagcccgaaatcctatcttccggacacgcgaaggggtgcgagagcggaagcggcaccgcgttggtcagttacggtgtgccacggtcgcagacgatccgcatcgtcgatcccgaaaccagcactgagtgcccaccgggaacggtcggcgagatctgg

SEQ ID NO: 451 - DNA, 200 bp, Mycobacterium paratuberculosis
gtgcatggtgagaacgtttcggcgggctattggcagcgacctcacgagactgaaaagaccttcggcgcaaggcttattggtccgtcggccggcacaccacaagggccttggttgaggaccggggactcgggcttcttcttcgacggcgaattattcatcatcgggcgtatgaaagatctgttgattgtgtacggacgcaa

SEQ ID NO: 452 - DNA, 200 bp, Mycobacterium paratuberculosis
ccattctcccgacgacatcgaatcgacggtacaagcgatcgcacccgggcggtgtgcggcggtagcggttccggctgagggcaccgaaaaagttgtggtaatcgtcgaatccaagaaacgcggtggctcagacgaggaagtaatgaacaacctcgccgccgtcaaacgcgaacttacttcggcgatttcgaattcgcacg

SEQ ID NO: 453 - DNA, 200 bp, Mycobacterium paratuberculosis
gcctcgccgtggcggacgtcgtcctggttgcgcccggctcgattcccatcaccaccagcggcaaggtcaggcgagcgacgtgcgtcgagcagtacaagcaggaccagttcgcccgtctggacgtgtagggtgctcaagaaccaggcaggtgcgcaatcgctttcatctcagctgttctgcacgatgaagtcagccaaacc

SEQ ID NO: 454 - DNA, 200 bp, Mycobacterium paratuberculosis
catgattgatctgtggcggtcgtgatgcctcgggcgcggatatattcgcgggtggcgcatccgggcggtgccattccggacaatcggctcgcgttcaccgatcagatgtcgtttctctcggtgcgcgctaccggacaggggacggtcgctcagtgtgtgtggatttatgagcggaccgtcgatttcgaaggcctgcgacg

SEQ ID NO: 455 - DNA, 200 bp, Mycobacterium paratuberculosis
cttccaccgcaatctggatctcgggttgttgggtcgacgaatagaacgttctccgctgccgttcggccgtgatcggtgggtttcctctcccccctccgtggacatcgaagtcgctgagggcgcccgtccgcgcagcgagctcagcgagtgggctgacgaacgtggacgactacctgttaacgccgaacggggtcccgctt

SEQ ID NO: 456 - DNA, 200 bp, Mycobacterium paratuberculosis
ggcatctcggcgttgcgcacttcacggatggctcgacagcggtcagcctggttgcatcgcacttggtggtggacggactcggtttctgcctggcgatcgcggacgccgtcaacgggaccgcccgcgatctgggctacccgccgccacgttcacgccaccgactgcgtgcggtggttcaggatgcctaccaaagcgcgcgg

SEQ ID NO: 457 - DNA, 200 bp, Mycobacterium paratuberculosis
ggaacacatgaggttgcgcgagcactcttcacggcagtgcaagcggggagtcgtcgacgctccgatgttgcgagggtgcgggcggcgcggcccatgcctattcacagaagcaacccggacgacggcgtgatggcaccggccattacgatctatatcgatccggatgagtgggatgcccgagcaaaatcacttggtggaac

SEQ ID NO: 458 - DNA, 200 bp, Mycobacterium paratuberculosis
gagtaattcactcttcgcgggtgtcgccgcgaagctcgctgagcactctggatgccggtctgccgatgacggcaccgtggcgatatcgttcccggttagcgaccgtaccgaggatgacatgcgtgctaacgcattgtcgtttgtgatcgtcatagtcgatccagcacaggcaacaacggatttgcgcggtatccgaggcg

SEQ ID NO: 459 - DNA, 200 bp, Mycobacterium paratuberculosis
cgataagccaggcgcttcagaccctgcaggaaaacccagaggaactcttgcaggtgcttccgctggccccgctgacgccgaaacgggtgatgagaaagttggcccacgtggcgtacggctacaccgacgtggggtgctcggccattggcgaactcgatccggcggtgggacgacccgatggtaccgacgcagaccatgtc

SEQ ID NO: 460 - DNA, 200 bp, Mycobacterium paratuberculosis
ttcattcgtggagtacggcaacgctttacgcgtcaaaacttcgatcgcccccgcggcatcttcatggtctcggggcggatccgcggacgaatgttcatcaccatcgtggcctatcagctcgagggcagggattcgaagcatcacctgcatgagctggtggcgcaaacgctttcggagttcgacctgacgggaacgattga

SEQ ID NO: 461 - DNA, 200 bp, Mycobacterium paratuberculosis
ctaatccttttcgagaatgtacatccggtatgaattggcctgaccccgatcggttgatccatcgcttatgagcgtcttgtggcccaacgagatgggcaggaaagctcaacacggtcatggcgacgaggaagcggcacactcctgagcagattgtgcgtaagctgacggcagctcggctgcgggctgcgggtaatgagacc

SEQ ID NO: 462 - DNA, 200 bp, Mycobacterium paratuberculosis
gcggcggtatgccgcgagttgggtgtgtcggaggtgacgtatcactgctggcgtaatcagttcggcggactcaaggccgaggacgccaaacggctcaaggattcgaacgcgagaacgccaccctcaatgggctctggttaatgcgacgttagagaaggacgcgctgcgggagagagcacaccagatgatccagacgtcgc

SEQ ID NO: 463 - DNA, 200 bp, Mycobacterium paratuberculosis
gttgcggacctgcctacgccagtacgccaaagatcatccccgccgcagattccgctccgcctaccacgatgcgcgcgccgagggctgggccgtcaaccacaagaagctccaacggcgttggcgcgatgaaggcctgcgtgtgccacagcgacgacgcacggcatatcaacagcgctacccacggtcgtcgcggatgcgcc

SEQ ID NO: 464 - DNA, 200 bp, Mycobacterium paratuberculosis
cgaccaggcgtgagcggtggacttccaattcgacgtcagtatcgatggccggccaatcaagatcgtctcaatcgtcgacgagcacacccgcgaatgcctcgcgggaatggtcgagcgcagcatcaccggtgagcatctgattgccgagctggaccagctggccgttcagcacggcacctatcccgggtgctgcggtgcaa

SEQ ID NO: 465 - DNA, 200 bp, Mycobacterium paratuberculosis
caatgccccctgaattagcgtgcagcgcaatagctggctgggccagcggccaaattggcccgggtagccatcagcgactggaaacacgactacaaccaccaccgccgacactcggtcctgggcattggtgtggcatggcgcgggatccgataattctcgatcaggcaacgccgcccggacgccagccgagttgcaacaag

SEQ ID NO: 466 - DNA, 200 bp, Mycobacterium paratuberculosis
aggcctaggtcgtcgcggatggcgcggtggtgggtgatttggccgtcggtgatggtgaagatgtgaacttgtttgtgttcgatgtgtttgccggtaggttggatgccgttgaaaataccggtatgttcgccggtcatcgtgctcaccgcgatgaccgtgttgccttcggcgagcgtttcttgatgctcgaagctcaggtt

SEQ ID NO: 467 - DNA, 200 bp, Mycobacterium paratuberculosis
ggagaaggcgttgcgcaaccattggctggtggccaggaaccctgccgcgccgtgttgttggcgttcgacctcctcagggtcgtcatcggcttcttgattgacgaagtcggaagcgatgattttctccgccagttcgacgtcgccgttttcaatcaatcgaaaagattccagtgcaacggttttggtgtcagacatcggct

SEQ ID NO: 468 - DNA, 200 bp, Mycobacterium paratuberculosis
ttggccttccttgatattggttgggttaactttgtgcggagtacagcttgccgcggccaggtcagtagtttgatcagttggctgaagtcatagccctgttctgtgggccgcatctggacgatgaggaccctggcccctgcggctacatattcgtcggcggatttgtcatcgaaccagggcaccgctcgggtgatggcggt

SEQ ID NO: 469 - DNA, 200 bp, Mycobacterium paratuberculosis
gccgtctcggccgttgtgttgcgcgagatcgtccagcagttgacttttgatgcggaactgttcgatcggcaggaaggtgtgccagatgtcagcgtggcgggcgactctcgggagggttttcttttcacccgagctgccgatcaggatgggtattgggtgcagcggtggcggttttagttgcgcgagacggtatttgatgc

SEQ ID NO: 470 - DNA, 200 bp, Mycobacterium paratuberculosis
gcgcaaggctggcgtcgaagagcgacatgcgggatgcgacagtaccgaattcgtatccgtaggtggcatagtccttttcgtaccggccagcgcccaaacccaagatgagtcgtccgttgctgatgtggtcgacggtgcgggccatgtctgccagcaggtcggggttgcggtagccgactccggtaaccagcaacccgatc

SEQ ID NO: 471 - DNA, 200 bp, Mycobacterium paratuberculosis
tgggctcggttgatgatttcaccccaggacgcaagggcgctccaaccctcaaagtggttcacctcgggctgatgtggggacaacacggggccggcatcggtggccttgtcaaaaaccggttcgtgaaaatggtcgtatccaaagatcaggtcggcccccatacattcggcttggatgaccgcggcacgccaggtccggta

SEQ ID NO: 472 - DNA, 200 bp, Mycobacterium paratuberculosis
gttcggggtcccggccggctggatctgaacaccaacggaggagatcattgcccgccacccggctgtcgatcccgcgagggttgcagtcggtgggtgatccagtcgaggatgattgactgggtatctgccgtgtagcccatgtgcccggtggcaaagaaccgcgccgatttgggggacccgtgctcgagcagcaggtagta

SEQ ID NO: 473 - DNA, 200 bp, Mycobacterium paratuberculosis
gtcgctgatcgggaatacggtgtcgtgtagcccgttgatgagcagcgtctcagcgcagggccggtccaggataccttggcgtacaagggacagcttcggcgcgtagtccacccattgctcgaaggtgtcgcgcccaaatgcataggcgagggtctcggccagctcgaaggggtactcgcctgattgggcctgctcgatcc

SEQ ID NO: 474 - DNA, 200 bp, Mycobacterium paratuberculosis
actcggcgtcaaagccatggtcgatgcagccgccttggctgaccacacaggcgagggagttccggtgggtgtgggcgattttggccgcccagtagccaccggtactaccaccccaatagcccacacccgccgggtcgagttcgggtcgcccggcgatccactccaacacgggggtgaacattcgctcggcgtcctccgaa

SEQ ID NO: 475 - DNA, 200 bp, Mycobacterium paratuberculosis
ccagccagcggagcatcaccgaccccggggatgtcgatcgccaatgttgcgacgttccgggcgagcacctgatcggtgtgcatgtcttccttgaaggtgtcgatcccgcccgagacgagcaatacaggcagccggtccgtcgccttcgggacacgcagatgggcgatgatgcggtcaccctccccgggccgcccggcgaa

SEQ ID NO: 476 - DNA, 200 bp, Mycobacterium paratuberculosis
cgggatctcgacacgctcgatggggatgtcgaagtaccgggatgcgcgcagcaacatttcctgcgacttgcggtaggcgctcttcttaccggccgaattcatcgtcgggtagcgggccatgcggtagtagccataggcgcgcaaatagttttcgtgtgccacactggtgtcgccaatctgttcggcctcttcggctcggg

SEQ ID NO: 477 - DNA, 200 bp, Mycobacterium paratuberculosis
cctgatagcgtgcggccacggcactgaacgcggccgcccaggcgtcgcgatcataggagttcaggccgctcaacacgccctgcacatcatcggcgagcgtgtactgaaacggataaattcccgccgtggccgagaccgccatagcggccatagctcggtcaccggtcgcgtgtgtcgcttcacacggccaagttatgacc

SEQ ID NO: 478 - DNA, 200 bp, Mycobacterium paratuberculosis
gctcgcggctgcagatattggagaaaacggacatctcacgcgtgccgtgggcgagccgcaccgggaagttctgtgggagccgctccagccagtgccaggcattcgctgatcaggtgggactgatcggcgtaacccgcctcgatcgctagatcggcccaccggattcggtgatcaccggcatggatcaaatccagcagccg

SEQ ID NO: 479 - DNA, 200 bp, Mycobacterium paratuberculosis
ctggaaccggaaaatccggccaagccgcttggggccgaagccgaccgcggcgtcgaaccgacggcgaagctgccgctcgctcaacccaacagaggaggcgacatccgaaacagagcgggccgggtggacacgcagcatctcgattgagtgcgccactggctgatcgaccacgggatcgatcttgaccacataccgcgcca

SEQ ID NO: 480 - DNA, 200 bp, Mycobacterium paratuberculosis
gcaccgccgccaataatgcgacccgttgccgaaaagcgttggcctccagcacatcctcagccaatccggacgcggatgtcccgaacaccgagtcaacccggatctgggtatctcttaactcgctgacaggatggcccagcaccgcggcggcagcacccggtcgtaaccgcagaccgatcatcgcaccttcggtgcccgca

SEQ ID NO: 481 - DNA, 200 bp, Mycobacterium paratuberculosis
cattggtcgtaaaaggttgtggccggaccagaaaccatgactgcgccctcggcggtgacgaacagatcgacgcaaccgtccggcatcacccgcagcgccccacccgcggtattcgagcgcacccagccacagtccacatacggcgcgagcgcacccaaaggtcgacactccaaatacccgaccatcacgctcacattcag

SEQ ID NO: 482 - DNA, 200 bp, Mycobacterium paratuberculosis
ccaggtcctacgtcgctccgcaacaaattgggccgcaatccttcgaagccgcccggtcagcgcagactcccaggcggcaatactcgtgaaccgtaaactgcggcgtagaggaaatgcccgccagggcgcaacacccgcgccacttcggcgagaaagcgtgacagggaggttgtgccccgtgaagtggtgtaaagccgatc

SEQ ID NO: 483 - DNA, 200 bp, Mycobacterium paratuberculosis
ttggccgaggattcgatattgagcaccgcatcgaacgactcgtcggggaaggacagattttgggcgtcacctcgcacaaaatcgagtccaggcacgatgtgccgttttcggcagaaggcgataccggcctgatttaagtcgacccccgtgtacgaggcgggccgcatggtgcgcgtgagatatgaggccccgccgccgtt

SEQ ID NO: 484 - DNA, 200 bp, Mycobacterium paratuberculosis
gccgcagccaacttccagcacccgcctgccgctgagatccgcctgagccgccgtgcggtggtagagctggatgcagtaccgattgcgctcgtcggcggcatcgagcggcaaggacatcggcgggtcttcctcgtatcaaattgaggaagacaacgtcatcgcggctgagtcgacgactgagcaacgagtaaccatacttc

SEQ ID NO: 485 - DNA, 200 bp, Mycobacterium paratuberculosis
tggtacttctgctgatacctctgttgaaacttctgaccgagcttgaagaggactgggtaacctttcggctgcttggatgctgaaggcattaggcgccacccagcccggcagccaccatccagaccgcctccgcagcaacgacgacggccaggagctgccagcggcggggcagcacccaatcgtgtattcgctgcatgacc

SEQ ID NO: 486 - DNA, 200 bp, Mycobacterium paratuberculosis
gcttgggtttgcgccggtgacgccgagtagctgacgagggggatctctatgaccaaaagcattacgactgtgaacatgacagcggcgctgaactgcacgccgacggagttgcccgacgccgcgatggccgcgagtgcaatcggatactcgaccgctggaaatccagagccgaggccgagtataaacgccacagacaggcc

SEQ ID NO: 487 - DNA, 200 bp, Mycobacterium paratuberculosis
gtcgctggtcagtacatccctgatgcggccgcgaagccgcgccaacgtgctcggcgtgttcggccgcggcagcccggcgcgacgatcgacgctggcactcgttacccgtgtcggccggaccgaagagctgacggcgaccaatgccgtgatcgcgagaatgaccagaccgattgcgatttgagtgtgtctggcatcaggag

SEQ ID NO: 488 - DNA, 200 bp, Mycobacterium paratuberculosis
ttgcggacagggcggacacggattgcatcaacgtcggtgcgaaagagtgcaccaccgtcagaacacccacccctgcggtgatcgccgttgccatggcgccaagccaaaacgcgagcaggttgagcacgggtcgtgaccgcgaaatcaagagaagagcgatgcccagacgcaccgggttggtcgccgcgattagcgccatc

SEQ ID NO: 489 - DNA, 200 bp, Mycobacterium paratuberculosis
gcgataacggtatccatcggctatgtcgtctccccgcgagcggcattctccagaagatcggcggccaccgctgcgctatcggaggatttcgtcatccttttggctacttcgcgggcccgagtcatgtagtgaggcctgaggatcgagcgcaggcacgtggccagcgattcctccgttgtcttcgagaaacgttgactaga

SEQ ID NO: 490 - DNA, 200 bp, Mycobacterium paratuberculosis
accgactttcatctgcttgacggcagctccccagagcggctgctcgttcctcatccaaaggaccaacgtggggactccggctcgcatgcccgcggcggtggtaccggcgccgccgtggtggacgacagcgcgacaggcgggaaaaatggccgcgtggttcatcgccgccacgatcttgacgtggccggagcgcgggacgt

SEQ ID NO: 491 - DNA, 200 bp, Mycobacterium paratuberculosis
gggttaagtcattggtgcctgcgcaaatcaacgctcgctcatccagtcgcgtgcaggccgcgctgatcattgcgacggtgtcggctggtgatttgaccggtaggctcccgaagccgaaatagacgggcggtgatccggcggcaatccacgacaagacttcggcatcggcgtccgtcggtaaccccagcgtcagcgcgccg

SEQ ID NO: 492 - DNA, 200 bp, Mycobacterium paratuberculosis
acgaagggccgttgaccatcccagtgcgcccattcggctgctagcccgggaaagagaaaatcctcgtatgcctggatctccagagacttacgccccacgatgcggcgcgtcgaggaaccgctcgccttcgacagacccaatcgccggcgctggctctcctcggccttgttcgtcacgcaccagtacccgcaccagaaggc

SEQ ID NO: 493 - DNA, 200 bp, Mycobacterium paratuberculosis
cgaaaccgctaagcggctcaacggcgacggaacgttcgggagaagccggccgttgacccgggccggcagacaatgcaacgtggcgagcgggatgtcgcagtattcggcgacattggcagcaagtccctgctgcgccacggcagtcaacaatagatcggccccgttcgccagtgatgtcagcgtctcccccatctccagcc

SEQ ID NO: 494 - DNA, 200 bp, Mycobacterium paratuberculosis
agattcggccgaagtactccttcgatgtggacagcagtttgatcggattcgtcttcttaccaaacagcacgtcccgcgtgtccggcccatagtcgatcgcggtaacaccggccgactcgacgaagccacgcaggtcgggcggggctgcaacacaaacttcgtgtccccgacgcaacagctctcgggcgattgcggcatgg

SEQ ID NO: 495 - DNA, 200 bp, Mycobacterium paratuberculosis
ggctcgacatcgccgcgagagccgtagacggccaaagcgaatttcatctgcgggtccttggcatcagccgaaaggctgtgccactcgttgcatggggtgcgaccaattggaaccggcccattcgttgcgtgcctcacgtcgagaacccaactgcggatgcatcgcagcgtggttgaggtgagactccaccgggtcgccgc

SEQ ID NO: 496 - DNA, 200 bp, Mycobacterium paratuberculosis
catctacgacacgggcgtacaccgatttcatcactgccaggtagcgggtcacggattggcgggcgatcggattgttcgggaacaacacgatcacttgggtttcgctctcaagccgatttacccggatggcgacctgagacggaatcctgccgtcgtggtagagcctggcattcgcaccgtccaagtgcgaattgacgaga

SEQ ID NO: 497 - DNA, 200 bp, Mycobacterium paratuberculosis
gcggataggggaggcacgccggcgtcgaggaaaaacagcaaaggagcaccccgctgaggcatccgcagccacggcgccatctccacgacgcgctcggcgggaacgttcgcaaggtctttgttcgaatcgaaggacgcctgtgcggtgcggacgatgtcgctgaaggaaccggcgacagagacggtgagcggcacaaagcc

SEQ ID NO: 498 - DNA, 200 bp, Mycobacterium paratuberculosis
gacaaaccaacccgttgtcgcaagttcgtcctgagagcgacgaatgtcgacgggaatgactccgtaatacgtttcggtgccggtcaattcgtgttctacgagagcggcgcaggcaaacacaccgccactgaatcgcgcgcccgccgccaggcaaacggattcgaaccgggcagtctgtcgctcgtcgagcaattgcacgc

SEQ ID NO: 499 - DNA, 200 bp, Mycobacterium paratuberculosis
tcaacatgtcgcaggggaccggcccatcaccgagcggcagagggaatgccggcagggtgccgttgttgtcttcgaagaattcgacccagccgcgcacttccggggactccaaggtcagtgcgtccaactcgcgatgttgtcggacgcagtagtcgtcgtagctgcctgccgtcgccagcgtgagcggcgctctgcccgcc

SEQ ID NO: 500 - DNA, 200 bp, Mycobacterium paratuberculosis
accaaagcgcggtacatcaagtggatctccgcgaatcccacgccgacaaacatcgcgtcgatgtggagatgatcaacgcacaagcagatcgtgaagtggtccgcgcgctgaatcacgatgaagcggaaagaatcccagcacagcggattcggtgtatccaggacaaggtcccgtacttcgtccgaagtcatctcaccgtg

SEQ ID NO: 501 - DNA, 200 bp, Mycobacterium paratuberculosis
ctcgatcggggtgaacttgatactggcggggtcgtcgattgtccgccgggcgatgcgccccccgtcctcgacctcgaaccaactgtggtaggtgtcgtgacggcgtaggtgcgcgttgatgacgtgcgtcatgacacggatatcgcaacggccgggtatgtcccagcctgcagtcagcagacgtgacatatcgatgccgc

SEQ ID NO: 502 - DNA, 200 bp, Mycobacterium paratuberculosis
gagctgcattttcgcggaagcgacggaggtgctgagcctgctgatagctcgcgggtaccgcgctgttcggcgcgtgtcgggccttatcgagcgacgccggcgacgcctgccaactgacgacggaacccgcagcgggcaaccactcgtgaatcggtcccacttctactttccctacgagaaccacgattcctcccctacgc

SEQ ID NO: 503 - DNA, 200 bp, Mycobacterium paratuberculosis
agcggcggctgcggctattggcggatggtgcgatgtcattcggcccggacttgtgatgttggtgcggcctctgccagcgtgtcgcagaggtgggcggcgagacctcgaacggtcgtgatggcggtcgacttgatccgcacccctgcttcggcctcgatccgcgtacgtagttcgagattgcccagcgagtcgaggccgta

SEQ ID NO: 504 - DNA, 200 bp, Mycobacterium paratuberculosis
ctccgagagtggacggtcgggatcaacggtgcgacgcaggatcaagctcacctgctcggagaccagacgccggagccgggtgggccactgatcgtggggtaatgtattcagctcggcaaggaatctggttgtgcccgttgggcttttccccgtggatcggaatgcttcagcgaaccgactgcgctccgcaaacgcgctca

SEQ ID NO: 505 - DNA, 200 bp, Mycobacterium paratuberculosis
accatgccgtatcgatcacgggtgcgtagccggtgtatgcgcggtcgtgacacagcagcgcctggaacgcgtaagcgccctcgtcgggagtgatggcggtgcctacgtcttccgcgaagcccgttgcgcgtccgagctctgaccaggcaccccacgcgatcgcggtcgcgggaaggccctgggcgcgccgccagtgggtg

SEQ ID NO: 506 - DNA, 200 bp, Mycobacterium paratuberculosis
gaccaccccggcggcgtggagcacgccgcgtaccggcagcccggtggtcgtggcggccgccaccaaccgctctgccgtgcccggctgggtgatatcggcgcactccacgacgacgtccgatccgatcgcccggactaattcgatcatctcctggactcgctgattcggctcggagcgcgagctgagcacgatgcggccac

SEQ ID NO: 507 - DNA, 200 bp, Mycobacterium paratuberculosis
aacccgccgcggcgagtttctcggcgaggaacagcccgatgccgcccaggccgcccgtgatgatgtaggaaccgtcgggccggaatacccgaccgctgtccgggtgcaggaccgcgctacttttcccgctacgggcaacgtcgaggacaagcttgccggtgtgttcggcggcgctcatcacccggatggcggtggccgca

SEQ ID NO: 508 - DNA, 200 bp, Mycobacterium paratuberculosis
tcggtcagcgggtaatgcgtgcttgcgggcatcggcagtaggccgtctgcgacgcgttcgtacgccgtgtccagcaattcccgcactcgcaacggatggtcgaccgacatcagacccaggtcgacgccgtaaaacgccaggttgcgacggaacgggaacagccccagcttggtgtcgccgtagatgtcgcgtttgccgat

SEQ ID NO: 509 - DNA, 200 bp, Mycobacterium paratuberculosis
cgcggtgactgcaacctcgatttgccctgggccaggcgggattcgttcgcatgcaacgagttccattgtctggagatcgcccggggcccggatgtgcaggcgcatgccatcgtgctcgtgatcgacgacggctgttctccgttcgtccgggcgtaacgggctcagccgcaaccgcgccgtcagccactcatcattccgcc

SEQ ID NO: 510 - DNA, 200 bp, Mycobacterium paratuberculosis
aggccgtttcgtcttcttccgacccactcaccagctgccgcgcgatcaggctggcgcccgtgtgcatgtcggtgtcgatctgggtggtacgaaattgcggatattcgttcccgatcacccgtagcaggccgcgcaggccgccttgctcgagattggcgccgtcgccctccagcaccgtctgagcgttcctggtgacgacg

SEQ ID NO: 511 - DNA, 200 bp, Mycobacterium paratuberculosis
tatagtcgcggtggctcgccgggtgcggccgccaactcgcggacgatgtgcgccacatgacggacgtactcgccgccacgggcggcgcactcgtcgtcccgatcgccatccttcgggccggtgagcaggaccacgcccgtgaaccggccgacgcgcagctgatcccgcagcgtcttgccattggcaacagggtcggcgcg

SEQ ID NO: 512 - DNA, 200 bp, Mycobacterium paratuberculosis
cgacgaccagcggatgctcgtgcaatccgcacctagcagttttaacgagtcggtcaactcggtggccgcgacatccgccatcgcagaggtgctgaccagcagccatgtgccagcgtcgacgggatccacctcggtcagctcttgccgatgccattcgacggtcaacagtcgctcgttcagcgcgcgatcgcggctcgctt

SEQ ID NO: 513 - DNA, 200 bp, Mycobacterium paratuberculosis
cctcggaggccccagtgcccatttgcagtccctggatgctcagcagaacggctccatgctcgttcagcacgtcgagatcggcctcgaaccccgtcgcagtggtactggttacccgggtgtagcagtaatgagcggtccgggcggacgcgtaggcgcggatgcggcgcacacccagcggcaggagcaaactgccgccgccg

SEQ ID NO: 514 - DNA, 200 bp, Mycobacterium paratuberculosis
gaattctggatctcggacgccgccccaaccgactggaaacacgcatccaagagcgcggggtgaatccgataggcacgctgctgcgaacgcatagccccaggcaacgcgacctcggccaagactgtgtcccccgaggtgtgcgccgccgtcagtccggtgaacgcggggccgtattgcacaccacgttcggcgaaccggtt

SEQ ID NO: 515 - DNA, 200 bp, Mycobacterium paratuberculosis
ccgcaactcggcgccgtcgacgctggatgaacgagccgcaagtagagcgggaacgtcgtacgcgggcggtcgctcgccaggccccgctgcggccaggatcgcggtggcccgccgaacccgttcgccctcttcgaaggtctccaccacgaactcggcggcgctccgcgaggccatgactgccagcgcgaacaccggggtct

SEQ ID NO: 516 - DNA, 200 bp, Mycobacterium paratuberculosis
catcctcgatcagcaacatctggtcgaagcggaggtcgcgtacttcggacgcgtccccaagtgcggtgtgcgccgcagtcagagctatctcgcagtaggccgctgctggaagagctgccacttcgtgtatccggtgatcggccagccagcgcagcgtcgcggttccgacctcggcctgccacgcgtggcgctccggctcc

SEQ ID NO: 517 - DNA, 200 bp, Mycobacterium paratuberculosis
tcgggcaggcgcacatgggagcccaacagcggatgcacggcgacggttggtccagcctgcggctgggtgtcccggctgtcgaggccgaggagcaggtgacggtgcgtccatgccggcagcggtacatccagcaggcgaccgtcggggtacaacatcgagaaatccacggcggcaccgacgctgtgcacctcggccagcag

SEQ ID NO: 518 - DNA, 200 bp, Mycobacterium paratuberculosis
atcgcgcatcccgtgcggcagtgcctgttcgcgccgcatcgcggccagagcggcggccggcgtatcgaggctggcggcggtttgctcgatggcgtaggtcagcagtgggtgtggcgagagctcgacgaacacgcgatgcccatcttccagcgccgcctgcaccgcggcgccgaaccgcacggtgtgacgcagattgtcca

SEQ ID NO: 519 - DNA, 200 bp, Mycobacterium paratuberculosis
gccaataatcggcatcgcagagcggctgctcgcgtgggtcgaacaggctggcagaatagaacggcacctcgggcgccgtgggctcgagttcgaccagggcgtcggcgagttcgtcgaggatcggatcgacctgcggagagtgcgaggcgacgtcgacggcgatctcgcgggcgagcacgtcgcgctcctcccacgcggcg

SEQ ID NO: 520 - DNA, 200 bp, Mycobacterium paratuberculosis
accagctcccggaccgtcgatgtcacgccgcctatcacggtggacgtcggtgaggccatcaccgagaccacgacgtcgtcgattcctcgggccatcagctccgaaagcacttgctgtgcaggcaattccaccgaggccatcgcgccggcgccggcgatgcgcgacatcagccgggaacggcgacaaatgacacgcacccc

SEQ ID NO: 521 - DNA, 200 bp, Mycobacterium paratuberculosis
attcgcgcgctatcagcggctcgacttctgccacggtggttgcaaagaccggttcgttcgccagcagctcagcacccatctgcgtccattgcgagccctgcccggagaacacccacaccgggccgcagtcgtcacgtccgaacgcagccagataggaagtccggctgtcggcgacctcatgcagacccgcggccagctcg

SEQ ID NO: 522 - DNA, 200 bp, Mycobacterium paratuberculosis
tcgacactgccggcgatgaccgcggtgcgcacgggacgatgggcacgccgccgcgccagcgtataggcgagatccgacagctcgacagaggccgcacgctctttcacccagcccgccaggcgcttagccgtttcccgcagcccctcatcggagcttgatgacacggtgaacaacagtggacccgctggtgtgggtttgac

SEQ ID NO: 523 - DNA, 200 bp, Mycobacterium paratuberculosis
gcctccgcttgcattgggggcttgctcaacgatggcgtgggcgttggttcccgacacgccgtaggacgacaccgccgcccgccggggctgctggagcttgcggggccatggcgtgttgtcctgtggcacaaagaggttggtgttgagttggcctattttatcgggcaggcgagtaaagtgcagattttgcgggaccacac

SEQ ID NO: 524 - DNA, 200 bp, Mycobacterium paratuberculosis
cgcggcgtcgaaggcgcgacagcgaccggtcgcggacaacattccctgcgccgaacctgcggcgagtttccggggttccagcagtaccgtggcaccgcccgccagcgcgaggtcgctttcaccgtggtgcaggctgcggcacgccacatgcaccgagaccagcccggacgagcatgcggtatcgaccgtcaacgccggtc

SEQ ID NO: 525 - DNA, 200 bp, Mycobacterium paratuberculosis
cgtgcagacccagcgtgtgcgcgatccgcccggacgccacagcgaaactgttgcccatgaacccgtacggctgatccagcgcgccggcatcggctgtccgcagtgtgtggtcgtcgtgcatcaacccgacgaacacaccggtcctcgagccggtcaaggcggccggattaatgcccgcatgttcgagggcctcccacgac

SEQ ID NO: 526 - DNA, 200 bp, Mycobacterium paratuberculosis
accgcgcaacaacgccgcccacaacgcgtcgggggaatcgatcgctccgggcagccgacaggccataccgatgacagcaaccggggtcgcgctttcgtccatcgtcgttcctcgtctgagcgggtgcgtcacctatctggtgtctccccgctcccgatcaccggctcgtcggatgcagtactggatggccgggggtgtct

SEQ ID NO: 527 - DNA, 200 bp, Mycobacterium paratuberculosis
ccagagtcctgatgcgccttcaacgccatccgatatgttgagtgcgggtggagctttccgcaggtcagcggcctcgcagaagcttactgaaaatgattgttattatcaaccaagtgcgagactggcggtctcagtgcggagatggaccgcttgcggagctgtttgcggaggcccatgtcagggcatcgctgcgcacggat

SEQ ID NO: 528 - DNA, 200 bp, Mycobacterium paratuberculosis
cccacgaccagttgttaacgaaaatcgttttcagtaaacttgcatgaaatcagccccaatttcgaaaacgaggagctttcgtgatggctttgcggctcctgcttgaaggccttgccaccgcggcgtcgtacacgttggcgggcggtcggcgatgacggcgccgatctggatggcttccccgccagaagtgcactcggcgc

SEQ ID NO: 529 - DNA, 200 bp, Mycobacterium paratuberculosis
tgctgagcagcggtccggggccgggctccttgctggcggcggcgggggcgtggaactcgttgagtgccgaatacgcttcgacggccgaggaactcagcgccgtccttgcgtcggcccaggccggcgcgtggggggggccgagcgcggaatcgtacgtagccgcgcatgccccgtacctggcgtggttaacacaggccagt

SEQ ID NO: 530 - DNA, 200 bp, Mycobacterium paratuberculosis
ggccgccacgatgtccacctatcaagcagtctccaccgcggccgtcgccgcgacaccgccaaccgatccagcgccaccgatcgtgaaatccgctgcgttaagcgatgattcagatgactcgggtgacgtcgatcatgaccccaaaatcgacaattggctggacgaactcattgcaaggttcctgaagcaactgggcataa

SEQ ID NO: 531 - DNA, 200 bp, Mycobacterium paratuberculosis
ctcgagattctgaccaccgcgccgcagctgttggcccccgcgctcctcctcgcggttgcccccttcggcgccatcggcggattcgccgggctggctggcctggccgccataccccaccccgcggtcgtcccggcgacggtcgcggcaccgccgccggcgcccacgccgagcatccctccggccatcgccatggccccgac

SEQ ID NO: 532 - DNA, 200 bp, Mycobacterium paratuberculosis
aggcacccgaacccgatagcgctgcggcggccgccgcagcgtcggcgcgcgaggctgcgcgagcgcgacggcgccagcggcagcggcaacgcggatttggtgatgagtatatggatatgaacgtcgatgtcgatccggattggggcgggccgcaccctggccgcgagtcggtggcgtcggatcagggagcccgcaatgtc

SEQ ID NO: 533 - DNA, 200 bp, Mycobacterium paratuberculosis
gcttcgggtcgaggggcacgtcacgtctgcaccgcgacaaccgaattcggcgccgattccgacactgcaggctaccgtagtgtcacgcatcgacgccccgcccaacccgtacgcgtacccgcactgagggcccacgcatatgcgactggacggttacgtcaattgacccaccgggaaggagggcaaatgccggatgctgg

SEQ ID NO: 534 - DNA, 200 bp, Mycobacterium paratuberculosis
cgcggtgtccttgtagtccacggtgcgcaacccgaggctgtcgagaagattcttcttacgcgcccggccggccaaaggagccggcctgcgcgtccgcgcaggtttcttgggcattaccagctcgccttccgcacgcccgggagctgtccggcgtgtgccagttcgcggacccggaccctcgacaacccgaatttgcggag

SEQ ID NO: 535 - DNA, 200 bp, Mycobacterium paratuberculosis
gtggccgcgtggtcgcccgtcgacggcgtcgcggttgcgcacccgcaccgcgctggcgtcccggggctggtgtgccagctcgttttgcgccgccgttcgttgctcgggggtgctccgcggcgagcggatgatctctttgagctcagcgcggcgttcggcgtagcgcgcgacggtcgcacgccggcggtcgtttttgacga

SEQ ID NO: 536 - DNA, 200 bp, Mycobacterium paratuberculosis
tgccggggacgctggtcgtcgagcaccgtatggagggtcatgtggtgcttcgaacgacggtgatgctgcagcatggcgtgttgacgaccgccgaaagtgcgctcgaattggcgcacggatgcgtgtcgtgcaccatccgtaatgatctgctggtcctgttgcggcaactgcatcgtcgagccgaggtcgaacggatcgtg

SEQ ID NO: 537 - DNA, 200 bp, Mycobacterium paratuberculosis
gcaagtcgttgtcggacaggccgagttcgccgacgtgctcgtgctcaaccgcgccgaccccttcacggccgccgcgctgcgccgcctggcgccgcgcgcgcgtattcaagtgggtgccaatggcatcggggatacgctgaacaatctttatcgcgacgcgcggcaggggcgaagcgacgatccacacgatccgctgctgt

SEQ ID NO: 538 - DNA, 200 bp, Mycobacterium paratuberculosis
agctcggccggcaagtggctcgctgccctcgcgccgtccgagctggcccatatcgatccgggacgacgtgccttcgccgagctggaatgggacgccgaccatggggaccggcacaccgctatgaccatcctggtgtgcggtgcgaacgccagcgacattcttgacgctctcaacggcgcacttctcactgaccgcgagtt

SEQ ID NO: 539 - DNA, 200 bp, Mycobacterium paratuberculosis
cgcctctcgcccctgggttttcgacgacgatccatttggggactggcacgaagacccttgtggtgatcccgcgcaagggacagaggagaatacgcccgcccattacagcaccgacggagaccactgatgaaatctggcattcaccccgactaccatcccgttgtcttccaggacgccaccaccggcgcgacgtttttgac

SEQ ID NO: 540 - DNA, 200 bp, Mycobacterium paratuberculosis
tcggtcgaccatcaccagttcgcgcaccatcgagtgggagacgccgcacggagtgcgcacctatcccctcgttgtcgtcgagatcacttccgactcacatccgttctggacgggcagccgacgcatcgtcgacactgccgggcaggtagagaaattccaccgccgctacggcagccgtcgacaaaccaaccaccgtgacg

SEQ ID NO: 541 - DNA, 200 bp, Mycobacterium paratuberculosis
acgcggctcactcaccctgacgagctctaatcctgtgccggtgagttcagtaacgcgtcccagtgaacgacggcctcccccgcggcaggagcggcgtcgccggtgaccagtccgagcaaggcgcgggatacccctcccagtccgatcccgctggcgtgcacaacgccagtgatcacccccagcgcctgctctgccgagca

SEQ ID NO: 542 - DNA, 200 bp, Mycobacterium paratuberculosis
gcgtcggagacccatgacgacactgatcgcctggtcgatttcgcgtcgcgatcggtggtcggcgggccggtagttgggcgtgtggatcatggtgactccgaggtaatcgaattcgttcgacgtttagtgggcgtgaacgacgtcccacggtggcaacgggtcggggtagccgacccaccgctgaggaccttgggccagtt

SEQ ID NO: 543 - DNA, 200 bp, Mycobacterium paratuberculosis
cggtgtcggtcagcagcgccgcctgcatgaggtcgagcacccggctgtggtcgaggttgaccccgatgaacacgatctcttggccggcgggaaagtcggcggttgaccagtactgggcgggttctatcaccaggttgggcccggcttgggaccagatggccgcaatgtccggtcggctggcaatccagcagaagcctttg

SEQ ID NO: 544 - DNA, 200 bp, Mycobacterium paratuberculosis
cgctacccggccgtggtcggtggggacgatcttcgccgccggattaaggcgccgaagtactgccgccaccgttgcgttggttttctcactcaccagatcggtcttgttgagcagaatcacgtcggcgaactccacttgatcgacaagtaggtcggcaatcgtgcggacgtcgccgtccccggcggctaggtggcgggcag

SEQ ID NO: 545 - DNA, 200 bp, Mycobacterium paratuberculosis
cttgcctgctcccaggaacccggataggacggtgacggggaggggcgtagaactctgtggcggcataagcgttaatgataatcattttcattaacgctcgcaaagctcctaacgccgagtcctcacggttgtgtgttttggcaaagcggacatgtgccgtaaaggtcgacgtagtgagtgacgtcggcgtagtgatgttg

SEQ ID NO: 546 - DNA, 200 bp, Mycobacterium paratuberculosis
gcggcttagccggcgggtgtgttcttcgatgtcgacgggtgtaaaggcgacggctctgccgcactgccggcacagcaggtagtgacgatggcccgcctcggtgcggaggcggtagaggatctcgccgtcctccgcgcgctgagtctcggcgatccggtcggcagccagtgcgcgcaagatgcggtaaacactggtcaggc

SEQ ID NO: 547 - DNA, 200 bp, Mycobacterium paratuberculosis
cgatcctgagctgttggttctggcgaatgtcctgataaagctgctgggcgcttcgaaagttctcttgcgctcgcagcacctctaagacggtccgctgcttgactgtcgcgcgtcgccgtcggggcgcagcgggcgatgacaccggtgatactccttttcgaactggatccgaggtgtttactcgtcacttccgcgttgtc

SEQ ID NO: 548 - DNA, 200 bp, Mycobacterium paratuberculosis
gcggtgggctcggtggacgacataagcgcgggaggggcgttcgttgcctcgtccactgctttggcgatgactcggtgccggtgattgctggcccagacggccgaccagatgccgcaggcgaggaccacgatggggaaactcggcggcaggttgaacatggcggatgcgcccagtccgagaagtacggagctcagaccgat

SEQ ID NO: 549 - DNA, 200 bp, Mycobacterium paratuberculosis
tgccgtggagacgagcatcgccatcgacggacggggggtcagcatgatcgcggtcgcggctggtgtgacgactaaggcgaacagcagaagtgttccgaccgcttggacggccatggtgacggtgagtcccaggagtgccatgaagatcatggcaagggcacgcacgggcacgcctttcgcctcggcgactaccggattga

SEQ ID NO: 550 - DNA, 200 bp, Mycobacterium paratuberculosis
ccgaggcaaacagcagtggtcggtagatgatgccgacgattaacgccagcacggccagcaggatcgcgaaaccggctagctggtcgcgggatatcgcgagcaggttgccgaacagtacgttcgtcatggtgccggagctcttggtggccaaggaattgaagaacaatcccaggcctatggccagggccagcaccgtaccg

SEQ ID NO: 551 - DNA, 200 bp, Mycobacterium paratuberculosis
ggccagcgcgacgattgtgccgccgatcaaggcgttggtcataaagcccgatgtcaggatggaccaccagtgtggttcgtactgcagggcgagaacgcggacggtcacagtgcgcttctcatgtacagcgctccgtcgcgggcccggtgaacatggatgggggtgccgtagaggcgcgtcaacagcgtgtcgtccatgat

SEQ ID NO: 552 - DNA, 200 bp, Mycobacterium paratuberculosis
gtcgccgacgggcacatagcgtggccggccgtcaagcatgtagatgacgctgtcgaggatcggtagcagcgggttgagatcgtgagcgaccaccaggatggtcacggcgagttcggcgtgcagccgggccaataaggcgacgatgtcacgctggctacgaagatccaaggaggccagcggttcatcgaggatcagcaatt

SEQ ID NO: 553 - DNA, 200 bp, Mycobacterium paratuberculosis
gaggtcgtgccaccagcgcaacggcgatcgcgatgcgttggcgttgcccgccggacagggtggaaagccgccggcagcccaagtcggtcgcctcgacagcggccaaggcctcagcgactctggtctgctgggatgtggtgctccgcccgaatgcccatcgccggccggtgagtccgagcagcaccgcatcggcggcgcgt

SEQ ID NO: 554 - DNA, 200 bp, Mycobacterium paratuberculosis
atcgcctcgcctgagctgtcggcgtaatgctgcggaatgtagccaatgttgtcgttggcctgaccggggcgtcggccaaagatctcgagtcggccggttgccgaagggatcaggccaaggaccatgttcagtagggtcgttttgccggccccattggagccgatgacggcgacaatgccgccggcgggaatatcgaacgt

SEQ ID NO: 555 - DNA, 200 bp, Mycobacterium paratuberculosis
ggcatgcgaccagatcagacgtccgccgcgcacggcactcacatcggtgaaagccaaggcggagggaggggcggcgacgtcagacagcgacatggagcgccttggccagttggacgagctgcccgtactgccagtcttcaaacgacgtctccccgggcggtacggtctcggttatcttgacgacgggcacgcttgactgc

SEQ ID NO: 556 - DNA, 200 bp, Mycobacterium paratuberculosis
tccgcggctgatcggatttcctcggggattgagccctcggtctgcgtgttgtagatcaagaggtcgatatgccggccggcaagggcggtgaggaacgcgtcaacgtctccgggtgagggttccgattcgttggccgatgcccgccggtacccggcaggggtcttgttgaccaggcccgccgcttgcgcctggtagtcaaa

SEQ ID NO: 557 - DNA, 200 bp, Mycobacterium paratuberculosis
gaccgtctctgtggccccataggatttacccgccgcctcggccttgatcttggcgatcaggttcacgtatagccttgtcgcactggtgaattgcgctctccgctggctgaagtagccggcggcaggcggttccattctgctcaattcttgcgttaccgcatcagcaacggcggtcaccgcggagggcaggtaccacaggt

SEQ ID NO: 558 - DNA, 200 bp, Mycobacterium paratuberculosis
gagggttggctccatccggtgttgtcgtgactgccgcggcgctcaccaagggggcaccggaagcggagctgccggccagcttggatgcccacgagtcgtaccctgcaccgttgaccacgataagtttcgcgttcataaagtcagcggcgtcggccggtgacggctcgtaatcgtgcgggtcgaccgacgagctggcgagc

SEQ ID NO: 559 - DNA, 200 bp, Mycobacterium paratuberculosis
acggtcttgacgttcgcgcaggcgccgcccagctcggagacaatgtcgccccactgatccacgctgaccacgacagcgagtggggcggtgggacacggcggcgcggccgttctgccaatggctgatggcgaggcggcattacgggacccctcggctgtttgggtcgggcttgacgagcaactcgttacgactgtcagcac

SEQ ID NO: 560 - DNA, 200 bp, Mycobacterium paratuberculosis
caggacagtagcgataggggcgccgtgccaccgcgagagcaacccacccacaccgcaaacgataaccgttttcatatctaatgcgcgagactttccggaaacgcggtccgcgtcgcggtgcgcgccggcccggttccgcgggaccccggctggcccgcccgagcggcaacatgcgcccaccgtcgccattcgcgttgcgc

SEQ ID NO: 561 - DNA, 200 bp, Mycobacterium paratuberculosis
ccgtcgtgcaccgcggcgccaccgccccgcaccgcgagcagtattcggaccccgagaagccgatcctgcgcatcaccggggcggacggcgcgggcgggcggacccactccatcgagcgttggcagaccggcggctggcagccgtacatcgacgacgccgaccaactgggcgccgacgaggccgcccacctggcgcgccag

SEQ ID NO: 562 - DNA, 200 bp, Mycobacterium paratuberculosis
cacgttgccggcggcggtggcgctggccccgagcgtcgccaccccggccggggccccggccagcacggtcgccgccggctccggcgcgtcggccgcccccgcgccggccgccgcggcgggaaacttcgcctatctggtcgccttcggcggcgacccggacaccggagtgggccccaccctgagcgggcgcggcggggcca

SEQ ID NO: 563 - DNA, 200 bp, Mycobacterium paratuberculosis
gtcgccaccccggggatccagctgccggcgccgccgccgagcaacccgccggcggcgcagccgcccgcgccgagcacgcccgcccccgccccgacccccaccgaggtggccgccccggcgccggagcccgtccagcaggcggcgccgcagaccccggtcacccccgcacccccggcgccggtctaccgcgccccggcccg

SEQ ID NO: 564 - DNA, 200 bp, Mycobacterium paratuberculosis
ggcccacaccgcagtaccagccgcggcccgtcgagcagccggcgccgccgccggccgccgcgcccgccccggccgccccacctccggtgcccgcgccgccgccggccgccccgccggtgccccaccagccaccggtgacgatgtacctgcacttcccgttcgtcacggtgccgatcccgatcaccccgccggcgccgccg

SEQ ID NO: 565 - DNA, 200 bp, Mycobacterium paratuberculosis
ggagatgacctggaagtcgtctggcggccggatccagatgcgtagcgactgtagttgcggcccgattcagggccacatggccatctcggtgtagttgcgcggcggccgcgtcatggccgttagtgctaggcggaagacgaccaggcacccggattactctgcgtggctagacgggcgggagttgagttcctaaggggagt

SEQ ID NO: 566 - DNA, 200 bp, Mycobacterium paratuberculosis
caagctacttcggtgggttttatgctggggtggacgggccggtgaattggagcgcttggcgactcctgtggttcccggcccgtcctgcctttctggcgctgggagtagcgcttggaggcggcgttgatgcgggtcttcttgtcgacggcgtggtgagcgcggacgattcggcgtccttcttcgaaggtgatgggccgtcc

SEQ ID NO: 567 - DNA, 200 bp, Mycobacterium paratuberculosis
caccggctttggtgagcccgtggcgctgttctgcttgtccggactggctgaccttggggacgaggccggagtaggcgcggatggcggccagggagtggaaccggtgcgggtcgccgatgcggccggcgatgaccgcacaggtgacgggcccgaggccgggtgctgaggcgatgatgccgcgcgggtcggcctcggcgtag

SEQ ID NO: 568 - DNA, 200 bp, Mycobacterium paratuberculosis
aggttggcggcgcgctcgtcgaggtcgtcgatctgctcggtgagcatctgggcttgttcggcttcggtagcgatgtcggcggccagttcggcgaagtcgatgcgggcattagcgccagatccccacagctgcagcgactcttgggcggcggtcaacagcagggtggcgtgtggttcgcgccaggcgccgcgggagtggcg

SEQ ID NO: 569 - DNA, 200 bp, Mycobacterium paratuberculosis
agcgcaacccatgcgttgcgggtgggctccatcaccacccgcacggtgtcttgctcgctgagtccgattactttccagagcttttcgaggtcggcggtcagtccccgggtccgacgggcatggcccagacattccgcaagcagaagtccgctaacgcgcggctccaagttcccgaacagggacaccggtcggcacctgag

SEQ ID NO: 570 - DNA, 200 bp, Mycobacterium paratuberculosis
gaggtcggcaaggaactgagcttggaccagcgctaccgcgcggcgacgggtgtgtacgcccgtctgggctcctgcgtcaacgccacgcattacctggtgaagtatctggtcgaagaaggactgcttgaacttgatcccgaagtgtttacgctgccggtgttggccaagaccagtgtcgagatcaagggagcggtctacag

SEQ ID NO: 571 - DNA, 200 bp, Mycobacterium paratuberculosis
cgcggaattgggcgctgagatgcccaccgatttgtcgaacctcgaccccgaggtatggcgaccaatccacaaagacattgatttgctagcgagctcagaacatgggtcacctgaagacggttcgtcccgcgagccagaggagtgagcatgtcggcgaccccatgagttcaaagttcggaggcatcccgtttgaagcggcg

SEQ ID NO: 572 - DNA, 200 bp, Mycobacterium paratuberculosis
cccgaaccgagctggccctttggcctgccgaccgtagcggcccatagcagctactgggccgtgtcatcgccggaagagtcgatgtcaccacccaccttcaccccctgatcatcatgatgaaaccgacgacccgggccctgctttgcctgttggcaatcctgctcacgacaggactatttactgcgtgctcatcggggtcg

SEQ ID NO: 573 - DNA, 200 bp, Mycobacterium paratuberculosis
tcgcccatggcccaaaaacacaccgcgtcgggcgcgccgtctggtgcaacgctaattccaggaggtccgatggaatcgacaccagccgccccgtctccgaaaatacctgcgagtcaaggagaagcgcagaagacagtgatccactacatccagcagaccgtcgatgccctgcccccgggaaccaacgccgacggaacccg

SEQ ID NO: 574 - DNA, 200 bp, Mycobacterium paratuberculosis
ctatgcgggcactggttcgggaatggcgtactgcgaggacgagccgaaggacgataattcgcctgttaactacgcttactggggtgatctgaaccttcccccgggcactgacgtcaacgccatgtacggtcaggtcgaaagcatttggaaagggtggggttggcaggtccttgagcgtcagggcttcgagaagcccaacc

SEQ ID NO: 575 - DNA, 200 bp, Mycobacterium paratuberculosis
ggttcggctacgctcccgacggttacgtcgtgcaaatcaaagccgcgtacccccccggctcgccgccgacaatcatcgggacatcgccctgcttcccaggcaatctccgaaaggagggggctcccattccgactgcgataaaccagacctcgcccgcaagataaaaccagtggatgccggtgtcaccgccagcgaccctc

SEQ ID NO: 576 - DNA, 200 bp, Mycobacterium paratuberculosis
gctcagcggggcatcatgtacttccaccggacatcgcagtcgggaattagcacggcgctgggtcgaattcactagcgtcgccttctactcgtgctgcggatcgtccaccccattacctattgggtgaggaatggggtgaatcctagcgtgtgactttgcggcgcatctcggccgcatagcgcgcggaaatgcgcagcggc

SEQ ID NO: 577 - DNA, 200 bp, Mycobacterium paratuberculosis
gggatgtgactgtagtcgatcttgcgcagttcggcgttgttggcctcttgctcagcccagatctccagaacatgcacagcaggaactgtggctgattgcgcttggacaccggaacaggcacatgtcgttggccactgcttgtagcgggtcgcatacccacatcgcgggcaagggaaatggaagtgggggacgctgtgtcc

SEQ ID NO: 578 - DNA, 200 bp, Mycobacterium paratuberculosis
cctaacgctcacaaccacatctgcctcccacgatctagctgtccccgcagcagtcgttccggtctctgcgctacacgtacgcgagcttgtgcctcgctgcgcgcatccggcctatcgacatcgcggagcttatggggcaccgggacgtcaagacgacgctgactgtctacgcgcacctgatcaacactgacgatcacacc

SEQ ID NO: 579 - DNA, 200 bp, Mycobacterium paratuberculosis
ggcaacatggccgcgctcgggtcgctagccgccccgttgcagaagcccaactacggcaatgtgatcccgctacacggctgaatcgggcggattgcggccccacacggcgcgccgatcaagcctcgtctgcagaggaacgaagggtcttcgacgcctgacgcctgtagaggcgaaccagcgccatgatcccagtgaggaca

SEQ ID NO: 580 - DNA, 200 bp, Mycobacterium paratuberculosis
atggtgaataacgctgccgatgcgcctgattcgtacacgtcggcaagctggatggttttgccgccgcggaccgcgaagccgtcgggcggatggatcaggctggtgaagatctgggtggtggtggaaagccagaacaggcacggcagcagccagtaagtgcgggttcgggtgacagggcttccggggaatcgcggttcgac

SEQ ID NO: 581 - DNA, 200 bp, Mycobacterium paratuberculosis
gagcgcgacgagctgaaagatcaaccagcccgtcagcagccagccgagaaagttgctcagcgggactcccagtgcgccggtcgggtggtcataggagtaccaatcgtgcgccgtcgccccgatggggtcatataccaggtcataacccccaaggatcaatgtcgccacgatgggcgtcgtaaagcgttcggcgccaccga

SEQ ID NO: 582 - DNA, 200 bp, Mycobacterium paratuberculosis
cagccacaccgggaacgggccgcatgatcacccgggccagcgcccaggccagccagccgaagatgatccagctggcgatggccaccggggggacgcccagtggtttcgggccgggcaggtgatgggtgtaggaaccgaacgggaaaccggtcgcgacaccgattgcctccaatgcgaacgcaacaataccggcgatggcc

SEQ ID NO: 583 - DNA, 200 bp, Mycobacterium paratuberculosis
acgaacgcggccatgcctcgtgcggagtagcccagccaggcatggacgacgacaaacaaaatgagaaatcccatttgggcggccccggcttgcgcagccagcgacgggcgcaccgccatgaccaccgcggcgagcagcgtgaggacgagcaagacccaacaggatgccctgagaacctgccaccgtgcatccgtttggct

SEQ ID NO: 584 - DNA, 200 bp, Mycobacterium paratuberculosis
aggcgatcgcgtcagcgtatcggttgccaccgctgtgtggtcttcactggtcatgtttgcgcaccctcagccatgctggtcggcgcgctcgacgcacgccgagttttctggcttacgttatcgcccgagggcgcggatctcagctattccggcgacatgaaataaggccgatgctcgtggtatttcacccccgaactaag

SEQ ID NO: 585 - DNA, 200 bp, Mycobacterium paratuberculosis
ggaccgttaggagacgacggcattgggtcagcaccacaattacggcaacgtcgtaccgctacacggctaattgctagcgacctccacgcgaggaacgtcttggccaggccgacttttgcggcaatctgagcatcgcgaatgcgcacacccgttacggttggtcagcatcgccatccctttggtcgggacatttacgtagg

SEQ ID NO: 586 - DNA, 200 bp, Mycobacterium paratuberculosis
aaggtcgggctacgtgactgaagacgcaatcagcatcggtggtgtgaaccttgctgatccagacacgtatcgcgcgggtatgccttacggagctttccgcaagcttcgtgagcgtgcgccggtcgcgtggcacccgcagaaggatggctcggggttttgggccttgacgggttatgaggagatccacgccgtttccaggg

SEQ ID NO: 587 - DNA, 200 bp, Mycobacterium paratuberculosis
acagcgcaacgtggtcgtcccagataaatggggcaatgttcgatgctccgcctcccggcgaagttcccccggtgatgattttcatggatccgcctcagcacaccgcgttgcgtaagctgatcaacaagggcttcaccccgcgccaagtcacgcggctgaacgagcacatcgttgagatggcgaagcaaatcgtcgacgac

SEQ ID NO: 588 - DNA, 200 bp, Mycobacterium paratuberculosis
gtgatcgaacgaggcgaatgcgaattcgccgacgatgtcgctggcgcactgccgtcctatgtgatcgccgaaatgctcggcattccgctcgaagatggtcggcggctctaccaaattaccgagatcttgcacacgggctccgtcggtgacagcgacgacgagcggcaacaagcgatggtcgagatgtttcagtacggcgt

SEQ ID NO: 589 - DNA, 200 bp, Mycobacterium paratuberculosis
agaactcgccgtgcgcaagcgcgcggagccaggtgacgatatcgcgacttccttactccacgccgaggttgatggtcagagcctcagcgatttggaatttaacctgttctttatgttgctgatcgatgccggaggtgatacgacccgcaatcttgtagcagcgggaattcttgctctgcttgagcatccccaagaactgc

SEQ ID NO: 590 - DNA, 200 bp, Mycobacterium paratuberculosis
agcggcttaaggcagacccttcactcatgccgaccgcgatcgaagaaatgctgcgctacacgtcgccggtgacggcattcctgcgcaccgcgaccaaagacactgagttgcgcggggtacccgtcaaggccggcgaacgggtggcaatgttctacccgtcgggcaaccgcgacgatagccacttcgccgaccccgaccgt

SEQ ID NO: 591 - DNA, 200 bp, Mycobacterium paratuberculosis
ctcgatgtcggccgggcgccgaatcctcatctcgccttcggcggaggcggaacacacttttgtctcggcgccaaccttgcacgcgtggaagcctcggcgatggttcccgaggtcctgtcacgcatgaacgaccttgaactcgctgggccggtcgaacgattacgttcagacctgataaacggcattcggtctatgcccgt

SEQ ID NO: 592 - DNA, 200 bp, Mycobacterium paratuberculosis
ccgcttcacccctggcaaacgtctcggcaccgcctgacaccgccggcgtaagggctgtctcctggcggtgagacgtgattcgcgcggcaagggaccgttaagggatcgccccggcccgcgagcgctacggcgtttgccgccctgttcgtcgtggagccgatgacgggaatcgaacccgcgttctcagcttgggaagctga

SEQ ID NO: 593 - DNA, 200 bp, Mycobacterium paratuberculosis
caccgccgccggtgcaggcgtcggcaccgcagcccaagatcagcgtgcccgagccggtggcggcgcccaagccgttgagcctgccggtcgccgcgccgttgccggccgccccgccgccggctgcgccgccgcttccggaggcgccgccgatccccgcggccccgccggtggtgccggtcccggtggtggtcccgccggtc

SEQ ID NO: 594 - DNA, 200 bp, Mycobacterium paratuberculosis
ctgggcgggttcggcggtggccacgccccggcgcccggcggcggcttgggcgggttcggcggtggccacgctccggcgcccggcggtggcctgggcgggttcggcgggggccacgccccggcgcccggcggcggcttgggtggctccggcggtggtcacagcggcggcggcctgggcggactcggcggcgggcacaaata

SEQ ID NO: 595 - DNA, 200 bp, Mycobacterium paratuberculosis
tcgcaccaccgcccccggccccgccgcccatcgccgtccccgttcccgtcctttcgccgccggtgttcgttccgccgccgcgcgtgccgctcgcccgcccacccgcgcccggtcacggccccttcggcggccacggcccgttcggtgggggccacggtcccttcggcgggcacggtccgttcggcggccacggtcccttc

SEQ ID NO: 596 - DNA, 200 bp, Mycobacterium paratuberculosis
ccacccgacccgcgccggcggccccggccccggccccggttcaggtggcgcccgtgcccgtcccggaggcgcccgcgccggctccggcggccccgccacccccgccgccggcggtcgcgcccatcccggtgccgatcccgttgccgatccccggcctgggtggtcccggattcggcggaccgcccggccacggcggcggt

SEQ ID NO: 597 - DNA, 200 bp, Mycobacterium paratuberculosis
attgccagctcagcgcttgcccggtggacgcgccccgcgggcgatgcccagtcccttgaccggtggctgcgacggtgcgtcgtcgccattggtctgctttgccggctccgctttcggggccggttcggcttcggccttggcggcttcagcttcggccttgggtgcctcggccttgggtgccgccttcttcgcgccgggcc

SEQ ID NO: 598 - DNA, 200 bp, Mycobacterium paratuberculosis
tgcgccggcggctgttcggcgctgctgccgggcgaggtcgagctcggcgtggtggtggtggttgtcgtcgtcggtgtcgtggtcgtggtggtcgtggtggtcgtgctggtggtcgatttgggcacatggctgacgccctgttggccgccgatgagctcgatgacgccgaagacgatcaggccgatcaggacgacgacgga

SEQ ID NO: 599 - DNA, 200 bp, Mycobacterium paratuberculosis
tgtcttttccgctcaccgagaggtagccggcatggcagggcagcgacttcgtggtgccggcgccactgacctgcaacgtcccggcttccggcacgaccggcgccgggctgccgccgccgaggccggtgcgcgcgccggtcgccgccaacccggccgcggccagacagcagaccgctatcgccagccagcacaccgccccc

SEQ ID NO: 600 - DNA, 200 bp, Mycobacterium paratuberculosis
gaacgtcgacttgttgcggggatttccctcttaccttctagcgctggatgcaacagcctctagctgaggggttgttgatgaggtcgtcgcggtatgccgttgtgggtcgtcggttctgggaattggtgcgggccggaatgtctgcggatgacgctggggtggctgtcggcgtgtcgatggccgcagggcggctctggttt

SEQ ID NO: 601 - DNA, 200 bp, Mycobacterium paratuberculosis
gctgatgctggcggagtgagaccacgattcgtcgaccagtccatcccgcgacggcgtcctcggttgacggtggaggaacgcgaggagatccaagacggtgtggctcgcagcgagtccatccgtgtgatcgctcgccgactgggccggcatccgtcgacggtgatgcgtgagatcgagcgcaacgcgatctgtcgtggccg

SEQ ID NO: 602 - DNA, 200 bp, Mycobacterium paratuberculosis
gtatcgggcgcggtatcgattcggggtgcgctggcgtggtggtcacgatccccggccgcgatatcgcgccagcttggcgcacacgcgtgcgcacgttaaggcgcgccgttcgcggcccggcaagctggcgaccaatcagctgctccacgacgaggtacagacgcggttgaatgagcagcacagcccgcagcagatcgctt

SEQ ID NO: 603 - DNA, 200 bp, Mycobacterium paratuberculosis
ggcggctgcggcgcgactttcccgacgatgcggagatgtgggtgtctcaagagacgatctatcaagcgatttacgttcagggcaaagggaatttgcgacgtgagttgcacacctgcttgcgtaccgggcgggccctgcgcaagcctcggcgtcgtcctggtgagcgtcgcggacacctgcgcgacatggtcaacatcagc

SEQ ID NO: 604 - DNA, 200 bp, Mycobacterium paratuberculosis
gagcgcccccctgaggtcgccgaccgcgccgtgcccggacactgggaaggcgatctcatcctgggtagcaccgcgtcgggttcggcgatcggcacggtggtcgaacgaacgacgcggttcgtgatgctgctacacctgcccgacgggcatggcgccgaggcggtgcaggaggccatcgtcgccaagatggccggactgcc

SEQ ID NO: 605 - DNA, 200 bp, Mycobacterium paratuberculosis
atctcgactacgtggcatccaaactcaaccgcaggccacgacagacactcgactggaaaacaccagccgaagccctcgatgaattactctgcaaaccgttcacaccaccggctgttgcttagagcgctagaaagcgcccctcgaaatcgcccaacaagtcgacgttcggcgcatttagtaattttgttgtgacctggtcg

SEQ ID NO: 606 - DNA, 200 bp, Mycobacterium paratuberculosis
caccgtgcgccagttcaacgacctgctgcgggtgctgccgccgctgccggaggagactccgcaggaggcgccggccgcgccgcgcaactcctcgcccagccgcccgctggcccccgccggccgcgcggagctgccgccgcgccgcgcgcagcaggacgtggccgggctgctcggcccggacgtccagcccggccgccgcg

SEQ ID NO: 607 - DNA, 200 bp, Mycobacterium paratuberculosis
cgcaccgacgggccggcccggcagcggcacgccgcgcgggtgcgccggctggtcgcggccgtcgccgaacacatggcgccggcgggcgtgctggccggcgccggcggcggcgacggcgggctgttcgccggtgtcacggcccgctacctggcgctggtcgccaccacgctgccggggtctgtcgccgaggacgtcgcggc

SEQ ID NO: 608 - DNA, 200 bp, Mycobacterium paratuberculosis
tgtctacctgcccgcgcaggtcgagccgacgctgccgcttcgcatccgcgcggcctggctgtggtcggggcggacggcggtcatcgccggcgcggccgcggcggcggtgcacggcgccgcgtggatccccgatgctgtcccgatcgagttgatccaccacaacactcgtgcccccgacggggtgctgatccggcgcgacg

SEQ ID NO: 609 - DNA, 200 bp, Mycobacterium paratuberculosis
tcggtgttgcgctacggctttcggtgttgcaccagggcgcggatcgtcggcgtgtcgccgccctgtgtacacactcgacgcccaggatgcacactcgggccgagacgccgagacgccgagacgccgagacgccgagacgccgggacgccgaggcgccgaggcgccgggacgactcagaacgtgctggtgggtcgcacctt

SEQ ID NO: 610 - DNA, 200 bp, Mycobacterium paratuberculosis
cgctcaaccacaccaccggcaacgtccgccgcatcgccgaggtgatggtcgcgcacgccgaatccggtgtgcaccaatggctcgacgccacgctgctggccggggcggcgctggcggggctgggtgtgctggtggcggtgctgggcggcctggccggtgcggctagccgaaggtgaacgagaagacctgcagccctgggc

SEQ ID NO: 611 - DNA, 200 bp, Mycobacterium paratuberculosis
ccgaggcgttcgtgcccgacttctccgatgacgacgacgccgccgacaccggcacccagtcgtgggcgccggacttcgacgacgacgccgaggacgacgacgccgaggcggccgagcccgcggccgagcgggagccggagccggagcccgaaccggagccggagccggccgggttcgccggcccggtgccgccggtcgcc

SEQ ID NO: 612 - DNA, 200 bp, Mycobacterium paratuberculosis
gcttctttttcgccggcccgttgtcggggttcggcgcggtggccagccgctcggtgggcccggcgggcggggtgggcggcggcgggtagccgggctgctgcatctggggccgcggcgcgccgaatcgttcggtctggccggggggcgggggagcgggcgccggcggcggtggcggcacctgaccgggcgcctgacctggg

SEQ ID NO: 613 - DNA, 200 bp, Mycobacterium paratuberculosis
cggttcggcggccgggcgggctggggcgcgggctgggcgttgccgccccgcggcgggctccccgtcgcccgtcgcctgtcgcccccgcgagcgtgaagttagtttcacgctcggcgcccagcgtgaagctaacttcacgctcggcgcttggctcacaccgcgataggccctcggcttgtgaggagggtcggcgccttcag

SEQ ID NO: 614 - DNA, 200 bp, Mycobacterium paratuberculosis
gtagcggtgatgatgttgaagctaaaccaatcgggcggaattccctggcgcagcgcaccgtcgagctcttcgaaactgagccgcatcagatgtgatgctgcgacggcgtcgtgctcgggcatccaacctctgtcaattggttcaccgtcgacggtaatgctgacccgcccgggataattcaccggatcaggcttcgtaag

SEQ ID NO: 615 - DNA, 200 bp, Mycobacterium paratuberculosis
agttatccccggatgcaagccctcttgataccagcgatagcttggtgaatcggtatatctccccggccacgcttcttggctgattagaaatagcatgtacttctcggcatcgtcgaatcgcctgaacatccataagttctttcgcgaaccgcgagattcctggtcgatgtagtatccgtcttcaccgagaacaagaaagt

SEQ ID NO: 616 - DNA, 200 bp, Mycobacterium paratuberculosis
aggaaagttcgtagtcgtcaaggaagcgaagggtttcattgtcggtcatcgtcggtggccggggcgcccagtctggagtatgactcgagttgtcgaccttggcaccgctgtgcggcaaaggcttgcgcattctgcgcaggtaggttgcttgccatgagtaccacgacttcacgatccggtgtaattctggaggaaactcc

SEQ ID NO: 617 - DNA, 200 bp, Mycobacterium paratuberculosis
ttcagattaatagggagatcgatcatccttcttcctgtattcattaaaggagtgccagtagcaggagtcgaggtcgggtggccacaccacggcgcggcgatggtattcgccgccgcggccggcgcgccgcgagtgtaagtcaggttcacactcggcgcccaccgtgaaaccagcttcacactcgccgctggtggggtggc

SEQ ID NO: 618 - DNA, 200 bp, Mycobacterium paratuberculosis
gttggattgcccagttcgtaggggacgacccagcccgatcgcacccgacggatacaaggaaggttggcaagctgtcgtttgcggttgtgtggcgcctggcacggggagattctggtgccaaaaatggtctctatgtaacggtgaatacctagaagcagcattctggcaataagtaaaagtgcaagccttccgtgacgggt

SEQ ID NO: 619 - DNA, 200 bp, Mycobacterium paratuberculosis
ttacctgcgatcattttgctcatttggcgctcctttagtgatcctcagacgatcaacctgctcctcgcgcacaccggggctcgcgcgaagaaagtcctgctaagtctctgtgtccaagcccagcgctttgcgatccaggacaatccaatcataggcgtcattgactatctgcacacctttgatttctggcgatattcgga

SEQ ID NO: 620 - DNA, 200 bp, Mycobacterium paratuberculosis
tcattttcttaatttcggaccaccgcatccccccatatcttatatcggggcgtaccctactggtgtacgcacgtaatacagagcctaaatgtttcacgtggaatgtaggcattatcggctggccgtcagcgctttgtattttgcttagttctagaaatagttctctatcgcctatcgtggacccgagcgatgccggtaat

SEQ ID NO: 621 - DNA, 200 bp, Mycobacterium paratuberculosis
tctgatgcgttcgattttaccgtgctactgatgagctcttcgagtgactccgttgacccttcctgttctcggctcgctggacagccattatggcccaacgaagctggatcgatgtcgttaaggatatcgggaatctcactttttaggattgcaacgcactgcgattgccggttccataacactacccagtcgagagatgg

SEQ ID NO: 622 - DNA, 200 bp, Mycobacterium paratuberculosis
cattttgaccgctgcggcaagagcatctctgaaggtgctgcctgcaaaccgttgatgctcggataagtgcggatgtgactttgaagtaaacagcatcatcgcatgagtgccgtccgcgagtcgcgcaagaggagtggatcgcacctctctgccgtcgtgttgttcctgacgatatgggaagaagacttcggcgaaagtga

SEQ ID NO: 623 - DNA, 200 bp, Mycobacterium paratuberculosis
ttgcacgaaaaagatgtttgcgcgataacgacgaaccgtcggtagcggcgatcgccactagccgctcgatgtcgtcctcagtcattatggatgctcatttcaatatagtgtgaacgtattatcagtttcgccaaacattccctcgacatcgtataccagccctgtcgggcacgtttcgtcgaatgtgcagaccgcaaggt

SEQ ID NO: 624 - DNA, 200 bp, Mycobacterium paratuberculosis
gaacgtcgcccattcccttacgtttcaattcgctaatacgtgtgggaactatcaccgtttgcgggttatcgggagacggcgcgggggcggtgacggtttggcacccggtcgagtgcgaccgtggcggctcttatggtcgccaacgcgggatctcagccgtgacgctctcggggatgtcctccaggagagtggtggtcagt

SEQ ID NO: 625 - DNA, 200 bp, Mycobacterium paratuberculosis
tcatcgaatgacagcgcaaggacttccatcctgggttggtcttcggggaatgcgtatccgtaggagctgcggtcttcttcgaatgtgtagcgtttcagatgttcctcgataaagccatcctggggagtgggggattcggtcttcatgaaacttatggcttgccgatccgcgggttcaactagtatgcgcgggctggggcc

SEQ ID NO: 626 - DNA, 200 bp, Mycobacterium paratuberculosis
tcccaccatttattcaaaatttcttgcgcggtcattcccgcataagggctattcgccccggctgattcggcaagttctcgagggcagccgtgctctatgagatccttgacgagtttctcaggtgattccgcgagcgcaagttgcgcctggtgccaaggcggtaaatccgatggggtggggatctctggcggatgtccgtc

SEQ ID NO: 627 - DNA, 200 bp, Mycobacterium paratuberculosis
ggcgggttcatcgggaggcgcgccgtcgtgtggcgggtgcgatccgggcggtcgatcgccgtcgccaggcgggtgatgaccgccaggttgatgcggcccgctgccatcggccaggggatgtccgtcgccgggtccatggggaccgccatcaccaggatggtatggcccatctccgccgccgggcacgtggggagcgccat

SEQ ID NO: 628 - DNA, 200 bp, Mycobacterium paratuberculosis
catgcggcggctcgacgggatgagcgcccggctccccgccatgaggcacatcacctagaccggaaggtgtttcggcaggcgcgccgccgcccatcgggaccgaggacgccgatggaacgggcgccgccgccgcggccgcgggtgctggagcggacgcaggcgccgccgcagccgcgggtaccgccgcagcgggagccggc

SEQ ID NO: 629 - DNA, 200 bp, Mycobacterium paratuberculosis
ggtccgcatgttccggcgcgcccaccgcgtgccgcgcggcaaaacgcgcagtcgcgcttgacttctggcgcggcggcggccgcctccggtcccgccgccgcaccggggccccggccgtcgtcgccgccgctggcgcgccccgatgccggcgctgatcgcggcggcgcgtggggatgcaatctcgaaggtttcaaccctgg

SEQ ID NO: 630 - DNA, 200 bp, Mycobacterium paratuberculosis
cggcacgtcgaccgtgccgccgaaacggaccgtctggacggcgtcgaacccgacgaaggcgagcaccaaaagcaggtaggggacgttgagcgccaaccgaagccgggccgcccgggccgggtcgaaccgggcgccgcccgcccgccaggaaccggccaccgcgagcgcggccagcgccagcgccgtcaccgcgaccagga

SEQ ID NO: 631 - DNA, 200 bp, Mycobacterium paratuberculosis
ccgtgaacacgatcgggttgctgtccgggatgccgacgccgaagtagaggttccacggcagcaacaccgcggcgagcagcagcgccaccgcggtcaggtcggcggcgacgcgccggccggtggtcgccgggccgggcggcggcgtggcgccggtggcgtgcgaccggatgatgcggcgcgccgccggttgccggggctgg

SEQ ID NO: 632 - DNA, 200 bp, Mycobacterium paratuberculosis
ccggcgtgggtggcgaatcgctccgggccgacgtccagccgctgccgcaccccgaggttcagccgcggcagcaggaacgccgccgccaccaacgccgccccgaccgcggccgccaccgcgtcccgccgagcgattctcacggagcaacagcctattgttcgccgcccccggcgaatcggcgcaccaacgccgcccggtcc

SEQ ID NO: 633 - DNA, 200 bp, Mycobacterium paratuberculosis
ccggcccggtgcagttcgacatcccgctgcgtgagccgctggtgcccgatcccgagccgcacggcgccccgaccccggccggcccgccccgggcggccgggcccgtgtgacctataccccgccggtcagcttcgaccagccgctggacatcgatctgtcaccggacaccgtcgtcatcgccggccacggcgccggcacgc

SEQ ID NO: 634 - DNA, 200 bp, Mycobacterium paratuberculosis
acgctggtggccggaccccacgtgtcgtcgttgggtaccgtcatcgtcaacctccgaaagtcgcctggatgcggtgcaacccgttgtggtcctgatgcacccgcgcagagcccaaggtatcgggccgcaatcccgaatgggccttgtggcggacggggccggcgtcaccgtattcgttgcatgacctccaaacccgaaga

SEQ ID NO: 635 - DNA, 200 bp, Mycobacterium paratuberculosis
acctgttcgtcgccgcgcagcggcggtagaccagaaggcctagcctttcggcagggtgaaagccgagcgcgccgccaccgacgcgatgtggcgggtcagcatggcttcgggaaccagtgcggtggcccggattgcggcagcgctcagcaccgccgggcgcaggttgaccaccctgcccaacagcgcggattctccgacga

SEQ ID NO: 636 - DNA, 200 bp, Mycobacterium paratuberculosis
tgcgccggacgcggcgccggcggaacgcggcgaaccgggcgaacgcggtgggcaggtcgtccgcctggtcgacgcacgcggccagcaccgcggcgtcctcgagcccctggcaaccgccctgacccaggtgcgggcgcatcggatgagccgcgtcgccgaccaccacgacgggcccgcgcgcccaggtccgggcgggggtg

SEQ ID NO: 637 - DNA, 200 bp, Mycobacterium paratuberculosis
cggtcgtaaaggtcgttgcgcagcacctcgtcgcgggccgtcgctgccagcatcctcggaatcggttcgggccaattggcgaatcttgcttgcagatagggcaattcgccgccaggcgagagctgcccttccgaagcgcgctcggtggcgaaccaatacaggcgatccgcacccatcggcacatggccggtttcgacgcc

SEQ ID NO: 638 - DNA, 200 bp, Mycobacterium paratuberculosis
gggaccaagtgtctcgccggccaactcggggtccatcgcaggtcgccacaccgcgccatgcggtgtagccgacgtaccggtcggcgagcgggccgttgaggtggcgggccaccaccgagcgggtcccgtcggccccgatcaccgcatcggttgtgcggtcgttgccgtctgacagccggacccgcacgccgtcggccgcg

SEQ ID NO: 639 - DNA, 200 bp, Mycobacterium paratuberculosis
cgcgtgagtttgatagcggagagcccgtattcgatggtttcgggtgccagcgcgccggtcaggatgtcgcgcagtgccgagcgttgcacgatcaccaacggttcgccgagcgccttgatcaaccgctcgggggccggccgacgcagccacgagccgtctcgccaacgcaacgcgcccgccgtgatgcggccgccggcatc

SEQ ID NO: 640 - DNA, 200 bp, Mycobacterium paratuberculosis
cgggcacccggtagcgcgggctgccgatgatcctgccgacccgcaccgcgttgtcgatgatcacctcgcgcggcgagtcgggcggcggccccttcagcagcgccagcagcgcccgcggcgccggcggcggcagcagcgcggaattgttgctggagaagatgaccgccagggttttggtgcgctggcggaaccgggcggcg

SEQ ID NO: 641 - DNA, 200 bp, Mycobacterium paratuberculosis
ggaaaagccgtcccgccaagtgaattcgatcgacctgcacggctaccaggtggccacggtgctggcccgcctgcacgcgccggccgccccggccggcgccgccgcgctcgcgccgcacgccgaggccgcccagccgctctacgcgcgctactggctgcacaaccggggccccgcgccgctcggcgggctgcccgccgtcg

SEQ ID NO: 642 - DNA, 200 bp, Mycobacterium paratuberculosis
gagggacaactaccgcaaaatcctagtgcaggccgcgccgccggcgcattatttctccgagagtcgatgccacccccggcccggccggcccggcccgggtggcgacgcccgcgtacgcgccggccggttccccgtcccccgtgcagccggcggcttcgtcggcgccggcgccggccggcacgcccgcggcggccgcgcag

SEQ ID NO: 643 - DNA, 200 bp, Mycobacterium paratuberculosis
gaaaagtcttaccggcaaacaggattcattgatgtgcagcagcccgccgatcagcgcggccgaccggcccacctcgttggtctgcggtgggcggtccagcgccgcgcgcagcgcggcggcgtgctcggccgcggcggccaggatcggcggccacgccgccccggcgtcccagctgccgccggtgctgggataccagcggc

SEQ ID NO: 644 - DNA, 200 bp, Mycobacterium paratuberculosis
tcccggctcgaccacgacgaagtggccgccatcgacgaggccggccccgccccgcagctgtccgccgacctgttgccgtccctgctgaccgcggtgcgccggcggcgccggcgcggccgggtggcgacctgggtggcatcggctgccgcggcggcggtgctggccatcggcgtgttcgtcggcctcgaggggtggtcgtc

SEQ ID NO: 645 - DNA, 200 bp, Mycobacterium paratuberculosis
cggcgagcgtcagcgcgacaaggcagaacgcggctccgcgcaccgcgacgtcccgggcgcgcgaatcacgggcgggcgccggcggcggggccgcgatcggcaccggcgcggctctgggggcgggcggcggcgcgcccgtctccgcgctgaccgcggcgagcgggtcgacggtgccgtgcccgaccaggggatcccacccg

SEQ ID NO: 646 - DNA, 200 bp, Mycobacterium paratuberculosis
tacctgcgccacctgagcaaggccagcacgctgcgcctggacgggctgaccgtggtggtcgactgcgcgcacggcgcggcctccgccgtggccccgcgcgcctaccgcgcggccggcgcgcgggtgatcgcgatcaacgccgaccccaacgggctcaacatcaacgacaactgcgggtcgacgcatctggattcgctgcg

SEQ ID NO: 647 - DNA, 200 bp, Mycobacterium paratuberculosis
gggatgacgctgacgagacggccgccgacgaacccgccgcgccggatcgccccgcgcccgccggcgaggccgaaccgaacggcgagcccgctccgagcggcgaggccccgcccaccggtgagccggcccaacccgtcgcggccacaccgccggccgcgccgccaccgggcgcgccgccaccgggcgcgccgccgccggcc

SEQ ID NO: 648 - DNA, 200 bp, Mycobacterium paratuberculosis
cgtcgagctgaacttcaccgcgatcgggcatttcacctcgatcctgatcggcctgtgcttctacccgatgacccgcgccaagggcgggcggcagctcagcccggcgcggctgcgcgccatgctgcgccggcgcgtggcgccgccggcccggcccgacgtcgactccggccggtaacgacgactccggccggtaaccaaag

SEQ ID NO: 649 - DNA, 200 bp, Mycobacterium paratuberculosis
agccggccgaggaggccgacgaccacggccacggacatcaccatcactaggtctgccgagcagacgcaaaagcccccgacacgccctgcgtgcgggggcttttgcgtcttctcgttccctacggcggacgtttagtctcgcggcatggatcgcatctggcagtgggtgtgggatcggcacggcgcgaagtatccctgggt

SEQ ID NO: 650 - DNA, 200 bp, Mycobacterium paratuberculosis
catctgggcattcgggttcacatcgatgttcgtgacctatgccctttggtcgctggtcatcacttgttacgagagatcgagtcactatctcgaagcggtcgtcgtcaccggtgtgggcgttgtattgcagtcattagtggtgctgcctgttcggcgacgatttcgcttgatgcggccggtgtcggccagtgaccaggtcg

SEQ ID NO: 651 - DNA, 200 bp, Mycobacterium paratuberculosis
atcgattccaggcgctcaacgaaacgtacgtgtggagtcggacagcgcgcatcagacagttgtggtttgtacccatttgggctgcaacgtttttcgcgattgtcagtgtgctcgccggagctcatgggatgcgggtcgtcgagtacgtgatcgtgggtggcgctatgggaatcgtcacgacactgatcagtttgcacacc

SEQ ID NO: 652 - DNA, 200 bp, Mycobacterium paratuberculosis
ttcatggagggatcattacgcccggtgagagcagcgctggcgggggattcgggcatcggcgacgctttaccgcgctcccgcccgaccttcgcctggtggttggaagtctcgatgctcagcgctctgtgcaacttcacaaccgcgggcatgatggtcggagccctgctcggccgggtcagcgattccccgctgctgcccct

SEQ ID NO: 653 - DNA, 200 bp, Mycobacterium paratuberculosis
cttgatcgcctgcgtggcgacggcggcactcgcggcgccggtcaccgtgggtgccattgtctcaccggcattgcatccgatccgtgacctcgccgagggcactgaacgcgttgcggcaggcgattacacccgtcgcgtgccggtggtccaggacgacgatctcggcgcgctgacggcgtccttcaatcggatgcaggcgg

SEQ ID NO: 654 - DNA, 200 bp, Mycobacterium paratuberculosis
gattgactgagcgacaacggctgcaggcggctttcggcacttacgtcgacccggctctggcggcccgactgctcgagcagggcgatgacgtgttcaccggcgagcgccgcgaggtcaccgtgatgttcgtcgacgtccgcgatttcacgccgttcgccgaggccaatagcgccgaggacaccgtcgcgcgtctcaacgct

SEQ ID NO: 655 - DNA, 200 bp, Mycobacterium paratuberculosis
ctgtttgagatcgtcgtgcctgcggtcgtcgacggcggcgggcatgtgaacaaattcctgggagacggcgcactggcggtgtttggtgccccgaatgatcttgcggatcatgcggatgcggcggtgagcgcagcgctgctgattcatcgcctcgtcgctaagcgtttcggcggtgtgcttcgaatcggcatcgggatcaa

SEQ ID NO: 656 - DNA, 200 bp, Mycobacterium paratuberculosis
caccggtgtggtgatcgccggaaccatcggcggcggcggcaaacttgagttcaccctcattggtgacgccgtcaacgttgcggcccgcgtcgagcaactcaccaagacgaccggtgacgcgatccttgttactcagcaaaccgtagacgccttggtttctcgaccgcccggactgagcgacaggggtactcacgccctga

SEQ ID NO: 657 - DNA, 200 bp, Mycobacterium paratuberculosis
agggcaagtcagcccccacagcggttttcggcctcgacccagccgtcacgccttcgcatcgcctcggctgaatgccgaacgctcgccacccagtgggatggcatggtttacattcagcactgtagatccttggatctcgatcgattgcgtatcgcttcccggtccattccacggcgctttgcgcgccgagcagatcgggt

SEQ ID NO: 658 - DNA, 200 bp, Mycobacterium paratuberculosis
atctgacgagccgaaggggtggtacttcgccgtggtgtcctcgtcgtcttcggtggacgacagcggtcgcgcgacagtccgacaggtgactctagccgtgctagacgggtgatcgtgttgcatcggagtcggtcttggcgacgtccgcgaatacggttacctgatctgtgccgcgatcgagttgaggccgatgtgcgacg

SEQ ID NO: 659 - DNA, 200 bp, Mycobacterium paratuberculosis
agatctgttgtactgcttcggttctccgtcgattctgtatcgatggccccgtcattcgactgcttctgagcgccgagggcacccgagaatcacaagccgcagccggtacctggacaccgttctcgaagccttcgccctgggtctcggtcgtcgcgctttacaggctgaggagaacccgtgacccgtccggacgcttgacg

SEQ ID NO: 660 - DNA, 200 bp, Mycobacterium paratuberculosis
gacacttccagctcacccccagtcgcttccacgtacttgcggagagtgtcgacccggctcgtgcccagatcgccatgttccatctgcgagacgcggttctgcccgacgccaatagccgcagcgagagtcgtctgcgtgtagccggcagcctcgcgcagttcgcggagacggtactgggcaacctcgcggtccatctccgc

SEQ ID NO: 661 - DNA, 200 bp, Mycobacterium paratuberculosis
cttgatcgcgtcgatacgggtccggttgccgggacggcgacggcgcatgtcatcaagattggtcatcgtttctttcccttccttggtttccgattggtggctttggctgctgccttgtgtaaacgcttttggtgagcatcgaagagctcgtcggcaatgggaatgtgcttggcataccacttggaccaattgcccgcctt

SEQ ID NO: 662 - DNA, 200 bp, Mycobacterium paratuberculosis
gtctccagcgatcaacatgatcgcccgcgaccgggtatcgaaggcgaatagcacgcgaatgtgggctccagctttcgtggggcgcggacggagctccttcatgttcgggtgccttgacccttcaagggtgtccacaaacggccgccgggtaattggaccgtgttcctccaactgctcgagcgctgctatcaagttgtcgt

SEQ ID NO: 663 - DNA, 200 bp, Mycobacterium paratuberculosis
actcctcgtcatcgagggcatccatccaggcttcgatgagagtcaggtcaacctcccatttccgcactaccgcatgatatcagctaggggtgatgtctcgagtgtccgggtccccaaccgcccatggtcggacgacttgaaccgatcaccatcccggtgcggattgacctgcgtttcacacggcggcgcgacgccggttt

SEQ ID NO: 664 - DNA, 200 bp, Mycobacterium paratuberculosis
tgaaggagttgcataagtcgcgacgcgattcctccacgccttgtccgacgctgcggttatgctgacccagcctgtagataggtcagctaagtagcaaggggacttcatgacgcagccaacagcgggttggtatcccgatccatctaatccgagccgccagcggtacttcgacggcacagcgtggaccgaaagttatgcgc

SEQ ID NO: 665 - DNA, 200 bp, Mycobacterium paratuberculosis
catttcccgcgccgccacccggcgttggccagcccgtgaagcccagccgccagaagaagtccgataagaagtggatcctaggcgccggagccgtagtggtggtcctgattgccatcgccagcggcggcaacgacggcgacaagaagaccgtcgcggagtcgaacacggcagcgtcggtcccctcaagggcaagcgcgccg

SEQ ID NO: 666 - DNA, 200 bp, Mycobacterium paratuberculosis
acgaagccaaagcatgtagggcctgccgtcgcccccgctgggtccccggtgcgagacggtaagttcgagtttcaagtgcttggtgtcgatcgctcggccactaaggaaggggtcttcagtttgcagcaagccaagggcgagtttttcgtcgtgaagctccgcgtgacgaacatcggcgacaagtcccaaagcttctctgc

SEQ ID NO: 667 - DNA, 200 bp, Mycobacterium paratuberculosis
ttccaaccaaaaactgatcatcgacggcaagaagtttgacgcgacgacctcgctcagcgacaacacctggatggaagacatcaaccctggcctcggtatggatgggagcgtctcgttcgacatcccgccgggcgcggtgccggaagcgatagagttccatgactcgatgttctcgggcggggctcgtgtagctctgtagc

SEQ ID NO: 668 - DNA, 200 bp, Mycobacterium paratuberculosis
ggcagggccggcgatttccgccggaacggcggcgcgcccgcgggtcggccgggagcgcgcaggcccgtcgtctttgggactattagtctctatgctggcagggcggtcgcggccggccgcgccgcgcgggcgcgcgggcatgccaccatgaggcatgaccgggccgcaaggtaacggaaattcgagcagcaacaaggcgg

SEQ ID NO: 669 - DNA, 200 bp, Mycobacterium paratuberculosis
gccgagcgcgccggtgacgctggacagcatctgctgcagcatctgcatctcttgcgagccgttggcctcgttggccgggaacttcgcggcggcgtcggcggcacgggccttgcggtccgcgtcggcggcggcggcgtcggcggcgtccttggggacgttggcgttgccggccccgccgaccatgccctgcccggcgtcgg

SEQ ID NO: 670 - DNA, 200 bp, Mycobacterium paratuberculosis
ccgccccacccactcctggcccacccgccgacggcggcacgacgcctgcgtccgtgtgtggtcgtccggggaagccggcagccccgacccctggacttccgttcgagagcgcttgatcacttccgctggagtgcggctcgctcggcataccaccaccgactcccggtccggtagaggatttgccctggcctaaatggaga

SEQ ID NO: 671 - DNA, 200 bp, Mycobacterium paratuberculosis
catcgcaatatccttagcgatcacatcatcgagcgcagcctgataattagcatcgctggcgactgcactgttgttgtttgcagtgaccgttccatacgctgccgccaatgctttcgcggcatcgcgacgatcggcatcaagtgcgaggttgtcagcaggcatgttgagcaggagggcaccgttagtatcggcgatccgcg

SEQ ID NO: 672 - DNA, 200 bp, Mycobacterium paratuberculosis
ctagcgcacgatcgttggcattagtgtcggtcgctactgcctgcgccactaacctataggtgtcgcataggtgcttttgcgcagctgcagtttcgctgagggtgtatttcggcaatgtggtcgccgcgggcaatcttgtagcggggcgaataagagcgattgccagtgcgccagcggcgactgcggccgtcacggctagg

SEQ ID NO: 673 - DNA, 200 bp, Mycobacterium paratuberculosis
gcaatcgccagccatggccgcgggcgtcgcgccggctgccaaggataggacggtggccgactacccacgggcggatggacgcttggcccctcaccaacgccagcaggtaggtcgcctaccatgtgccctcctactagtcagaacgcgcctgacgtgccatcaccgctacctctcaatagtgaggcaggcggcgggacgac

SEQ ID NO: 674 - DNA, 200 bp, Mycobacterium paratuberculosis
agcaattcaccgtgcggtactgtgccgtgctagcccaactccccacccatatccccaccctgcgcactctgccagtcaagcgttcctcgcagcagcgggtggctcatatgcgcccaaggcgtatctccgaaaggctgggacacctgccgtgcgggtttacctataaggttgctcagctgcctccgcagaccgtcttcatt

SEQ ID NO: 675 - DNA, 200 bp, Mycobacterium paratuberculosis
gcagcgttcttgttattggcattgtccagcgcagattgccaggcgggatcatcgctacccgtcgccacgctggatgttgctgccacattgctatacgactcagccagggcaagcgcagcagcgcgatcaccgggggcaattgccggatttgcgtttactgcttcttccagcatcacggctccgtttaccgtcgccaggtt

SEQ ID NO: 676 - DNA, 200 bp, Mycobacterium paratuberculosis
ggcgccaaatcggagatccgggtggtcaggatccgcccggtacccgggcagggagtggtccgtgtctcgcagtggatcgaacaacgcgatgtgacgagttccctcactggaaatcgggaccttggtaacaatcgtggggccgatcaacattttgaccccgaggacaccaaagtaacgacctacatcgactacgaaaacgg

SEQ ID NO: 677 - DNA, 200 bp, Mycobacterium paratuberculosis
gctcgtgatcctgcgtcagaatccctccgtcgaggagactcccaccggggcgccgggtacggtcaaggtcggcacgccgaaaggcagcgtgactcagttagctgacgggtcggttcggatcaaatacgacgcgggcaatcccttcgcgccaagcattaccgctgatacgaacggcccgtttgcgggccacaccatcactg

SEQ ID NO: 678 - DNA, 200 bp, Mycobacterium paratuberculosis
taaacggtgacctagcattcaccccgggaccggaaggcgtccacgtgaatggcacgcgcactgattatccctccctcgaggcttatcaggactttccaggtggcagtacccgcacgttactaatcgacccagcgcagtcaactagctcggtgggaccgatgttcaaccttccgttccaccacgacgtcggcccattgggt

SEQ ID NO: 679 - DNA, 200 bp, Mycobacterium paratuberculosis
ggtagagcattcgcgccgtttgacagtgggggttggaacctcaaatacgacgtgccagcgccgctgcccgcgacggagttcggcccggttacccgtgccccgtcgattcctctgctgccaagcggagtagaggtccggcctgatcgcttactgacaggaaagctactccgatgccttcgttcacccgcgcaacaccactc

SEQ ID NO: 680 - DNA, 200 bp, Mycobacterium paratuberculosis
gacgccggcgcctggcgcacagcaacctggtcggcaccccttgtcgtccaactgatattggcaatgctgcttgtcgccatgtggttgctgggcaagtggccgttcgaaacgcatagtgcgtacgccggtgaacgaacatggatgctgacctcgaccgtcattacgactttggtggcgctgttaatcggcgtcgcgttcct

SEQ ID NO: 681 - DNA, 200 bp, Mycobacterium paratuberculosis
gaggtccccgtcaccacgtaatcgtggtcttggggtcagcattgcaagctgctcggtggtcgtgctcgccggcggaacgcttttcgcttacatattcctgcgctaaaggccaccgatgacagacaaacgttttgtgggcgaaccaagcgatcgatacgggccactgactttcgccatagctatagtccacgtctttgtgg

SEQ ID NO: 682 - DNA, 200 bp, Mycobacterium paratuberculosis
tcgatctcatcacctggatcatcgtcgtgccgatgtggcccttcgtcgtcttcgttcttccgataacgctggcatacatcgctgtcggcgccattattgcgagggcaccgggcagatgggggcaggtaggccgcgggatgatgattggcagcctgtcaggaccaatctcaattctgattttcattcccgcttttattgtc

SEQ ID NO: 683 - DNA, 200 bp, Mycobacterium paratuberculosis
cggataggtggtgtggaggatccgcatcgcgcgctcggccgccgcgccgatcggggtgtcgaattcgtccgctgtttcacgtgaaacattggccggcggcgaggtcgacgcggcggcggatgacggcggcgccgtggccgcggtcggcggcggcgccggggatccaaccgccgacgccccccgcgtgcccgacggggccc

SEQ ID NO: 684 - DNA, 200 bp, Mycobacterium paratuberculosis
cggctgccgcccgggtggtggggctggacggaatggccgccggtgacgcccgcccgggcggcggggactggctcggccgcggcggccggcgaccggcgcgcaccgcggcgacggcgtcggcgaacggccccccgctgcggtagcgcatcgccgggttcttcacagggtgatctcgatgagctcgcgcacgttgggtggca

SEQ ID NO: 685 - DNA, 200 bp, Mycobacterium paratuberculosis
cggaattcaatctggataacccgctgaactacatgccgcccgagttgcgagcgctgtccgaacaacatttgaccggcagcggcgaaaccgtcctcggcccattcaaaaatccgtcagggggaccgtcgtatatcgagcccgctcagcagcgaggtgcgagctatttcgatataggggatgcatggaacgcgtcaaccccg

SEQ ID NO: 686 - DNA, 200 bp, Mycobacterium paratuberculosis
ttcaccacagagactcacgcgatggccctctacatcagtaccgacacgccgccactatttacaccacgccccggcacgttcccccataaagctgtcaacttcaatcgatagggttctggacaacacgtataccgccgcggaactccgctatctaaaggctcatggctaccaagtcgtcgacggctataccctagttccac

SEQ ID NO: 687 - DNA, 200 bp, Mycobacterium paratuberculosis
ccaagatcggaggttagcgcggatgaaagcgctccttgaatttatcgttcaatactgtggcttcctctacctcaaccccggctacagaatcacgaactcggccacccgaggcttggccgacatcgacgcatcgattacgttcaccggcgaggagatcgggtggcagatcattaatgatcgcgggctcatctactttgctg

SEQ ID NO: 688 - DNA, 200 bp, Mycobacterium paratuberculosis
cggcgccgtcacaaggtgtgtccgacgattcgtatgcactttcccttattcgtcaatacctagaaggcggcgaggatgtcggtgctggccccgcgatcgacgaggcgagctggttgagcgcaaacttgagccggatcgagcggctatttaccgatgaatcgaacgctgcgcgcgtctgcgacgaacttgccgatctacga

SEQ ID NO: 689 - DNA, 200 bp, Mycobacterium paratuberculosis
cgctccaattcattcaaaaaatggggatggcccaaaccggaggaaaccgactagcggcaaatcctagaccagtggagtccgcggccgataatgcagagcttgctacggtgccttttacgtacttcgacttcctgtatttagacgctcgatatcgcctcgcggattcgacgacatccggaagtccgacgagcaaatcttca

SEQ ID NO: 690 - DNA, 200 bp, Mycobacterium paratuberculosis
ttgactttgactggcccggttgtcagttgggagctgattaatgacaggggccagttcggatgatgaaacgaatgcggtatcgccggacgagaccattgcatggatccgaagcaacttgagccgcatcgagcaattcttcaccgcggccaagcggagcattcgtgtgagcaactcattgatctcgcaaaggcccttgcaac

SEQ ID NO: 691 - DNA, 200 bp, Mycobacterium paratuberculosis
aaagtacttcggctcatcacaggagtgaagctgctgccgaacggcgaccaggggctggcggtgaaagagcgttcattatgcggctgtacctaacccgccgcgcaccaggctgccaatgcagccactgcgggacttccggcgtgaccggatctgtgaagtcctcgaggtcggatgcatctcgagcacacgtggcgttgcgc

SEQ ID NO: 692 - DNA, 200 bp, Mycobacterium paratuberculosis
tggttgggcagcggctgcgcgggcaacccggccggggccgccggagcggtctgggcgagcggcaccagcggagccgccgcggcgggcgccggcgcggtcggggcggcgggggcgacgggtgccggagcgacgggagcgacggccggcgcctgggcgggcagcgcgaccggggcggccgtgggtgccggggcgctcgcgcc

SEQ ID NO: 693 - DNA, 200 bp, Mycobacterium paratuberculosis
gtcggagaccgtcatccaacccaccatcgaagtggcgcccggcatcacgatcccggtcggcccgccgacgacggtcacgctggcgcctgccccgcccgcgggcggcccgccggggggacccgagccgggtggcggtgtaccgccggggccgggcggcggtgttccgccgggtggtccccaagcaccgcctccgccgccgt

SEQ ID NO: 694 - DNA, 200 bp, Mycobacterium paratuberculosis
gctgccgatcctgaaatcatcatgcggattgaagcggacggcgtcgtcgcggtcccgtcgggatccgccccgtaccgttaccaattgcgtttacctccgggtgctgagcaagcaccgcggcggtgcgtggtgtgtggcaagtcgtttattccccaaaccagccaggtgcggacctgtgggcgttcgtgcggcggtcgcgc

SEQ ID NO: 695 - DNA, 200 bp, Mycobacterium paratuberculosis
tgcgcaccatccggttgcgcgccgtcgtcgatctgtgagaatgcggtggtgcattcggacggcggccgggcgggatcgcggccaatcacggcgctgtgggcggtccttgcttcgggcgccgtgctgtgttgcccggcgccggcccacgcggacacccaattgtgcgacccgtcgagcgtcgattccactcagatgtgcca

SEQ ID NO: 696 - DNA, 200 bp, Mycobacterium paratuberculosis
ctacgagaccccgtcaccggatgtccggatggtgtttcccgccaactatcccgacgagcagacgatgatcggctatttgaccaaggtcgacaacgactttcgcaatgcccgctcagcgggtcagacgtcgacgtcgccgacggcgctgaaggttaccggcacccggtacagctccggctcgcaggcggcgggcacccagt

SEQ ID NO: 697 - DNA, 200 bp, Mycobacterium paratuberculosis
cggtggtgaccgagatctatcagaacctgggcgcggcgcacccgatggtttggtacaagtcgttcaactacaacctggccagccagcagcccgtcacgttcgacgcgttgttccggccgggaacacaaccgctgcaggagatcttgccgatcgtgcagaagacgctggccgaccggtaccgggccaccgtctcgattccg

SEQ ID NO: 698 - DNA, 200 bp, Mycobacterium paratuberculosis
cccgccaccgggctcgacccggcgaactaccagagtttcgccatcaccgacgacgccatcgtgttcttcttcgaccagaacgcgctgcagccggccatggaagccactcgggtctccgtcttgcgcagcgcgatcgcgccgttgatcagccccggcatcgcatagtggcgccgacggacgggcgcgttgcgcgatcggcc

SEQ ID NO: 699 - DNA, 200 bp, Mycobacterium paratuberculosis
tccgaatagcggattcggagagatatcccagtactgacattgcctgcgtcggcggactccgcccttcgtgtacaacctgctaacggtggggcgtgcggttatggccatcgatgttcttgttgcacaacggattcagagcaccgttcggcggccgggttacctgaaggcgtggatccgcgacagctgagcgtggagcgtgt

SEQ ID NO: 700 - DNA, 200 bp, Mycobacterium paratuberculosis
gtagcggcacccgcggtccgaggatcggtccgggacggcgttccttgtgacctcggcgctcgagtcacggcgccaccccgaactcgtcgccgccgaccacggcctggtggccggccgcagacggttcttgtcgtgggcgctcaccgatgccctcgacaccggtgagctgtcctcgaaaccgaccctgccacgattgtgga

SEQ ID NO: 701 - DNA, 200 bp, Mycobacterium paratuberculosis
gatgctgttggcagcgctgctggggatggcattgtcggccagccatatcgatttcgacctgggttcccgcgacttcgcggacacgttcggacagctgctgtccgctcagtcgtggcgatccgagacggtgagctccggcacgattgttgaccttccctgtgtgtgacgaccgcggcgggatatttatcatttgtcttgcc

SEQ ID NO: 702 - DNA, 200 bp, Mycobacterium paratuberculosis
gataaccgatgtcggggctgaccgtcgtctgcatcatcactgtgcccacgatcggcccggctgtccggcggcgccgccaacttgccgattcgatctcggcgcagtggagattcgtctggtcgtcggcggcagcgcgggcagcggagttcgccgtcggcgagtaggtgctcggcgagttcggcggtgcgggcaacgatcac

SEQ ID NO: 703 - DNA, 200 bp, Mycobacterium paratuberculosis
cgtgcagccagtccatgacccatcagccttgcctatcgccctcgggcgggtacaggggtcagttcgtgttggacgacaccagatttggatcagccgccgtcactgacggtgcccggccagctggtcgcctggggatacgggccggcggcgcaccgtgcgcgaccgcgacagcaccacggtgacggtgcgaccccgccgca

SEQ ID NO: 704 - DNA, 200 bp, Mycobacterium paratuberculosis
cccgatgcgatcgtgctcatcaacgcatatcgtgatacccgcagccctgcaaccacgtcacgccgacaccaccgcggcgatcggaacagcattgctgcacaagccaaatggaattcgacacccggcgcatcgcggtcgccgtcgatcggcccgtgtccacagtgcggcgctggctgcgccgcctaccagcggcacacctg

SEQ ID NO: 705 - DNA, 200 bp, Mycobacterium paratuberculosis
gaacgcatctaccaaggcggcacccgacagccactggaactggatcctgacgttcgctgcgcaacaccgcaacctgctgcatcacgcgttgtcgatcctgtcgacagccgcctactgtgaacgccaccgctagggcatcgacgacccgccctggaccctgatcgggcctacacccgaggtcgcctgttgtcgccaccggc

SEQ ID NO: 706 - DNA, 200 bp, Mycobacterium paratuberculosis
ctgagcctcatcgcggcccccgcgagccatcgggagcgccgttcggcacgcccgccgacgcccgtcaccacgacgaccatcacgtcgccgcgccgaccaacccgtcactttcagaccaactcccgatatcacgtccgcgccgacagtgacggcatcatctgcatactcagcgacggccaacagagcgcaacgcccgacgg

SEQ ID NO: 707 - DNA, 200 bp, Mycobacterium paratuberculosis
taacagcatcacttcgtttggtggagtacgggtccgcgtgtccgcggtcaacaacgtggtcaccgggcttcccggttcgccgcggcgatgttgtcgaggaggtaatagtcgcgttcggtgctgccaggcgccatcgggtgcggcggggccgccataccgggctgcagtggcgccagcagctggtccttgccgtagatcag

SEQ ID NO: 708 - DNA, 200 bp, Mycobacterium paratuberculosis
ggatcgggccgacttcgagtgcgccgggcctgctgcgctgcctgcctccgagcttggccgcgtccacatgaacctgagacccagactaggccgtgtcatcaaacggcgttcctcgaaacagccctgccgcatcacctcgacgagcgggaacatcaatacacacccgaatccgagaggctgggactgtctaaatagcggtg

SEQ ID NO: 709 - DNA, 200 bp, Mycobacterium paratuberculosis
gatccgaccttcattgtctggtgtgcgtcatcgaggtggtcaggtttgtgggcgtccattccgtcagcatcgggggcgggaagccgatccgggagtgcgagcttgaagatggtgcgcacggtccctaggtattggcgtgcgagcggaccggtcgtgtacggcaggtcgaagcgcgcgcatatggaccgcacttgtggtgc

SEQ ID NO: 710 - DNA, 200 bp, Mycobacterium paratuberculosis
gatctgcgcgtagcggttgctcgggagatccggaaagaggtgatgctcaatctggtagcagaggtttccgctgaggaatgccaacaccggcccggcgcggaagttcgcagtgccaagcatttgtcgcagataccattcggatttggactcatcgttcagtgcgtcgggcgcgaacttctgtgtgtcctcgccgaggtgtc

SEQ ID NO: 711 - DNA, 200 bp, Mycobacterium paratuberculosis
cgcagcagatcaccacgtaagcccacacatttcgcagcaggttggcggccgcgttcgcggtgagcgtgcggcgccatcgccgaagactcagcgcgggaaagatcagatagtccttgccggcctggcacgccactttctgcaccaaggcggtggcggtagttgtgggcatagcgccactgtgaggagacgccgaccatgtc

SEQ ID NO: 712 - DNA, 200 bp, Mycobacterium paratuberculosis
ccactcccaggtgctggagtggatttccgggtcgttcatccaatcccattgaccgtggcagatgttgtgaccgagctccatgttctcgatgctcttcgcggtggccagcgcggcggttcccagtgcccagccgggcccgcttcggctggcggcgatcacaagccgtgccgcgaggtcgaggccgcgctgaaacgcgatgg

SEQ ID NO: 713 - DNA, 200 bp, Mycobacterium paratuberculosis
cccgctgaatgtatgtccgatcatgttcaccgcgcgaattctcgatgtcgcgacggattgcctcaagtgcgacaccaagcgcctcgaggtccgcctcccgcaggtgagcgtattcggctgcgtctgttatcgccatcgtcgtcttgcccaagtctgcaaatagtttgggggtcatacctattcgcacagaacgacggtga

SEQ ID NO: 714 - DNA, 200 bp, Mycobacterium paratuberculosis
gtttggaaagcttgctgcgtgtcatcgaggtcacgtccgttcgtggtcgccttgttgaggctcggtggtgtccgcgggagcggcgccggggatcgtgaggcgcacggccagtccgctgagcagaatgtcgagtccgcggtcgagttcagccagtgggtcgtaggaagcccagaccggtgcgagttcgcgtaggtgcccaa

SEQ ID NO: 715 - DNA, 200 bp, Mycobacterium paratuberculosis
actggtcgatcggaagccggtgtagacccagccgcaagacgtggtcggtttcctccggccgctcgacgatttcctgcagttcggtaagtacgtgcccgtacaggaacccgaacaacgcccggtagacgtgcagcgcgtcctccccggtgaacccggccccgatgagcagggtcagaacctcttcgagatgccgcaggatt

SEQ ID NO: 716 - DNA, 200 bp, Mycobacterium paratuberculosis
cccggtgggcgcatcccaagcggtgtggccagcggccgggtgaccaacaacggcaccacgttggggtgcgcacgtgccagatctcggaattcgtggccgagcttgcgtagtgcagcggcccagtccggcgttgtggtgtccagcgaaagccgttcgaagaccatctcgacgacgccgtcgagcaccgcggccttgttcgg

SEQ ID NO: 717 - DNA, 200 bp, Mycobacterium paratuberculosis
cacatgccgatacagtgccatcgggtcgcgcccgacggcctcgccgagccgccgcatcgagagcccgtcgacgccgtcgcggtcaatgatctccagggcgctggccaggaccgccgcacgggtgatcggcctgctctcaccgtcggcctcgttgttgcgggattcgggcgcggaacttgcaaggcctgctggtggttggg

SEQ ID NO: 718 - DNA, 200 bp, Mycobacterium paratuberculosis
tcatggatgctgccgccttccgggcgtgtctccagtgttgatctccaccgtaggcctacactgtagacaccgcaatgccgagtcaccttcacgctgttgacagtagtagatctatgccgtagatatacaccgttgacaagctcgacgatgtggcgtgtactggacttctaagcatcagtagaggcgccgccatgatcgac

SEQ ID NO: 719 - DNA, 200 bp, Mycobacterium paratuberculosis
atcgttggaccggttgccttgctcgccggtggtcgtggggttcaccggggtgctgaccaacacgggctcgctggcctatcggccgcgaatggcgccgcattcggcgatgacatcaccgcgccgacgcgcacccctccgtcctcggggtcttcgttggcgcatttcgacgctcggcttgagcgtgcagccagccggtgtac

SEQ ID NO: 720 - DNA, 200 bp, Mycobacterium paratuberculosis
ggcgttccgcgggacagggcgagccgcccgccacgatctggagatgtcgctggctcgcccggcaaccagtctcgcccatgtcttcatcccgcgttcgcgggttatgaacaccgagaacccaaggagtccgcaatgagagtggctgcaaagattgcccacaagttcgaagccgccaagggcagcgcgaagaaggtcttcgg

SEQ ID NO: 721 - DNA, 200 bp, Mycobacterium paratuberculosis
tcgcgccaccggcaacaccggcatgcgggccgagggacgcgccggccaggtcaaaggcaacgccaagcaggcaggcgacaagctcaatgacgctttcaaacactgatcccgggcacatccgccccgatcatctccacgagacttaggtaactatcatgatcatcttcggaattgtccttattgttttggggctgctcctc

SEQ ID NO: 722 - DNA, 200 bp, Mycobacterium paratuberculosis
ccgagccttgcccccacattcgcgttcgcccatgttgtcctggtcatcggggtcatcctgctggtcgtgggcctgctactcatgctgatggggcgcaccggtcacgccatcggcggccggcgtcactactactgaccgtggttccgtggccgacggcatcgagtcgacggccacgatcggccccgtgacccgacagtcga

SEQ ID NO: 723 - DNA, 200 bp, Mycobacterium paratuberculosis
gcactaccacttcgagactgcacagccgcagatggcaccgaccaaaccgccacgctgcgtgcagaactcatgcctcaccaactcgcaaggagccgatatgtccaccagcagtgccgttttcgtcgtactcgtcgtgttcgccacgaccgtgcccatcgcaatcttcgcatgggtagcgggcaaaaaacaccgcaaagttc

SEQ ID NO: 724 - DNA, 200 bp, Mycobacterium paratuberculosis
gccctgcggcgcccgacaacacccaccaatccgtcaaacagggagacccaccgcgatttcgacagcgcgaggcgtgggctgacgaggccgccgacctcagcactgcgcgcggtcagaagccgacatctgagcgaccccagcatggggcctgcctcaacgggacggcgtccgccacaacgcgtcgccgaacctccctgagc

SEQ ID NO: 725 - DNA, 200 bp, Mycobacterium paratuberculosis
agctcgacgacccaatgggaccgagcggacacgatggatactctccgacatgcgccccatgagcatgtgaatgccgatcacaaggaacgccaagacaattgacattatccacgatgccccggacggtcggcatagaggaagagttccaccttgtcgacctcaccacccggcggctggcaccgcgggcaccagagctgctt

SEQ ID NO: 726 - DNA, 200 bp, Mycobacterium paratuberculosis
ggactgctgtctgacggttatgtggccgaattgcagagctgtgtcgtggagaccaacggcagtgtggtcagtacgcttgcggaactgcgggccgatctgactgagcggcgtcgagtcctcgtcgataccgccgctacgctcgggttgggcgtggttgccgctggggcggttccgttgtcggtgcccagcgagatgcacgt

SEQ ID NO: 727 - DNA, 200 bp, Mycobacterium paratuberculosis
gacccagacttcccgttatcagcagatacttgccgactatcagctgttggcacgcgaacaactgatctgtggaacccagatacacgtgggaatcgacgaccgtgatgaatgtcctggtggccggtcgggtagccgcctatgttcccactctgcttgccttgagcgcgagttcgccgttctggtccgacggatctgacacc

SEQ ID NO: 728 - DNA, 200 bp, Mycobacterium paratuberculosis
ggctacagcagcgtccgaacattggtatggcagcgatggccgaccaccggattagcgcctccggccacgtcagccgcggagtacgacacgttgatctccaatctcattgcgaccggagtgatcaccgatgcggggatgtcgtatttcgacgttcgccccgccctgcgaactcccaccttggagctgcgcgtgtgcgatag

SEQ ID NO: 729 - DNA, 200 bp, Mycobacterium paratuberculosis
ctgtccacgcgccgacaccattgtgctcatcacggcgctattccgcgcgctcgtcgaacgcgagatccagggactacgcaccggagtgcctgccgccatagtggtgcccccgctcggccgtgccgcgctgtggcgagccgcccggtcaggactggaaggtgacctggtggacttgatacatccggcgagtcgccccgccg

SEQ ID NO: 730 - DNA, 200 bp, Mycobacterium paratuberculosis
gcgatgtggttaccgacttggtccagatgctccgcccacagctggaggcatccggggattggcaggccgttgagggcctggcgcgcaaggctcttacgcagggcagctctgcggccaggcagcgtcgcgccatgcgcacgcgcaatgacctgttcgacgtcgtggatcacctcatcgccgagaccgccgccgtcgcgccc

SEQ ID NO: 731 - DNA, 200 bp, Mycobacterium paratuberculosis
ggcgcccacggtacgttggcaacccgtcgtaatggatctgacgggggctgagagccaccgtcggcacggcgcaaacaaatcgctagaccgcggcctccattcggagctggaccggcgtaggatcaacaccatcggtggtatttcgtacacacagccagttcgagtgtggcatcgctgattcgaagtgatatggccgcatc

SEQ ID NO: 732 - DNA, 200 bp, Mycobacterium paratuberculosis
acgcggtccagatgggagcgtcgccatgacgccacagcagacacgcagaaacgatgagaacaccatcgtgccggcgcgcacgccgcgcctccggttaaaacccaaagcaccccaaagcggctatgtcgatggcgcctggtggccccgcagcgatgacctcagcgcagagttgccagacctgttggcagtgctctcggtgc

SEQ ID NO: 733 - DNA, 200 bp, Mycobacterium paratuberculosis
gcctgggccgcatcgaccgagtgctataccacctgaacgcctgggcggacgcgccacgaaagctcgccaccggaggacgggcggtacgcctagacgggtaccggcttcagccgatcaacaccatcgaagttctcgggctcgagggtgaccgactcacgctattggtgattccgcccgacaccgacgcgaacgacgcccac

SEQ ID NO: 734 - DNA, 200 bp, Mycobacterium paratuberculosis
cgcaccatgatgaccgcggcacaacctcgcaacgccgcgaccgtcgacggattgctcacgatcagccagcgagaccgggacagccgcacccaggcctccaccgcacaagaacgctgggaatcagaaggcggaactacagcttccccacggccggcgcagctccccggctgacgccggaacctcgcccgcggccccgcatc

SEQ ID NO: 735 - DNA, 200 bp, Mycobacterium paratuberculosis
cgagggaggacatgccgggcacttatgagcggtgacgaaacagcccgtgccgcttccgcttctcgtcaccggccacctcagtccagccgcccaccggataggtcacgggctgcattgttccagcacggacaacctccaacgacccgtcggcgtgcttgacgtagcggtcaccgaagcgcgcaaactcatcagtgagccca

SEQ ID NO: 736 - DNA, 200 bp, Mycobacterium paratuberculosis
tcgttgcgggttacttgcacagtcatggtcaaatccgatccctggcgatatcgccagcatcccattcttcagaagccttcgccgggatgggaattcgggaaagcactgcgtggtttggagatccctgaagcccagcgctgctgggcaacgccagcccgatccaagctgattcggacgcgcggttggatccccagaagccg

SEQ ID NO: 737 - DNA, 200 bp, Mycobacterium paratuberculosis
atctacacacgtctcgtcgctgggatgtgcggccctcatcatcgtcgcatgcgcatcggaggcatccgcgcacacagccacgaccagcagatcgagtcgacggaatcctgatcctagcaggctgacggttgagataggttggcgctcatatccatccaacttgaccggaccgccaccagcgtcgagttttcgcggcgcag

SEQ ID NO: 738 - DNA, 200 bp, Mycobacterium paratuberculosis
accgccagtcagacaatcgatagagtacccgttcgatgcggcccaggcgcaccgagagcactgccaacaggtctggcagctctgcgctgaggtcatcgctgcggggccaccaggccccatcaacataaccgctttggggtgccgtgggtttcaaccgaaatctcggagtacggaacgggccctgcttccgttgcggattc

SEQ ID NO: 739 - DNA, 200 bp, Mycobacterium paratuberculosis
tcgaccgctcgtagcgtcatatgaacgctcccatctatggccgagccaatcgacctaggaatcgatgctccaaaccccatgggcaatctgcacgaccgaacaccaacatgtttaacgatactcgcagtcacacaaaatagcgataggcgaggacgcatatgacggattgcgcgaaggaaccacgcagggcgccttacaaa

SEQ ID NO: 740 - DNA, 200 bp, Mycobacterium paratuberculosis
tagctgttggcgtcaggcgggcttgacccttcgactaccgcgacgccgccaccgtagccacccccctcaacaccgcgtcgcgctggtgccggccgcggtgcacaccgaccgaccagccgacatccactttggcgcacggcagctcacccatcaaaggccacactacgccgacgccgccctgccgactcctcgacaacggc

SEQ ID NO: 741 - DNA, 200 bp, Mycobacterium paratuberculosis
ccaccctgagtgtgtcgccgcaagtgcccagggaattcagatcacccatccacacagggagagtccgatgaagacggtgtcggagaacaccttccgttaacacatccagaacagccggcggcggatcaccggttcaggacacgggcgccggactggcgtcgccgctgcccgtcccctcaacgtcgggatcggtcacccgg

SEQ ID NO: 742 - DNA, 200 bp, Mycobacterium paratuberculosis
gcatcaacaccgtaggcctcacgaaacttcactccgagaacgaccaggcgcatccacaccgccggcggatcggtctcctggccctcgacccgtttgccgaacgcggcaccggtgagagtgaaccggacgcgatcctcgccatcgtcaaccccagccaccaatgtggccaggccccgcctcaacccgatacgtggccacaa

SEQ ID NO: 743 - DNA, 200 bp, Mycobacterium paratuberculosis
attcgcgctcgccgtcccgaacagccgaactcgatgagccatcaaccgcaccacacccgaccagtccaccgatcaccgcaggcagcgctgtactccgcagttcctcaaccgagatcttcgaccttgacgtcccccgcaaattgatgcaaatcatcgatccgagcacctgctccgcagtaatggtggcctctggtgccgcc

SEQ ID NO: 744 - DNA, 200 bp, Mycobacterium paratuberculosis
tagtggaaactcgcagagcctcaggcgaaacgccgatcggctttacaccacttcacggggcacaacccgagcaaacagctccgactgcacgttgaacacactgttcagttgttgctgccgtcagccaacaccccaaatctagacgccaagcaaactcctggaccctactcgtcgaacaatcccggcagcccaacgtgaaa

SEQ ID NO: 745 - DNA, 200 bp, Mycobacterium paratuberculosis
cagtgcgacatcgcgcgcagtgtcctgttctccaagatgtattgcgaagcagcgattcccagtcatcgccggtactatccccgggcccagccaggcgcaaccagtcaaccaacggtccggcccaccggggccgactcttctggcaccggccccggttgactgacacgttgtgcgacagcgaccgcgacattcaagtgcga

SEQ ID NO: 746 - DNA, 200 bp, Mycobacterium paratuberculosis
cgccacagaaccgcgctgactgcttaacccgaggtcgcttttttctgtgacgcctaacggcgaacttcgattacgaccactcatccgccgctgcaccacgggttcccgccgacaccggccccaaaccaatccgtcgtgtcggtcgtgctcatgccctacacaggcgggtcagggccggacgctgcggacagcgctcagca

SEQ ID NO: 747 - DNA, 200 bp, Mycobacterium paratuberculosis
tcgcaccgcgtcggattcccctggcatgtcgacgaatcgcctagcggatcttctcaggaattgagtccagcgcacgtagcacctggacggcgagcttgccagcactatcgtcgtcgaatatcgccgatagtgctgcactatcgtcgtcgaatatcgccgatgtgatcagtgtttgtttgacgagttcaacgcgcctttcg

SEQ ID NO: 748 - DNA, 200 bp, Mycobacterium paratuberculosis
tagggcgtgcgaaacgtcgtggggccgttcatgattttcccattccgtcaagcgtgttcactcaaccgagatgccgctcaacaccctccacagtaccctgcgcgctcctcggagcggtgcggccagagacgacgatcccgaggctgcacttcgtcgggactgtcggaacagagccatccgcttaggaggaggtggctgat

SEQ ID NO: 749 - DNA, 200 bp, Mycobacterium paratuberculosis
aatcggcgcctgccttgcgcaagggttccattcccggggacgaggcccagtccgtggcggccttgacatcgcgtcatcacgagttgcggcgggcgacctcggcggcgtagcgggggcgagtgttgccggcttcttcgctccaggtgacggcgcgtttgatgctgaagccgaggagtttggcgagcacgacagcgggcagt

SEQ ID NO: 750 - DNA, 200 bp, Mycobacterium paratuberculosis
tcgccggcgaggtcgatcagcgcggtgttgcgggcgatccggggggagatgccaattcgtttgagccgcagccccacttggttggcggacaggtgcccaccggagcgtcctccgggaaacagccatggattggtgcccacggtgaccgcggcgtatccgcggcgctgctgtacgagatcggcgagcaggcggtcgacggg

SEQ ID NO: 751 - DNA, 200 bp, Mycobacterium paratuberculosis
gctgggcacggtgagcgggacggcgccgagggtgagttggaccgcgtcgtcggtgatggtgacgtcggcaaccttgagggtgaccaggcgggcggcgggttggctgtagagcagcacgagcagcccggcgacccgatcgcgcgtctccaagtcggggtgttcgatcaggtattggatcaggcgccatcgttcgtcgtcgc

SEQ ID NO: 752 - DNA, 200 bp, Mycobacterium paratuberculosis
atggcggcggccatgatctgggcggcgaggccgtggttgcgtttgagtggtcctttgtcggcgcgggcccggagtttacgcaaatgattccattcggtgaatgcgcggacggccgcgcgatcgtcgcggttgctgatggtggccagccgggcggcgatgtactgctcggtgcggtgcagataggggtcgcggtctggcag

SEQ ID NO: 753 - DNA, 200 bp, Mycobacterium paratuberculosis
accctcggcggtcaccaggatgttgcgaagccattccacggatttgctggccgggaggtcatcgaggtcgtggtggctgagggtgtcgccgagttcggcgagctgcgcgggcagttcactgttcgatcgcatgcgtctgacccatcgcagcaccggcatggcgtcacattgcagcaacgcctcgacgatgcggctggcgg

SEQ ID NO: 754 - DNA, 200 bp, Mycobacterium paratuberculosis
cgccgctcaattcgccgttcttggcgaacaattcgcggagctcaccgggacaggcgcaggccgggcacagcccacggtggtacgtccgtccatgggcgccgcattgcacacagtcggtgaaataggcgggttcacgttgcaggcaggccgagcacagcggcccgaccccggcaagccgcgccgagacccccagcgttttg

SEQ ID NO: 755 - DNA, 200 bp, Mycobacterium paratuberculosis
ccgcaccgcgcgcacggttcccgacttcgtgcgcacgggttacacaccggctcaccggcgtcagtccgggtgtgcacggagcggatgttgccgcataccgaacagggttggggtgggcgctgtttggccgagcaggtgccgcagatcggctttcccgtccgggtgcgggtgcatgggcgagtacgtccgcacgagctgca

SEQ ID NO: 756 - DNA, 200 bp, Mycobacterium paratuberculosis
gaccgcggtgggtgccgggtagcagcgccggcagagcttcgcttggccgtcatggtggttgatgaagtccacacgaccgcaccgtgtacacggctcatgattgaccggatcatgctcgaaacaacggtgacagaggcgctcgccggcaccgtgataattgataaggtgacgctggcaaccgcaacgagcgcaggtgccgc

SEQ ID NO: 757 - DNA, 200 bp, Mycobacterium paratuberculosis
ggctgaagtggtgaccccagcaggtatggcagcagcgcaacccgtcaatctggctgccgagcttcacggtgcgcaaacacaacgggcactgcggaaggcgcacattgtcggcaccggcagcgacaagtagttcggcgagccgcaccgagaccgccgagcggtgggcgatctcaccgcgaaacactccgggggtgtcctgc

SEQ ID NO: 758 - DNA, 200 bp, Mycobacterium paratuberculosis
aagatccagttaagctcgcgctgcgcgaccgccgtgccgaacaccgacgccacccggtcaatctcggtggccgaaagcccggtccgcagttgcgcgataccgtcacgaaccttggcggcgtgatcgacgtcgggttcgggcttgcacctccgacacaacaggccatcgccgtgccgcggccggtagatcaacttgtccac

SEQ ID NO: 759 - DNA, 200 bp, Mycobacterium paratuberculosis
cgcgccgcagcccgggcattcaccgacagccggctgccaaccctgcatcgaacaggctcggcagatgcgcttcttgagcttgcgcgagtaggtttcggaatcgttgcggccgcactgggcacaccgcggcgctcgaacacgcatggcgccgagttggcgcagacacaggatcagctgctcgatgtcggcggcgcagtcgc

SEQ ID NO: 760 - DNA, 200 bp, Mycobacterium paratuberculosis
tgccgccgggcccggtgagcacgctaccgtcgcgccgcagcgttctagacagcctctgcaactgcgcggccgacaggcccatcccctcgatcgcggtgcggacatcgtcgtggctcaggtgcggctcgatcgcgcccactgcagtgacgatcaccgtcacgaactcgctgcggtttccgcgcatccgccggcctaggaat

SEQ ID NO: 761 - DNA, 200 bp, Mycobacterium paratuberculosis
ccgcgtcgacgatcttggcccggacggggcggtggccaccaagttcccgcgtcctgaccggtttgctgcgctccggtgcgcccgcggccttcttcgccgaggcagctgtggcgggcacgatctcgatcaactcgtccatcgcacacctcaaaatgtccaccagtgccaccagggtgggcaggctcaaccgttccggtttc

SEQ ID NO: 762 - DNA, 200 bp, Mycobacterium paratuberculosis
tcggtcacgagccggtagacctggctggccgacagctgcaccccgcgttcggccagcagtggccgcaacgctgtcgtgttgaacagtccgcgttcggccatcagcctgcgcagatgccagtggtaatcggcggtcattggtgtccctctccaaagctggacacccgccccagcgcgtcggtgagcatcttgttcatgaac

SEQ ID NO: 763 - DNA, 200 bp, Mycobacterium paratuberculosis
tcgccggtgacatgggtatagatgccggtggtactggcgaaccggtgaccggaaatttcctgcaggaaccgtggatccacgccgtcctcggtcatgtggctgatgaacgaatgccgaaaacagtgcggggtgagcttgcgatccaagcccacctcatcccggatgtcgtcgaaggtgccggtcaacgtccgcaccttcac

SEQ ID NO: 764 - DNA, 200 bp, Mycobacterium paratuberculosis
ctgcgagcgccgttcggtcagccacagcgcctgcttctgcccaggctcatacaacggtcgaatgttgttgacatagtccaacagtgcctccgccgcccacggcatcaacgtcggcaccgtccgccgcttgggcggcgaccctcgcgaggccttcccgtaccggacatgcagaaacccacactgccccaactcgggagcgt

SEQ ID NO: 765 - DNA, 200 bp, Mycobacterium paratuberculosis
gcggattgcgatacatgtcggccagatcgagccgacacagctcgctgatccgcaaaccccagccgtacatcaccttgaacatcgtcgtgtcccgataggcggccaacgtgcccttacgccgcgaccggcgagccttctcgacctgcgcgtcggcgcaatcaaggaaatcctgaagctccttgcgggtgaacggccgacgg

SEQ ID NO: 766 - DNA, 200 bp, Mycobacterium paratuberculosis
cccggatcaccctcatagtcgacaagatgcgccgaagtgttccactcgtgacagatctgcgtcggatgatcgccgaaccacagttcacactgcgccggccagtcgtagaagggcgaggtgatgaagctacagaacagccggaccgcgccctgcttctgacggatcgtggacttcgcccgagacagcgaccccaccagatg

SEQ ID NO: 767 - DNA, 200 bp, Mycobacterium paratuberculosis
cgcgctccactcatccatcatccgagcggtccactcccacggatacgccccagaaaactcgatgaactcaccgacgcacgaggcccgcaccttcaccgtgttctccgcacacaaccgcccacccaactgctgcttggcccaccccgacaacatcgcccgcaccatgtcgtcctcgggatgaagatgccgcacacccggcg

SEQ ID NO: 768 - DNA, 200 bp, Mycobacterium paratuberculosis
ccaactccagatgcgccgagccaggcgccggcgactcccgtttcctgcccaccaccccccaccttccaatgcactaaacatgcatcacatgcaatctacgtcagaaacgcccagttcggaagcccccgcccgcattacatgacgtacactccgtgtgtcgaacaccgacatcccatcccgatcacatcatgcatctgatg

SEQ ID NO: 769 - DNA, 200 bp, Mycobacterium paratuberculosis
gtggcgaccggccctccgctgtacaacccgaatcccagcctggccgaccccaacccgcccttgccgtggtggccatggcagatcggtcccgcgccccgggtgccgggcaccgccgaccccgacgacgcgccgccgcctccgccgccgagcccggccccgccgggtccgccgccgagcccggccccgccgggtgcggtcgc

SEQ ID NO: 770 - DNA, 200 bp, Mycobacterium paratuberculosis
cgccggtcgaggtgccgcccccggtggcgcccccgcccccgccgccgccggtgaccatcacccaggttcttccgccgcccccgccaccgccgcccccgccgccggagggcggcggcgccaccgccgcatccaacgggccgcccgatccgcagaccgaggacgaacccgcggtgccgccgcttccgccgggcgcgcccgac

SEQ ID NO: 771 - DNA, 200 bp, Mycobacterium paratuberculosis
ggggtcctgcgggtctgccatgcggccgctcctcgaccttcctctgtcgtcgttccctggctcaccggggtcttcgacccatcatgccaggacgccttccgccgcccgggccgccggtcatcgcccgcgccgggccgcccaccaggcgcccccggcgatcagcgccgccgcggtcgccacgaacggccagaccggcaccg

SEQ ID NO: 772 - DNA, 200 bp, Mycobacterium paratuberculosis
acagtgacaccgcggttagccgccagaggcagtagcgatgcctatccataccccctggggcggtgtggataaacctgtggaaactgtggatagtgtgcggcggtcggcggcgttgcccggccgggcggcgatcgtcggcggcgctagtctggtccggtgatccaggtgtgctctcaatgcggcacccgctggaatgtgcg

SEQ ID NO: 773 - DNA, 200 bp, Mycobacterium paratuberculosis
gctggccgccgcccgctgggggttggacaccctggccgacggcgtggtcgacgaacccaacgcccgcacccgcttcgtcctggtcgggccgcccgcgccgccgccggcccgcaccggcgccgaccggacctcggtggtgctgcgcatcgacaacgcgccgggcgccctgctggccgcgctcgcggagttcggcatccgcg

SEQ ID NO: 774 - DNA, 200 bp, Mycobacterium paratuberculosis
ggcggggcctccggcgcgggcgggggaggcggagggggcgccgcgggcggcggaaccggcgcgggcggggcctcgggtgccgggttggccgggggcggggcgccgttgtcgaccggcggcggcggggcctgcgggggctgggtcaccaccggctgctggccgggcaggtgctggttgttccgcggcatctccggggcggc

SEQ ID NO: 775 - DNA, 200 bp, Mycobacterium paratuberculosis
gcgaggcgggcggtttcgatgacgctgccgcggctcatcgcctgcgacgtcgacggcaccctgttcgacgacgacgacgagcggatcacccctcgcacccgggccgcggtccgcgccgcggtggccggcggcgcgcggttcgtggtggccaccggccgcccgccgcggtggatccgcccggtggtcgacgcgctgggctt

SEQ ID NO: 776 - DNA, 200 bp, Mycobacterium paratuberculosis
cggcgtgggccgggtgctggaacgctggtggctttagcgccgcgacgatgcgcgccgcgtggcggcgcgaggaggagcggggcagtcggctttagcggggcggtcggctttagcgccgggcagcggccttagcgcttcgctacgtcgccgccgggtgggtcggcagcgagaagtgttcggccggaaccgttgggccgctt

SEQ ID NO: 777 - DNA, 200 bp, Mycobacterium paratuberculosis
gcccgaggagatcgccaaggaacaggcccagctgctcagcggggcgacgccggcctcggtcgccgcgcccgcccccgacccgcaggccgagcccgagacccagccggccccgccgccgccgtcggacaccccgattccgccgccgccgacggacccgtcgggtccctccgccaacggcgggcagcccaagccgagcctgg

SEQ ID NO: 778 - DNA, 200 bp, Mycobacterium paratuberculosis
cgttgagacgttacgcgcccaccggcacccgggtgcggattgatcagccgcccatgggccaccagcgatccgtgttgcttgagccgctgggtgcggacgttgacctcgtagccgagcaccccgtcgagctggccgagttgctcgcgcaggtagcggtacaggtcgtcggaatctcggcagatggccacggccatcaggtt

SEQ ID NO: 779 - DNA, 200 bp, Mycobacterium paratuberculosis
tttggatccgcttgtggcgccggcgaaagcaatctgcggatgggccgcgatacgttcgccgaccgtgtgcacgtcgcgaggcgcaaccgtgagccacagcatggcgctgaggcgatggccgagccgttcgggtagtacgtcgacgtcgtagaccagggcgccgcaggcctccagcgccgcgatccgcctgctcacccgcg

SEQ ID NO: 780 - DNA, 200 bp, Mycobacterium paratuberculosis
ccaccgaccaaccggtgcgcgcggccagttgggactgcggagtgcggccgtcgtcggcgagcgccgcgagcagcgggcggtcttcggcggtgggccgggaccggtgagttcccgactccggctgggcccgcgcggccacgatccgctgcgcttgccggtccgagagcgcgctgccgtagcccgtccagggcgcgttcacc

SEQ ID NO: 781 - DNA, 200 bp, Mycobacterium paratuberculosis
gggtcgccgaacgaatgcagcatcagatcgatgctgatgtcggtgaccgcggcggtgcgcggtaggagctgcgtcagcaggtcctcgcgggtgtcgcccagcggcgcacggatgacgcagaccaggtcggtccaccccgccagcacattggcgtgggacacgtcggggcgtcgcaccagcgcgtcggccagccgcgatat

SEQ ID NO: 782 - DNA, 200 bp, Mycobacterium paratuberculosis
gcggtccggcgccgcacggatgcggcacacccagtccgcgtcgccatcggcccaccggttctccagcccgacgacgcgcaccaccccgtcgcggcgcagccggtgataccgccgggcgaccgtctgctcggtggcgcccaccacgctggcgatccggcgaaacgagacccggggagctaactgcagggcgtgcagaatct

SEQ ID NO: 783 - DNA, 200 bp, Mycobacterium paratuberculosis
gtgcgtctaactcgtcggtcatcaggaaaagtatccgcgtggacaggtccaagtgaggatttcaggccaatttggtcgcggcgagcgcaatttcaacgcctccgctgtcagcctggaagctcggcctaaggagcgctcacatgcacatcgaaatcggactgcccagccatatcgcccacgtgcgggggcggctgaccgtc

SEQ ID NO: 784 - DNA, 200 bp, Mycobacterium paratuberculosis
gagtgggcccgccgggccgaacaccgcggctttgccggcctggccgcgatcgaccggctggtgtacccgagcctcgacgcgatgaccgcgctcgcggtggccgcgggcgcgaccaccggcatcgggttgacgttcaacgtgctgctcgctccgctgtaccccgcggtgctgctggccaagcaggtcatcaccctcgcgga

SEQ ID NO: 785 - DNA, 200 bp, Mycobacterium paratuberculosis
ggcgtccggcggccggctgcgcctggggctgggcgtcgggagccgctgcgacgactacaccgccgtcggcgtcgactatcggcggcgcgggcgcattctcgacgagacggcggcgctgctgcgtgccgcgtgtgaggccgaggtggtgaccggcgaccagccgctgtgcccggcgccggtgcggatcccgatcctgttcg

SEQ ID NO: 786 - DNA, 200 bp, Mycobacterium paratuberculosis
gtggacgggcggacgcgacgatccgccgcgccgtgaccgtcggtgacggctggaccgccggggcgctgcgcgattacgccaaccagtcggtgttcgccgagcgggtccgggcggcatgggcggcgcggggccgctccggacggccgtggctgcaggccagcgtcaacttcgccttcggcgatgacgaggccgtcgccgct

SEQ ID NO: 787 - DNA, 200 bp, Mycobacterium paratuberculosis
ggccgcagacacctgcagagctactacggcttcaagcccgactacgccgccctcaacgtcgccgacatgctcaccacgccgcaggaggcggcgcagaccgtgcgcgcctacgccgacctgggcttcgaccgcctcgtgtttcacccctgcgtccccgacaccggacaggtcgaccggctggccaacgcggtgctcggtta

SEQ ID NO: 788 - DNA, 200 bp, Mycobacterium paratuberculosis
atgccggtggcttcgccaccgcccgggacggcaacaagatgaccgccgtcggtgatttcgcaacttcgtaaaacctaacggcgccattccttttgggcagtcacacgtggggcagccattttgagccgtgtggtgagagtatgaaggctcggtcttgggcgtctttgcatgcggtcgtgcctgagttatcgacaccgcag

SEQ ID NO: 789 - DNA, 200 bp, Mycobacterium paratuberculosis
accacgccttcgactgtaatggtgtgaaacggtgcgagagttcggatttggtggttttggatggcgctattgacatagggagttgatgtagcgggctggattcctgtgtcggtaccgacatacgtgtacggatttttgttctcgggcccgatccccggcaggttgttgcccgtacagcctgccgccggtggattgccgaa

SEQ ID NO: 790 - DNA, 200 bp, Mycobacterium paratuberculosis
gccgcatgttatgccatcgggcgtaacgaaatgcatctctttgagcggcaggtggccagggttgggaagggcgatggcatagtcggaagcgtcgaccggcgcatagccgctcatgtctgaaaagccgggcgaatcggcccgagcgatacagccggacgcaagagcactgacaaccgcggtggcggcaacgaggtattccg

SEQ ID NO: 791 - DNA, 200 bp, Mycobacterium paratuberculosis
tcgcatcctggtcctatcggtgggcaggccggcggtccggttcacctcttgcgtgagagggtcggaccgcattgctctgcgctgcaagagaagcggagcccctcgtgtctagaaagcaaagctgcccgacggcttgagcacgaacccgtggtgaccttgggtggtgtccaagcatgcgacgaggtggtcgcttcccaccg

SEQ ID NO: 792 - DNA, 200 bp, Mycobacterium paratuberculosis
cgcatgtggcgttgaaggcactcactttctgccccacgtctaaaagctttccgtgcgagaactgcccgccacacgggtggcccgtcttgttcagcgcgtaggcgggtcccatgcctgccgccgctgctctgcccacgacgcacgaaccgctgtccatcccggggaactcgccattgcatgttatggcttgctctgcccac

SEQ ID NO: 793 - DNA, 200 bp, Mycobacterium paratuberculosis
gctggtatgacttcacccgcctcaaagaaacacgaaatgttgtaaggagtcgaaaagtaagcgaagggcggccctttctcgggtggttcgatgtagctctcgactggtactggtgcgaatgtcccgagatcgggaaacccgggcggttgcgcggcggcgtgttgcggcggtgatgtacaggacatggacaccaaagctga

SEQ ID NO: 794 - DNA, 200 bp, Mycobacterium paratuberculosis
gattagcgctagccatcgcgtggccacattggcgacgttgcacatgtctcctcgatcagggcgtaacggtaaatgttcgtcgcagaggtttgcggattgtgtccggccttctgcgcctccaccagcgaggcggcgacgcgtgtaggtcggcggggtcgtagggcaacaagatgactgcagtcggcgatttcgcggctgcg

SEQ ID NO: 795 - DNA, 200 bp, Mycobacterium paratuberculosis
taactaggcggcgccaagatttttcggcaatcatacgtggggcagccattttgagccgcggggtgacaggatgaatcctcggccttgggcgtccttgcatgcggtcgtgcctaggttgtcgaccccgcagatcacaccgtcgacggtgatggaatgcattgggggcaaggttgggagtggatgtccatagacctgactgt

SEQ ID NO: 796 - DNA, 200 bp, Mycobacterium paratuberculosis
ccaattgtgtagtcggacaccgtgaccggcgcataggcgctcaaatctggaaaactgggcgaaccggcatgtgctgcgcaagcgctgatcgcagctgcgacacatgcggcagtcacacgtggggcagccatttcgagccgtgcggtgacaggatgaagcctcggtcttgggggtctttgcacgcagtggtgccggagtta

SEQ ID NO: 797 - DNA, 200 bp, Mycobacterium paratuberculosis
tcgactccgcagatcacaccattgacagcgatggaatgcattgggggaagagttttgatgggctggccggcgattgaccggaatggctccccctcattcgtctgcttaagcccggtcgtcgttccgatccagttaaccccggtgattccggcatcaggttttgatggcgcggggggtatcgcagggaggttgttcccact

SEQ ID NO: 798 - DNA, 200 bp, Mycobacterium paratuberculosis
gcactgtgcctgatcgggcgtgaaattgcagactacgccgtcgggagtgaggaagtaaaccgttggtaagggcggccgtcccgggttaggagcatcgagtgtgtaatcgctgggactgacggcggtgtagctattcaggtcgggaaatctaggtgtatctgcatgggcactgcaagcgctgatcgctgcgacacatgcgg

SEQ ID NO: 799 - DNA, 200 bp, Mycobacterium paratuberculosis
cagtcacacgtggggcagccattttgagccgtggggtgacaggatgaagcctcggtcttgggggtctttgcatgcggtggtgccggagttgtccactccgcagatcacgccgtcgacggtgatggaatgcattgggggcagcgtctttagctcttggccgttcgtgtcaagcggtgaccctgtgggttgcgggcccgagc

SEQ ID NO: 800 - DNA, 200 bp, Mycobacterium paratuberculosis
cgttgaatcctgacagcacgggttgcccaccaatctctcggaagctcaattcaccgaatcgggtgccgggagccgtcacagtcgcggtggcaagatcccccgccttaccccagccggttccgttccagggttgccagcgatcgcgctgggtgacttcgcttggatcaactcggtacatcgttactccttggctgcggtcg

SEQ ID NO: 801 - DNA, 200 bp, Mycobacterium paratuberculosis
aacgagtcggcggcaatgtagacatagccgtctttgccctggtagccgctaatctgcgtcggccccgccccaggggcgcgccacgacccatcgatcggcttccaaccttgaccaggatcattggtcaccttcacaagccatgaaccgcccgtcgggttcagctggtcggtgcctgcgaccatcatgtaggtggtgccgtc

SEQ ID NO: 802 - DNA, 200 bp, Mycobacterium paratuberculosis
attcatccgaatgctgcccgcagggagcgtgtctttccccgctgcctgcggtggcggtggaaacaagacgttttggccgtctgctccggttagcggtgcgccgaaatggggatgaccttcctcgtcgaaggtaactgggaccgcaaccgatggataatgcgtgccgtcgtatgccttattacccgagaatgaatccccga

SEQ ID NO: 803 - DNA, 200 bp, Mycobacterium paratuberculosis
agatcgcgtagtacttgccgggctggcccggcacctcaacgacctcccccaggtccgccgctccgattccgggaatgcctgggttcgcgcccgtgccggcgacaggaccgaggttccgcactacaccgcgcaacggactttccatccagccgtcgacggctgcgggcggttgataaccgtcggtgtgcagattgcccatc

SEQ ID NO: 804 - DNA, 200 bp, Mycobacterium paratuberculosis
gatttacgcagcgtctccgagtaggcgttccggattgaattcatctccttgacggcatcgcgcacgtcgtccacggcgtcggcgtgtgcgtccttgatcagtcgctccagcttggcccgctccgccgcgggcaggttgagcttcaaatcctctttggccgcgccgatgagtctgtcgaggaacatcagctcccgttccag

SEQ ID NO: 805 - DNA, 200 bp, Mycobacterium paratuberculosis
gggcttggccgccgcacgcggcgaccacgaaggcgccgcggcggccctggacctgttgagcgacaccggcggcgaattccccgagctcgccgccgaacacgcgcagctgtgcgctcgcgcgcgggcgctgtgcgccaccgcgctgtgcgacgacgacctgcacgtgcaatcggttccgttgtgggacaagatacttgagc

SEQ ID NO: 806 - DNA, 200 bp, Mycobacterium paratuberculosis
ttcatcggtgtgctggcgcgccgcccgctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgat

SEQ ID NO: 807 - DNA, 200 bp, Mycobacterium paratuberculosis
ggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgc

SEQ ID NO: 808 - DNA, 200 bp, Mycobacterium paratuberculosis
gggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaa

SEQ ID NO: 809 - DNA, 200 bp, Mycobacterium paratuberculosis
tggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacg

SEQ ID NO: 810 - DNA, 200 bp, Mycobacterium paratuberculosis
caccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcaaagatccggttgggccgatccgaagccgcca

SEQ ID NO: 811 - DNA, 200 bp, Mycobacterium paratuberculosis
accgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaac

SEQ ID NO: 812 - DNA, 200 bp, Mycobacterium paratuberculosis
aagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagca

SEQ ID NO: 813 - DNA, 200 bp, Mycobacterium paratuberculosis
ggggacatggatgaaaccgcggcccgaatcgtgcataccccccacgctcgacgcgagaccgcgagaccgcgagaccgcgaggcagcgaggcagcgagaccgcgagaccgcgagacagcgagacagcgagaccgcgagaccgcgacgaaactagaccgcgaccaccagccgtgacagcccgcgcagcgtcacgttggtctt

SEQ ID NO: 814 - DNA, 200 bp, Mycobacterium paratuberculosis
cggcgcgcagcgcggcggcgtagcgctcgggcagactcactgcggcgctgggcaattcgacgccgggcgcgccgccgccgccgaccgccgcgacgcaatccagcgccaccgcgtcggcgtccgcaggcagcgcggcggccagggactgcgcccgggcccgcagccgcccgacgtcggcgtccaacgcggcggccaccggc

SEQ ID NO: 815 - DNA, 200 bp, Mycobacterium paratuberculosis
accgcccgggcgagcgcggccagcgcgccccggccgcggcgggcccggcgcccggtggccaggtcgaactccacgtcggtggcgccgcccgcggcgacgaccgcgtccagcgccgcccggcccaggttggtgtgcaccaccacgcccgtggcgttgatcaccggccgcaggctcgacgcggtggcgggcagcgtggcgag

SEQ ID NO: 816 - DNA, 200 bp, Mycobacterium paratuberculosis
aggcaatcacgtgcagtgtttgacggcgacgaatgtcaatgctgtttgctcagcattacggtgagatccactatatcgccccgtgttacggggatgttcgcacccggcaccggcccgtccggcaatccgcttccgcgggcggcgtcgactggtagcgtccggcgcaccggcccgacctgggagcgacgatggtggcaacc

SEQ ID NO: 817 - DNA, 200 bp, Mycobacterium paratuberculosis
gaacacgagtggagcaaacccgcggccctggccattcccagggagggctacttcgagctcgaacgcggtcgttacgggccgctgtatccccgcaccccggcctgctacggcttttccatcatcgccaaggtcaaggagggccgcgaggaagccgtccgcgcctacggcaaacagatcgaagaggccatcaaggccgatcc

SEQ ID NO: 818 - DNA, 200 bp, Mycobacterium paratuberculosis
gcacgtgcttgccgcgctgcggctgcactacctgcgctggttgctcttcgacgtcggatcgggactgcacttccagtaccagggcatcttcgacacggacttcgacaagtacaccgaggacgcggtgcagctgttcagtcagaccgggatcaccaccgtcttcacgaacctcgaggggtttcccgaagactggcgggaga

SEQ ID NO: 819 - DNA, 200 bp, Mycobacterium paratuberculosis
acccggacgccttcgtcaagttcgtgcgtgagcaccagtgcccgagctttctggagtacggggagtatccctacgtcaccgccgacgagatcaaaaaggcgttacggctcaaggccgccttccagaccatgctggatcagatgcaatgacgtcggtcagagtctgagatgctcgagctcgacgacatccagcacatcctg

SEQ ID NO: 820 - DNA, 200 bp, Mycobacterium paratuberculosis
ctgacccgaaccccggcgctgaccggacgctacgagtttctctcgttcgacgatgcaaccgccgggcgggcgtggctgtccgccctcgtcgatgtcgtgcagtccgcggcgtcggtacgcgacaccatggacagcgccaagcgatgggtcacgctgggtttcacctggaacggcttgcgggcgctcggggttcccgggga

SEQ ID NO: 821 - DNA, 200 bp, Mycobacterium paratuberculosis
cgcccttgccagctttccggaagagttccgccagggcatggccgcccgggcggacattctcggggacaccggacgcaatcatcccgacaactgggtgggcggattggccggcgcggacctgcacgcgatcgcgattctgttcgcgcgagacgacgccgaacatgcccgcgccaccaacgcccacgacgacctgctgaaaa

SEQ ID NO: 822 - DNA, 200 bp, Mycobacterium paratuberculosis
ggtgccaaggtgtgcgcaggttgtcacacctcgacctgaacgcaacgcctccgttcaactacgcccacgaccacttcggcttccgggatcgcttgtcgcagccggtgatcgaaggatccggcgaggaacccacccccggctcgggcgcgccgctcaaggccggggaattcatcctcggctatcccgatgaagtcggcccg

SEQ ID NO: 823 - DNA, 200 bp, Mycobacterium paratuberculosis
gtggccaatcagcccgagccggaggtgctgtcgcgcaacggaacatatgcggcgtaccgccggctgcgcgaacacgtggccgtcttccgcgactacctccgttccgtggccggcgcggatcggcaggaggagttgttggcggcaaaactcatgggccgctggcgtagcggtgccccgttggtgctcgcccccgacgaaga

SEQ ID NO: 824 - DNA, 200 bp, Mycobacterium paratuberculosis
cgatcccgagttgggcgcagatccgctgcgcaacaacgacttcaactacaaggagatggaccccttcggctacgcatgcccgctgggcgcccacgccagacggctcaacccgcgagacaccgcgcacaacatgaaccggcgccggatgattcgtcgtggggcgacctatggtccggcgcttcccgaaggcgctcccgacg

SEQ ID NO: 825 - DNA, 200 bp, Mycobacterium paratuberculosis
acggcgaggatcgtggcatcgccgcgttcattatctgcgccagcctgatccggcagttcgaattcgcgcagaacgtctggataaacgaccgcactttccacgaactcggcaacgagcacgacccgatctgtggaacccaggacggcacactggatttcaccataccgaagcgaccgattcgccgggtgctcaagggactg

SEQ ID NO: 826 - DNA, 200 bp, Mycobacterium paratuberculosis
cagcgcgacattcagaccctggacaaccgcttctccaccatgaccgaagtgcgcagggcggcctggccccgatacgaggggcccgactgggacgacgcccactttctgcagggcatcgccggcaccttggagcttttccaccgctcgacgcttgcgttccaggagctggccggcgaagcaaccggtcagcaggtggcggt

SEQ ID NO: 827 - DNA, 200 bp, Mycobacterium paratuberculosis
gcaccgacgacatggcccagcggcaggtcgaatacctgcaccacggggatccgctcgtgccgcggcaacaacggttttccgcctacacccgctcgctgatgaaggggctcgacgttcccgtccgcaacaggtggggcctgcatccggcccgggtggccgcgaccggtcagatggcaccgctgacctgctttcgcgacctg

SEQ ID NO: 828 - DNA, 200 bp, Mycobacterium paratuberculosis
ctgctgcggttctggatcggcgaccagttagtcaagaccgctgcgcgcaccaaccatgcagaggtaagaaacaaacgggccttccgcacccgcgaacaggcctaaccactaacccagagtgtcaaggatcaaccgacatagaaatgtcacccatcaaccgactctgaacaggggctccgtttgtctggcgccgagcgtca

SEQ ID NO: 829 - DNA, 200 bp, Mycobacterium paratuberculosis
cccggcgggcggggcgctatgacacgcgacgacgacgatgacgccggcgcagccggggttgaggagcggcgccaatgacacgcgacgacgacgatgacgccggcgcagccgcggttgaggagcggcgccaatgacacgcgttgtcttatccatcggctccaatctgggggaccggctggcgcggctgcagtccgtcgtcg

SEQ ID NO: 830 - DNA, 200 bp, Mycobacterium paratuberculosis
accgacttcccgacgttggcgcgcggggtgctggccgaactcggcgtgccgctgccgccggccgtgccggggtgatcggcgccgcgggcgcgcgcggcgcgccacatgatgctcggccgcaacagccgggtcgcggggtcgacgagcgaggtgaccctgatgaactggttcagcgcgaccgtgtcggtttcggccgcggt

SEQ ID NO: 831 - DNA, 200 bp, Mycobacterium paratuberculosis
cgccggcggccagctgcgcgaggccgtcgccaccgcgcaggcggcggcgcggctcgcccgcgaccgcggccagcccacccacgaactggcctgcatccaagccgcggcgcaatggggggacgccgcgggggcggcgcgcgcccgcgcgctggccgacgcgctgtcgctgccgctggccgacgccatcgcctgccacgccg

SEQ ID NO: 832 - DNA, 200 bp, Mycobacterium paratuberculosis
aggcgctgcgggccggcaacggcgaggccctgctgacggtcgcggcggcctaccgggcgatcggcgacgcggccgccgccgccgacgcggccgcgcaggcctccgccgcgttcgtcgaggggcagcagcaccagcgcgggcggtatgcggcggccctggccggtgagctggccgaggaatgcggcggcctgtgcacgccg

SEQ ID NO: 833 - DNA, 200 bp, Mycobacterium paratuberculosis
accggcccgccgacatcattgcccgggtacgcgaggcgcgcgcccgccgaacgtgaaactagtttcacgctcggcggcaaaacggcgagaaggccccgcagctacgccgggaccagctcgacgccggagagcacgacggcgttgtcgcgcgaaggcgcgacaacgctggccagaaatcgcccaccctctttccagatgcc

SEQ ID NO: 834 - DNA, 200 bp, Mycobacterium paratuberculosis
ccaccatggacgcgcggccggcgggtgccgacccgctgctggcgccggaggtggtcgaggtactgcgctcgggggagccgacggtgatcctggtgggcggcgacgctacccgccgcgccgggctggccgcggccgcccggatcgccgcggccaccggcgcccgggtgctgtgcgaaaccttccccacccggctggagcgc

SEQ ID NO: 835 - DNA, 200 bp, Mycobacterium paratuberculosis
gcagggcgcgctcgtcggcgacgaggtcgtcgccgagctgggccgggtcggaggccagccgcggctgcgcgccaccgggcgtatccgcgtcggcgggcagcattcgcgacgccggcgccgagggcgcggcggtccgcgtcgcggttgggcgcggcgcggccgacgggtgcgacggcgaacagccggcgagcgcgaccagg

SEQ ID NO: 836 - DNA, 200 bp, Mycobacterium paratuberculosis
gccggcctactcgcggcgttgccgctgtcgctgatcgccgtcgcagccgctgcggtgatgattttctttgtccaccaacgcgattcgacggcaccggcgaccgaacccgcgccgtcggccgcgccgcccaaagcggcggcgcccaaaccgcccgcgccgcggatcgagatggccgacatggcgttcatcgccgcgctgaa

SEQ ID NO: 837 - DNA, 200 bp, Mycobacterium paratuberculosis
gaaggcgaccgatgctgcgagcccctgttcagagtcggttgatgggtgacatttctatgtcggttgatccttgacactctgggttagtggttaggcctgttcgcgggtgcggaaggcccgtttgtttcttacctctgcatggttggtgcgcgcagcggtcttgactaactggtcgccgatccagaaccgcagcagctcac

SEQ ID NO: 838 - DNA, 200 bp, Mycobacterium paratuberculosis
cgtcgacgtggacatcgcagcgggccccggcgtagtgggctcccacgcagacctgctgccaggccacactgaccaccccgttggtcgttacccggcggctgacccagtcctggccgtctcggtcgatgctggcgggtacgtcgtcgccagggctcaccggcgaggcggtggcggtgaaccgttcggctggggtggtcatg

SEQ ID NO: 839 - DNA, 200 bp, Mycobacterium paratuberculosis
ctttggcgctggtgccatcggccagcgggaaaccccccaccacatccatctgccacagctccatcggggcgccgcgttcccaacgtttccacttgcgcgaacgccgatcccgcaaagccggatcgatcatgcccgcccgcaccaaggcccgatacaccgccgactccgacggcaccggacccacccgacgcttagccagc

SEQ ID NO: 840 - DNA, 200 bp, Mycobacterium paratuberculosis
acaccgtggtcgggtcggcgtcggggcccatcgccgaggtgatccggcggtggatctccaccccgatccggtcgcgcgccgcgcgcaccgcgggatcggcgccgccgctgagcaatgccgtcgtgcaggccgcgctcacctccggctcgtcggcgaccaccagggccaggtgccgcagcacctgttcgacccgggtcggc

SEQ ID NO: 841 - DNA, 200 bp, Mycobacterium paratuberculosis
tgccgatgggtgtgttcggtgccgtcggtgtgtgttcggtgccgtcggtgtgcgcgtgggcgtgctcgtgctcgacgtggtcgtgctcgtgcgtggtgtgcgcgtgcgcgtgcgtcacgccgccgtgctgatgttcgtgcgtgtgcggcgcgtcgtgggtgtgctgttcgctcatcatgttctccgttgcgtgaaatacc

SEQ ID NO: 842 - DNA, 200 bp, Mycobacterium paratuberculosis
gcccccgaggtgttcgaccagcgcgacgacgacggcgtcgtcgtcctgctcaacccccatcccacggccgagcaggcgcaaggcgcgcggcgcgcggcggcggcttgccccgccctggccatccgcgttgaagaatgacgacacggcgaggaacaacaccatgtcagacaccctgacgagcaccgcgaccgagcagaccg

SEQ ID NO: 843 - DNA, 200 bp, Mycobacterium paratuberculosis
tcggcagcgcgccggccatacacccggcgggctgaccggcgatggccatcgatccctcggacatcctgctcaccgaccgggtcgcggtggtgaccggggcgggggcgggcatcggccgcggcatcgccgccgggctggccgcattcggcgcgcgggtggcgatctgggagcgcgacgcgcaaacctgcacgcgggcagcc

SEQ ID NO: 844 - DNA, 200 bp, Mycobacterium paratuberculosis
atgctcgtcggcttcggaggtttctgcagcggccttcgccgcctgagcctgcgcttcccgccggagccgggcggcacgggcgcgggcgcgcgccgccgcggccagcgcttcggcttcggccgcttcggcctcggcctcctcgagcaacgccttcacgtcctcgtcggaggtggccgaatcgtgcggcggcttcttcgcat

SEQ ID NO: 845 - DNA, 200 bp, Mycobacterium paratuberculosis
tggtttggcggtgtgcccaggctttgtgttcgtcgtagtgggttcggtgtcgtaggcagccgtggaggatgcctacgaggcggttaccgagggcgcgtagcgcttggtggtggaggtcgccggcagcgcgacgccggtcgtagaacaggcgggcgccggggctggtgttcagggcgcagaaggcccattggtcgatcgcg

SEQ ID NO: 846 - DNA, 200 bp, Mycobacterium paratuberculosis
cgggtgtgtctcaaaatgtgttgccagttcggcctcaaggtcggtgatctggcggttcagttcagcgatgatgccgaccgtggcgcgggtggttgcgccgaacgcggcggtgaccgcggcaggggcggcgagctgctcagcgcgtaaagcggtttgaatgtcctgggcgacggtgtcgaggttgcgttgtcgcccagcgg

SEQ ID NO: 847 - DNA, 200 bp, Mycobacterium paratuberculosis
gccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccgccatcgggttgatcgcatacacctggtaatcggccgcggtgagcgc

SEQ ID NO: 848 - DNA, 200 bp, Mycobacterium paratuberculosis
ctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcaggtggacgtcgtgatgatcctccgcccaatcgtcgccgacaaatatca

SEQ ID NO: 849 - DNA, 200 bp, Mycobacterium paratuberculosis
cgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggccatcgcttcagctggcaacgacgctcaccgaccggcggctcggtaaac

SEQ ID NO: 850 - DNA, 200 bp, Mycobacterium paratuberculosis
ctctacatcagtaccgacacgccgccactatttacaccacgccccggcacgttcccccctgggttagtggttaggcctgttcgcgggtgcggaaggcccgtttgtttcttacctctgcatggttggtgcgcgcagcggtcttgactaactggtcgccgatccagaaccgcagcagctcaccgtcgacgtggacatcgcag

SEQ ID NO: 851 - DNA, 200 bp, Mycobacterium paratuberculosis
cgggccccggcgtagtgggctcccacgcagacctgctgccaggccacactgaccaccccgttggtcgttacccggcggctgacccagtcctggccgtctcggtcgatgctggcgggtacgtcgtcgccagggctcaccggcgaggcggtggcggtgaaccgttcggctggggtggtcatgttcagcgattgatgcggacg

SEQ ID NO: 852 - DNA, 200 bp, Mycobacterium paratuberculosis
ggcaacgatgaaaaccaccgtttgcgcgcgcgatcgaatcgtaccgcgggcacacatttacgtcatcgatccttcgaccctcggcggcgcgaaatgacgccgggaggtccgcaccgaggcggccgaggggagccggacgaccggggagcaaatcgcgatgcgctgagtcatttcttcgccggtcccaccgatgacgatcg

SEQ ID NO: 853 - DNA, 200 bp, Mycobacterium paratuberculosis
tgcacggcttcgggccgacttgctcgctcgggctgggcaggtccgcgcgactggctgggagccctaccacgggctctggtctaccggggaagtgatcggtgtggcgttgctgctgggagatcatgctgaactcgccgctctcggcgagaccgtgcagtcagcattggagcgctgggcgttcgacctctggggcctggatg

SEQ ID NO: 854 - DNA, 200 bp, Mycobacterium paratuberculosis
gaggtcaggccgacgttgacgacggctgcgaagaaacccgtgagtggttcctggatgcggcatacgagttcggcggccaggaagcggtgcgcgaacgatccgaggaaccggcggccgaagacatccccatgtcggagttgctcgccgcagagtctggccatgacgttgactttgatcccgaacggctcggcgagctcgcc

SEQ ID NO: 855 - DNA, 200 bp, Mycobacterium paratuberculosis
agcgacgatgcgctgcgtgaacaattgagtcgcgcagcagagtcaccgaccgtccgaagggcgcgacctcgccgttcgtcgtattcagatcccagggacggtgccaaatgagtccggtggccgacggttggtcagtcgatgtccaggggacaaccgttgttgtgactttcccgcccagcgacgagatgggacggcgttca

SEQ ID NO: 856 - DNA, 200 bp, Mycobacterium paratuberculosis
cttaccgtggatgaggcacgtgtgctgtgcgaacagctcggttttgcgcacctactcgcgggacgtaatagggcaacaggggacccggacgttgatgacgtcgatgcggatagagccgctggcagtcggctgattgatgatgccttgcatctcgaacctgttgacgtctccgatgaacatctacggaagttggtggatta

SEQ ID NO: 857 - DNA, 200 bp, Mycobacterium paratuberculosis
ctttcgagcgcgccgccaagcagcccaagtcgccggcgccgacgatgcagcggaagatcaggcttgggtcgacgacatctcgcagttcaacgacgacgatttcgacgcccatcaagatttgcctgcaggtggtttcccgatcgctgatcaagagccgagcgagaagcgtggtgaccgcgtagaagaccaggctgcaccgg

SEQ ID NO: 858 - DNA, 200 bp, Mycobacterium paratuberculosis
cggatgaggacggtatcgccaatgcgtggctcgatgagtgggaggagaagtgacgcaggctggtgaccgacgggtgttggtaaaacctttagtaacgggccacgtagtaaaggttggcggcgacaaagttaattaccgcacgtcgttcgaacgctcaggaggcgacgcggagggccagagcgtcgctcttggtgatgaat

SEQ ID NO: 859 - DNA, 200 bp, Mycobacterium paratuberculosis
atccgaagcggtgtgggggcggtcgagatgaacggtgacaggaatcttcctgaaggctggaaggtctatatccgcggtgggtccgtggaagtgaaagcgccggcgtcgggcgggacttctaccggttatctactgacatcagttgaggcccggcgtctcggtacagagattcttcgggcgttcggccagtgtgacggtga

SEQ ID NO: 860 - DNA, 200 bp, Mycobacterium paratuberculosis
tgccggcctggcggcccgtagcgccggaggcgcggagggccagagggccggcggcgcgagcgtagcgagcgctcttggtagtactcagagttattgcttcaccacatcagcgaccagcggaggcggggtttcggcggttgatccgggggagcggcgccggattcgttggggcgcaagggcgatgctgtggcaggcgtctt

SEQ ID NO: 861 - DNA, 200 bp, Mycobacterium paratuberculosis
cgttgaaggcggtgcgctgctgtggccgggtgttgcataacgatgcggttggcgatcctgatgacggtcagggcgtggtgattaagcgtcgggaggttgatggacggatggtggcgagtctgcatggtctgatgacttgcggttcggtgtgggcatgcccgcgttgctcggcagtcatagcgaataccagggccgccgaa

SEQ ID NO: 862 - DNA, 200 bp, Mycobacterium paratuberculosis
atcggtgcgacagtgagagagtgttatcgtcgtggtggtcgcgtgtatctgttgacgttgacgatgcggcatagccggagagatggtcttgctgacctctgggattcgctttccacggcctggcgttcggtgttcggaactcgtaattggacggggcagaaagaacggatggtgcagcgcaggcgtggcttggcccttct

SEQ ID NO: 863 - DNA, 200 bp, Mycobacterium paratuberculosis
cccggagatcatgggtgatgccgagcgtttcgacatagctggcgtcacccgggttgtggaagcgacttacggcaagccggaacttggtgggcatggctggcaccttcatatccatgccctcgtgttctcagtgaccagcttgtcgagcggtctgattgagggcattgagcggactctgggccgcggagttaatcatgatt

SEQ ID NO: 864 - DNA, 200 bp, Mycobacterium paratuberculosis
ggttggcgcgcaacgtctttgctgctcgaatacatcagcgctggtcgcagggattggccaaggctggctgtcagatgccggggtcggtcgccgttgatgtccgagagattgacgacgagggcgctgaatacgttggccgatacctgtccaaggctacatatgatgtcgcggcacgcataggtcttgaggtgggagctggc

SEQ ID NO: 865 - DNA, 200 bp, Mycobacterium paratuberculosis
gtttcaacgaaagacgctcgggcagaacgtaatcagactccgttcgaagtgcttgcgaatctcgctgagtcggtggatgctcgcgggttcggaattcggaccccgcgtcattgggctgttctccctgcaggaaacggagattgggctgtaatcgacagtgatacaggcgaagtcgcgagcatcacggcgcctggacagtg

SEQ ID NO: 866 - DNA, 200 bp, Mycobacterium paratuberculosis
gaaggtatggcatgagtgggagcaagcgtcgtgtggtcgtcgtcagattacttggtctcgtcgacggtcaaaccctgaatcgggccgcgagatgctgtggaatgacttgttggatagtcgtggacggtcagcagaagcatcggacgaagaaattgcggtcgatgaggtcgatgccgagtcggtcggcgttattagtcgac

SEQ ID NO: 867 - DNA, 200 bp, Mycobacterium paratuberculosis
aggtttggtaccaggtgtttgcctggcgtccagggttgattgtggatcttctggaggcggccgagcggtgtggtgtggcggctgttggtgtgttatcgcaatctgctggttgtgacgtcgccgggtggccaccaggcgggtagcaccaacatttacgcggcagaaatgtgttccaaccttgaccccctacggattgtcgg

SEQ ID NO: 868 - DNA, 200 bp, Mycobacterium paratuberculosis
tggctcgtgcgagcctatgtatcgataactttgaggaggatgggatgtcgtatgttgtgcgccgaattactctggacgagttatctgctcctcgcccaacgaagcggatatcggttggttgggccgatgggctacttaacggcggtatgcccgcacggaagttcgcgatgatctacggacaacctggtgtcggaaagtcc

SEQ ID NO: 869 - DNA, 200 bp, Mycobacterium paratuberculosis
acgctaaccgtcgagttcgcttgtgccgctgctaaaatggttactacggtttacgcggcttcaccggatgagcatgacccgcccgacgtgcgtagtcctggcgatattgtgcggctggcccaccgaatcgatgccccgctcgcgggggtgtatgtggtgaccgtggatacgattgacgacgccatcgcggcggcaaccga

SEQ ID NO: 870 - DNA, 200 bp, Mycobacterium paratuberculosis
ggtgggtgcgcggatgttggtcgtagattctgtgaatgcgtgtgcggatttcgatgctcggcggatgaaggcgggcatgcggaagttgcgggcgtggtgtagggataacgacgccgcagcgatgggtgtgggtatgtacgacacagcgggtcggcgggccgggggctacagcgttgcctatggcgctgacgcaatcctgg

SEQ ID NO: 871 - DNA, 200 bp, Mycobacterium paratuberculosis
accttgacgttgaacaaactccagagcgtgacaagctcgctgagttacttgtagatgaggagatcccaaccgaggacttgtcgctgcgacggctgaccctctggaaatgccgatttggcccagtaggtcagcaggtgttgcggatgaccggcggtgggctcgtaccgcacgaacggccaattgactcggggctccgccgc

SEQ ID NO: 872 - DNA, 200 bp, Mycobacterium paratuberculosis
ctcgttgaccaatcggaagagcacaacgctatcgcggaggtcaaggacgatgatccgccaacgcggtagtaatccgggtggtattcatcggccctgcgtaggtaggttaggtccatagtcggcacaattgctggtaaccgggagtttcgctgagttctcgataggcggctgagttatagcgccatgccgtgaatgctggg

SEQ ID NO: 873 - DNA, 200 bp, Mycobacterium paratuberculosis
tgggtatgtagctgaagtagccattttctaagggccgcggtgtccgtatgcgatgtgaagtagtgcagcgcatcgctgtagtggctgggaatggcaggggtgccaccgtgcgcagcgcgccgagcgccggctcgatgctcacgaaggcattcttggacaaacggccacaccattgcgggcacggggtgttcttgcccctg

SEQ ID NO: 874 - DNA, 200 bp, Mycobacterium paratuberculosis
ctgccagatagcaacgcttgcctcggcctctttgcggtgtgtcagctcccataaggcgacggcgtattgttcgatgagttcgtcgcagagatcgcctatctgggttcgtagctgtgaatttagtttggggctcatgtattggaccgcggatatcagtaggtcagttgtactggattcgcatattagtgcgtgagctgaca

SEQ ID NO: 875 - DNA, 200 bp, Mycobacterium paratuberculosis
ggcgccaatgaactcgctgcagctggacaagcgttttgtcggatatgggggtggtgagagccgctgtcaactgattggtgctgtgatgttttacgaccccgcggtgcccggacggcggttctccgcgccgctccgcccgccattgccggccggtaatgcaaggtatctctccctgaagctgcgcgatagcaacgcggtca

SEQ ID NO: 876 - DNA, 200 bp, Mycobacterium paratuberculosis
tcggtgaaggtaggtccaatcggcactgcctccggtcgtacgagcaaataccgccacccaaacgtatcctttgcggtacaaagcggaatggtcagggtattcccccgtgtcctcgaacacccgcatcacgccggcgatgtctggccgccagtaccaccccgctctcatagtcgaggttctagcatttagcaccgacaaat

SEQ ID NO: 877 - DNA, 200 bp, Mycobacterium paratuberculosis
acccgaagaggatcaagtggcaacctggccgcattggcggtcttgggttggccggtgcttatgagtaatcgcgcgcgccgaggctgtgcgggtgggggcaccggtgccgcgagggctataccctttgtgggctcaacctgcaacgggtaaggtggtggaatgagtgagatgatccgcactgacagccgcggtcgcgtcac

SEQ ID NO: 878 - DNA, 200 bp, Mycobacterium paratuberculosis
gctggctggccacccggactcggcctatctgctccgcgaggaaccgggcggggtgctggtgctggaaccggccgtggtcatgtcggcggcccaggcgagctatctggcgctcccggttgccgaccgtgcgcgtatcgaggagttcgtcgacgacccgtccactgctgtgaaacgcacgtataagcggcgccggtaagtgg

SEQ ID NO: 879 - DNA, 200 bp, Mycobacterium paratuberculosis
gcatcgagtacgcacccgaagctgctgcgcagctcgatgcactggagcaatctgccgacgatcagacctgggacgcgatctgcgacgtgctcgaactgatcgaccagaccccggacagtgcccaggcccggcgcgaagaaatcacgggatcgaacggctcgaagatgtggaaggtgcccgtgcggtccttatccgtcgac

SEQ ID NO: 880 - DNA, 200 bp, Mycobacterium paratuberculosis
gatctcgccgtgttgtggagccgcggctcggctggtgactatgtggtgttcgtcggcgtgatgccgatcgcgaggtaggggcgcacccaaccgaccagtgacgtagtgcgctggacacggcgcaagccgaggtcacagacgctgacattcgcgatcgaagccaggtgccgggagtgccactacaaggcgacggagcgtgc

SEQ ID NO: 881 - DNA, 200 bp, Mycobacterium paratuberculosis
aaaggtcactacatatccggccgaacgcgtcgctgatcagcttcggccaacgccgcctgcagtgccgtcaaaattcggcgggttgtggatcctcgctgtggtttcggcgtccaactcgtcgacaccggcgattagcccttcagcaaagtgctcccggagcgcggcggtctgccaatcgtcgtcgacagcgccgtgcatcc

SEQ ID NO: 882 - DNA, 200 bp, Mycobacterium paratuberculosis
tgttgatcagcgtcgaggtacgggaagtgcgagagcaagatgtagtgcccggctaacttgcggcgcgctgactgctgaacagaagcaaatgtctgtaggtacgccgggagcaatttatgcgcatcgacgtgcatcggatggacaccatcgtgattgcccgccaccaagtgcttggtccccgggcggtccgcaagccatgc

SEQ ID NO: 883 - DNA, 200 bp, Mycobacterium paratuberculosis
gagcgcacgcagctgactggaccgtccgccgcccgagatgtcaccgagaacccacacgacatcgttgtcgcctacgagtcggtcccatcgttcagcgatctcggcgtcgtggtcggtcgtctcggcaaacccgcggagattggctacgagccgatgaccgatgtggaggtctgaggtataccaagtttcggttctgagcg

SEQ ID NO: 884 - DNA, 200 bp, Mycobacterium paratuberculosis
tcattttcaggtctacgagatcacgtgggtcagccgacgtgattcacggtgaatcaccgcgtatgcctcgtgggtcggtggctgtccagtaaggatcggtccaagcgcggcgttctggagacagtgcgagcgttgtccgacctggtgcaagttggaggatggcaaagctctcgtcgattgactgccgaagtgcttccgtt

SEQ ID NO: 885 - DNA, 200 bp, Mycobacterium paratuberculosis
gcgtcagcgtagtcagcgagccggccgagtagcgccttgcagtcggtcacccattcgtctttcaaccgatgggtctgggttcggccgagacgggcggcgcgcttgtagattgttcgtggcgttcgatttgtaccgccggaggagtggatatcggtgactccgcaaccggctagagccagcgcggagtccatcacttcggt

SEQ ID NO: 886 - DNA, 200 bp, Mycobacterium paratuberculosis
ggcgcgggtaagcatgcggccacgggattctgtcagagcaaggagcttgccaaagttggctcgcagaacttcgatcactgaatcatgttccgacacaagttttatcaaggacctagagcccaagaccgaagacgatgccgcgcgtacgattcgatcgttgagttgtgcaaggcgttcgcactcaaccttttgagttccac

SEQ ID NO: 887 - DNA, 200 bp, Mycobacterium paratuberculosis
aaagtgcgccgattgcactccggttggcgtcgaggtcggctcggagagaacgcaattgaagcgtggccttttccgcgaacctggccgcgggcgacatcgccaacacggcgagggcgtcttggcggatgtcgtctctggggtcgtagtaagcgcgcaccgcgtcgcggcggatctgcggtagatagagcttcgcctttgtg

SEQ ID NO: 888 - DNA, 200 bp, Mycobacterium paratuberculosis
agcgcggttcccgtcagcgcggacacatgtagaagatcgctgactgttgcgccggcctggaacgctttggcgacgatatcgggcggcagcgcaggcagcacctgggatatgcggacttccagatgatctgtcatagggtgagtgtaggtcgcagcgccgacacggccaacagatttagtcctctacctggggctttgaat

SEQ ID NO: 889 - DNA, 200 bp, Mycobacterium paratuberculosis
acgtaggcacgccgctggcacgctgtccgctcatcgataactatgggtacatgagcacgttcgaccgtaccgggtgcgccatcatatttgggtgtcagttcagcggaggtcatcagtgcacctatcaggaaactggtgtggccgcagcggacgtacgccgattggtgctcccagttggcctcgggtttcttcgaggtggt

SEQ ID NO: 890 - DNA, 200 bp, Mycobacterium paratuberculosis
cgatgatgtctctcgatcgaccttgggattgcgaaattcccgacttccaccttccgctgctctcccgtgtacgagtttcgatgacccgagcccggttcgagctccgtacgagggtcagtattccgctctggcaagtgctccttgtggtgatcgtcgttgcccttgtcctcggcctgcttattgggctggtgaccgtcgac

SEQ ID NO: 891 - DNA, 200 bp, Mycobacterium paratuberculosis
caggtgtacggctgaggcgttgggacgagatatggcggcgaagcaacaagagattcgacttgtccatgagcgctacggtgtggtgggcgcggtggggggaggctggcgatgcgcttcgtaaacggcaaaccgatctggagtccggtaaccgaggagctgcggagcgcggagttacctcttcgattgtggctgtctgcgaa

SEQ ID NO: 892 - DNA, 200 bp, Mycobacterium paratuberculosis
tcgccgtgacggcactccgcggtacagcctagactcgcggactctttatcaaattgtgacgtacgggctactggggcagaacgcattcgggctgaatgaggtagcgatcttcgatgcccgctattctcatcttcaacgatggtcgatatcggagctcctctgctcacttgcgggcgagagagtgtacgtcgctgagctgt

SEQ ID NO: 893 - DNA, 200 bp, Mycobacterium paratuberculosis
cgatggaactggatacgtttctacgtgacccgtgcgggtcacgggtacccaaccttgcgcgtgaggcagctatgaggatcagcgccgaaggtgaactgcctgcgtctcggcgccgtcgtgatcggtttacgaggaagccaccggcgaagacaccaccatcaccgtcgaaggcaaatctgtggcgcgcctgaggccccgtc

SEQ ID NO: 894 - DNA, 200 bp, Mycobacterium paratuberculosis
agcctccacgccgccggtggatccgccgcgacgagttgctcagccgactcgaaggtgcccaagccgacaccggtctgcgccacgaccttaatgcgctcgccggcgacaccacggacgacctcgggcccatcaaataattcgcatttgtgaggacattcggtcggtcgcggaaacctgccaccgcaaggtttatgttcggt

SEQ ID NO: 895 - DNA, 200 bp, Mycobacterium paratuberculosis
cgactgttgatcgctaagcctgtggtctgtttagctgcatagcaacatgtttcgccaatcgggcgcttacgactatcgacggttcgatgtatccgacattcgaattcccgttcttacgtgcggttttgaacgagccgaagagaagctatgccaccggttcctactcggtgatgattgttgcatgaccgaagttgcgcgcc

SEQ ID NO: 896 - DNA, 200 bp, Mycobacterium paratuberculosis
gtgagactctcatctcccatggggatctctacgatccgaaacccgttaacgagatccaacccaccggatttgcgccgtgggatctcgccctgggagggcatcgttcgtgtgggaggccctcgatcactggacatggctttgatgactgtcgcggcccatccgaatacccacaacgatgttctcatcgtgggtgcaggtag

SEQ ID NO: 897 - DNA, 200 bp, Mycobacterium paratuberculosis
atcgcggcatgtgttggcgcgctttgctttgcgtgcgggactcgtggatccgaagctgttggtgacgaatgattgcgaggcggtgacgcaatcggtaagggtcaacagctggcgctatgtggtcatcgactgcgcagaactgatgtctgcgtcgcatgactccatggccaagttggaccaggcttgttgcgacagtggca

SEQ ID NO: 898 - DNA, 200 bp, Mycobacterium paratuberculosis
caacgctattcgcttgtgatggacctgctgaatctcgtgcgtactcggtcgacagactgacgtggagctgcgcggtccaatcgctgcgtctcgtcgaggagatgccgagccacgcaaatggagtcttcgagttgcgcgtggtggacaacgtgccggctcccgacatcgtatcgaactcggttgtaagggtgctcataccg

SEQ ID NO: 899 - DNA, 200 bp, Mycobacterium paratuberculosis
gcgaatggccgtattggactggctgattcgggcgacgacgaggaggggccactgatccttgaactacgccagtagtggcaatcaaaagcactgttacgaaagaacgaattgaggaaatcaaatggctgacatcgcgagactgacgctgaacgtggatccagcatctgtccttctcttgggtaccggtggcacttcccgga

SEQ ID NO: 900 - DNA, 200 bp, Mycobacterium paratuberculosis
caagggcggcatacgagaatggagtgaagaccgaagctaacgtccagcgtggcggtgtggatgttcaccggttgaccggagtcgccgtatcggtgagcggaactgggctcgacggagcggtcgtggagacgtcgaccccacttgagaatgttcctgccggcgcgattttccgcgcagaaggagctgccgaagtatcggta

SEQ ID NO: 901 - DNA, 200 bp, Mycobacterium paratuberculosis
cgcgccgagggccggcaaggattcggtgggggtagtccgcgaggtgtgcttgccgtgacggtattcgtcgagcggctggttccaatcggaaacgcgaatgatgtagtgcgctcatcgcctcagaggcgcccggcggcgggtgagtaaccgtgcgcggccagtatggatatacatcgccggcgttgaccgcggtgagatgc

SEQ ID NO: 902 - DNA, 200 bp, Mycobacterium paratuberculosis
ctctccgatgctcgatggacaagaagcatgttggagctcgttgggttgagtcgagcgcttccgacgaagcgttcagcttggtcgttgctggctgagggcgccgtgaggaatcgtgtgccgacgcggatgacatacctaaagtcgtatgtgccgacgttgatctcggtggctccggcaccgtacggagcgaatgcgcgatt

SEQ ID NO: 903 - DNA, 200 bp, Mycobacterium paratuberculosis
ggtgacgaaggagaggaaagctatcggggccgagatccatgcctcggttaactacttggtgaggaaagggcgatcggcgggagtcgtatcgatcttgtcgacgcaaaagccgacggccgattcgttgcccacggacatcagagataacgcgtcgttgagagtgtgcttcggtgtccaatctacatatgcggcaacggcag

SEQ ID NO: 904 - DNA, 200 bp, Mycobacterium paratuberculosis
tccttggagacgggtggcgaagtgacacggatgtgtcgccgctcgggatgtcgtcgggcgtcggagtctcatttatcggcggccactttcggcggttccgggctcccttcgttcgagagcgcgtaattgcgacccattcgtggcgttggtcatccctgaatcgtgacccatgggaactccttcgaccggaattggcagat

SEQ ID NO: 905 - DNA, 200 bp, Mycobacterium paratuberculosis
ggtcatgttcgcgattcctagggaaagcggtctattccgccgtatatctgtcggtccgacatcctcagcggcgcgcttgcggattggcggtcataactgttgcaacggcactcgggcacaagccgccggctggcggcgcgtgagcacagggatacgtgagaggggtcgatggtgacggtcgaggacttgggtcgccgtgc

SEQ ID NO: 906 - DNA, 200 bp, Mycobacterium paratuberculosis
tgggcgacagcctctactcctgaacatcgaggaactggcggatcgactgacggtaagcgtcggctgcattcggtcctggcggttgaagggggagggtccgccagcgatccgggtcgggacggcgcttcgttgggacgctgtcgaagtggatgcatggctggacgcacgacgggaatcacgattggaagcaggatgatcga

SEQ ID NO: 907 - DNA, 200 bp, Mycobacterium paratuberculosis
gccacgtgtcggaccgcacggtacccgcgtgtatcgggctcgtgtctactaccgcggtcgctacgtcgcatctcggacgttttcccgcaaacgcgatgcacaggagtgggaacgtaagcaggtcgagacactgaagaccggcgcgtgggccgatcccaaggcaggtgaacgtccggtccgcgaatggtgtgagatgtggc

SEQ ID NO: 908 - DNA, 200 bp, Mycobacterium paratuberculosis
tgtcggctcaacccgtcagagcaccggcgacggagcggaagatccgcggcgttatcggaaagcagatcgccggcacattcggccggcgccctctggtctctgtccgcccgtccgaggtccaggcgtgggccgctgagatttctcgaaagcagtcggcggcgacggcccgccactcgctgggggtactgcgccgagtcttt

SEQ ID NO: 909 - DNA, 200 bp, Mycobacterium paratuberculosis
gaacatgcggtccgcgatggggccatccaccgcaacccggccgcaggcatccgcttgccgaaggtgcaaggcaacgatccgcgcccgctcactcacgacgaactgtggcgactggctgaccacatgaaccaattgcgtgaccgactcttgatcgtcgtagccggatactgcggtctacgctggggcgaacttgctgcgct

SEQ ID NO: 910 - DNA, 200 bp, Mycobacterium paratuberculosis
acgggacgaaacggagtatcttctgagctcgcctgagaatgcacgtcgactcctggaagccctgggccgagacaaagcaatccatccggcaccatcggataccacagaagcaccgaccacacaccgaccagagaggagtgacgagcagtagggcaagcgcccggaaaccctcgctgacctgcaaaaatggtgagtgcccc

SEQ ID NO: 911 - DNA, 200 bp, Mycobacterium paratuberculosis
ccgccgacgccgcctcggtgaagcccggcgcctttcggtcgagagcggactgcagcacggtcatgtccaccaccgacgatgcagagcgaagcgatgaggaggaggaggtgaaatcatgattggaatcccagcagtttggcggacaatgcgatcaggatttcggtggtgccgccgccgatgcccaggatcctcatgtcccg

SEQ ID NO: 912 - DNA, 200 bp, Mycobacterium paratuberculosis
aggagggctccggcatcatcctgtcgaccgacgggctgatcctgaccaacaaccacgtcgtcgcggccgcggcgggaccgcccaagggtcccgcggcgcccccggtggtcccgctgccgcccggcggcccgggcggtggtcccggcgccggcaccccgaagacgacggtcaccttctccgacggccgcaccgcgccgttc

SEQ ID NO: 913 - DNA, 200 bp, Mycobacterium paratuberculosis
gcgcgactcgttcgcatcgagtaggtcaggggttcgaatccccttagctccacagagtttgagcagctagagggtagttccggagatagccgagggcggcttccgacctctgggtccgcagtcggcacgcagcagatcgaattgccgcatctgattgtcggccacgggacctaagtccaaatggacgggttgcgtgggca

SEQ ID NO: 914 - DNA, 200 bp, Mycobacterium paratuberculosis
gcaaaatgaagagggctgtgtattgcgtaattcgtaggccgggcgtcgcctgcgaaagtgggcggcatgcctgcgcaagcatgggtaacgctgatcgtcggcggcgtcgccacgattggcgtccttgtcacatggcagcaaaagagccgcgccgaccggcgcagcgagtggtggcgacgcaccatgtgggcgtttgagcg

SEQ ID NO: 915 - DNA, 200 bp, Mycobacterium paratuberculosis
gccgtcgtcttgggcacggcatgctcccaggtgcgctggcacgagccgcctatcaccagcaggtccccgtgcgcctgcggcagccgcagcgacgggccgccgccgcggcgccgcagcgcgaacgcgcgggtggcgcccaggctgacgatcgccaccatggtgtcctcggaactgctgcggccgatggtgtcgccatgcca

SEQ ID NO: 916 - DNA, 200 bp, Mycobacterium paratuberculosis
gggcggacacctgggccgctggtacatggcccacgtcgaaggacgggtcgcgcgggtgcaattcagcaccgaccgggtgatccacggatatgaacgcgacggcgacggcgtgtatgtgcggcgccgcttcaccttcgacccgggcctgctgcgcgaagccggaatgtccaatgccgcaatatggttggtgaatcccccga

SEQ ID NO: 917 - DNA, 200 bp, Mycobacterium paratuberculosis
tcagcgacccgagtcatggcagcggcatcctgtccggggtgtatctgacgctgatctccccgctcggccggttcttgctggcggcagcgatccgcgaggcgcacaccaagacggacggcccgccgcggatactggcgcatctgcgcaacattgcggcggatctgcccggctcgatcgggttcgcggtcgcgttctgctac

SEQ ID NO: 918 - DNA, 200 bp, Mycobacterium paratuberculosis
gcccggttcgtccggcggggcaggaaggcgccgggcttcttcgtgcgcagcgccgacaaccggtacctgctgcagtaccacggcgagcatcttccgcactgggagagccgggtcgaactgtcggacgaacgagatagcttgggcatgaagcggattcgcacccgcatgcatttctccgacgccgactacgccagcgtgcg

SEQ ID NO: 919 - DNA, 200 bp, Mycobacterium paratuberculosis
cacggcgatcggtgtaatcgacgaacacctgcgccgccacggggcgggacgggtggagtggttgaccgacgacgtcgaggcctcggtgcgcggctacatgcggcggcgggccggtttccaccaggccggaaccacccggatgtcggcgtcgccgaaagacggtgtggtggatccccagctgcaggtgcacggggtgcgtg

SEQ ID NO: 920 - DNA, 200 bp, Mycobacterium paratuberculosis
ccccgctggacgcgccgaacacgatcgactggatctgcggctggcggcagacgtactcgatggccgcacgcggctcgatcgcgccggacgccagcacggacatcgcgatcagccggcagcggcgctcgcggatcgtcttctcgtacagctcgattccgccgcacatccggaagccgatcttgttgaaattggcgcacacg

SEQ ID NO: 921 - DNA, 200 bp, Mycobacterium paratuberculosis
atcgggttttcgatcccttgcccgtcgagggcgtcgagcagccgcggcaggttcatcgtgatgaagcccggctcggcgccgtacttgagccggacgtggtcggagaagaagcggaacgcgtcgtgcatgccgagcccgagcagcaggtcggtgaccacgttctggatgaagatgaccggcgtggacaacccggcgaacat

SEQ ID NO: 922 - DNA, 200 bp, Mycobacterium paratuberculosis
cttcatctcggcgtccaccaacagctgcatgatcggctcgatgtccttgccggcgagggcgacaccgcccttgaacatcgaccggaccgccccgtcgtcgggcaggaaccggcgcagcgcgtcgagcatgccgaactcggtcacggcgttggcgtacttgtgcgcatacggcatgcacgggtagaagacgtaatcggggt

SEQ ID NO: 923 - DNA, 200 bp, Mycobacterium paratuberculosis
agcgggaacggttggcgcggaagtgatcgcagatctcgccgacccggtcgtgggtggtgcagacgaaggtgcggatgccttcccggtaggcggcgtcgagcgtgtccagcaccggcccgaggtgctggaaccggatcgcctgggcgcgcgccttctcctcggacatgtggttgaccccgaagaactggttgtcgccgaac

SEQ ID NO: 924 - DNA, 200 bp, Mycobacterium paratuberculosis
agcacccggtccatgctcacgacgccctcatggccgcgagttttttgatgcgcgcggcgatctcgcgccgaaacgcgccgcgcggcgacccgttgaccgcggggagggccggcgacgcggggcgcccggccagggcggcgccggtgatcatcgccacgacacggtcgacggcgagcgcggagcggaacgtgttctcgccg

SEQ ID NO: 925 - DNA, 200 bp, Mycobacterium paratuberculosis
tcgcggcggttgttcttgacgctctgggcgaaatagtcgatctgcgccgaatactcttcgccccgaaggtaataccagacctcgtcggtgagctcggtggtgtagcggatcgtccagcccggccccaactcggggagcccggggtgcgtttcgcgaaggtagatctggcactcctggcgatcggcgacgaggcggccgtt

SEQ ID NO: 926 - DNA, 200 bp, Mycobacterium paratuberculosis
ggtcccccacaccgagattttcgtcgacatcttgcggaagctctcgtcgctccagttgacgcacaactggccgctggcgccgttgtcgtagcgcagcgtgcagtagacctcgtcgtcgacgtcgcgggagaagacgctgtgccgcaccaccccgtcgaccgaatgcggcacaccggcgatgaagttcatcaaatcgatgg

SEQ ID NO: 927 - DNA, 200 bp, Mycobacterium paratuberculosis
cgtggcaggcatagtcgtagagggcaccgccgccttcctccttcacgccgcgccaggtgctgcctttcgggcgtagcacgacgggcccgtaagcctcggcgcgcacgtggtgcacctgcccgagcccgccggacgcgacgatgcgtgccgcctcccggaaggcgccgatgaagcggcagtggtagccgacctgggtgacg

SEQ ID NO: 928 - DNA, 200 bp, Mycobacterium paratuberculosis
agccgattggtctccgccaacgtcaccaggcgctcgccgtcgcggacatcgagcacgaacggtttctcgcagaagacgtgtaaccctcgggcaagggccttttcgaccatcggtgcgtgcagccgcgacggcacggccacgacaaccgcctgggcccgcgtgtgcgtcagcatccggtcgaggtcgtcgtagcagtccag

SEQ ID NO: 929 - DNA, 200 bp, Mycobacterium paratuberculosis
acccgtgtatttgcccaggatgtcgcgcagatagcccgcggagtcacacaccccgaccacgtcgaggtccgggtgggtgcgcaggatcgccaggtgcgaaagacccatttttcccaggccgaccacggccgttcgaatcatgctccgcgccttcactcgcttccactgccgcatcggcaacgggtacggcccgccaacac

SEQ ID NO: 930 - DNA, 200 bp, Mycobacterium paratuberculosis
cgtggacgttagcaccgcgggcggatcgtcaacgcgaaatccggtcgatctcttcgtcgtcggtaatccccgaacgtgggcgggcgcgggagttagtcttttcaaggcgatctcggccccgccggccgcgcggtggcatcggatcgtcgcggcgcagccggcgggccggcgcgagcgcctcaggtgaggggagacatggg

SEQ ID NO: 931 - DNA, 200 bp, Mycobacterium paratuberculosis
tcgcgctgcggctgttgacccgccaccggccggccatgatcctgaccaccggttccggtgtggcggcgccctttatctggctggcctggctgctgcggatccccgccgtgttcgtcgagtccgtcacccgcatcaccgagctgtcgctgaccgcgcggatggtcaagccgttcgcctcccacctcctggtgcagtggccc

SEQ ID NO: 932 - DNA, 200 bp, Mycobacterium paratuberculosis
gattgcacaccgctttgtgaggcgcgccggtaatgggcgatcgatcccttggcggcggccagggtggggatcacgtcggcgtagcggaagctgccgttgcgccagcgggtgtgtttgggcagggttttcacgtcgagcggcccgtcgccgatcagcaccaggttgtcgccgcgccagccgccgccgaccacatgccgttg

SEQ ID NO: 933 - DNA, 200 bp, Mycobacterium paratuberculosis
ccaggccgcgagcacgacgtcgacgttcttgtaggggttgagccggccgaacatgacgaaatcccggcgcccctcgggaccgacgaacggcggaacccggtccaggtcgaggtcgctggccagcggcaccacgcgcaccggggtgccggcgacgtcgcggcgcgccgagatggccgccgccacatagtcgctgtaggcga

SEQ ID NO: 934 - DNA, 200 bp, Mycobacterium paratuberculosis
cgcagggtgggcagccaggtggcggccgtgcggaatcgcgggtcgagcaccagctcgtagtcgcgcgcggcgtcggactccgggtgctgatcggaggtgaccagcaggacctcggcgccgtgccgctgcagcgcctcggcctgcacccgcaccgccggccgcgtccacggcgaaagccacagcacccgaggggaattcac

SEQ ID NO: 935 - DNA, 200 bp, Mycobacterium paratuberculosis
aacacggctccgatcgcgtccaggtaggcatcggccatggcctgcaccgtgtagtgcttgcgcatgcgctgctggccgcggcgtcccaccgccggcagcgcgtccgggtcggccatgatccgggccagacattcgcgccacccggacacggtcaccggctcgacgaggaatccggcccgcccgaaatccagcatttccgg

SEQ ID NO: 936 - DNA, 200 bp, Mycobacterium paratuberculosis
gacggcgcagatcgccgacgcggcaacgggcacgccgcgcgccatcgcctccacgatcaccagcgggaacgcttcggagcggctgggcacacacagcaggtcggcgtcggccagtgccgggccgggaccggccgcccagccatgccagcgcacccgatcgcgcagcgccgccggcgtgcccgcttccagccgctgccggt

SEQ ID NO: 937 - DNA, 200 bp, Mycobacterium paratuberculosis
ccggaccgtcaccgaaaatcgagagccgccaaggtatttcggccagcccgcgcaaggcctcgatcagcagatgcgggttcttgtgctcgacgatgcgcgacagcatgaccaggtgcagcggcgcaccgtcggcgcgccgccgcggggccgggtcgccggtgacgaccaccccgttgggcgcgatgaagtggcgcccgcac

SEQ ID NO: 938 - DNA, 200 bp, Mycobacterium paratuberculosis
agccgatgctggtcgagcagcatgtcccaatgccgttgcgccagcacgatgaaaccgtccgccctgcgcatcgcggcggtcagcggccgcgagtagatgggccggtccggctccggcggaacatgcggggcgaccatccagcgccggccgcggccggcggcccgccacagcgtggcgaaccccacctcggtgttggtgtc

SEQ ID NO: 939 - DNA, 200 bp, Mycobacterium paratuberculosis
gccggagatcagcaccgccgggccgtcggcgacgtcgatgatcggcgcccaccacggctggcggatcacccgcaccgtgtccgggatttcggcgatcagcgggccgaaccgctgcacgcagacgatggtgaccgggtagccgcgccggtccaattcggttgccagaagcgctttttgccgctcggctccgccgtagacca

SEQ ID NO: 940 - DNA, 200 bp, Mycobacterium paratuberculosis
ggcggttggtggtgatcacgaccgacggcagctcggtgcgccggcggttcggccgccgcagtcgcccccacgcggcggccccggccaggtacgcatccgcgcggtgcacgccgcgccgatgctcgagcaggagggcggcgttggcgcgcgccaggtcacgattgcgccggtgcgccgcgtcggtgaggcgttgcggcccg

SEQ ID NO: 941 - DNA, 200 bp, Mycobacterium paratuberculosis
gtcgccgtgtgctcgacgccgcgttcgtcgaccgtcaggacacgccagcccgccgcgtgggcccgggcctgccagtcggccgcctcgccgtaaccgaagaactcttcgtcgaaggcgccgagggcgttccaggcggtgcggttgatcgccaggcacggcgggcgtcgcgtcacgaggttctccggcgtgcgacggcgcgc

SEQ ID NO: 942 - DNA, 200 bp, Mycobacterium paratuberculosis
gctcgcctcgggagccatcggcgacacggccgccaccccgggccggcgcagcagctcccgggtccgggtcagcggccccagtagccgggtgccggcgggcagcagcaacaggtcggcgtcgggcggtgcgtgctcggccagcacgttgaaggcgacggcaggggagacgtccagcggacccgaaacacagtgcaccccag

SEQ ID NO: 943 - DNA, 200 bp, Mycobacterium paratuberculosis
ggtatttcgtcgccacctcggcgccgtaggcgtacacgggcaggtcgggcaggtgctcggcgacgctggccaggcacgtattggtgcggtcgcggtcgccgtcggtgacgatcaacagcgccagcggccgctcggccggcagcgcgatggcaccgccggccgagcgcttcaggtatgcccggtctgccttcgacgtcatg

SEQ ID NO: 944 - DNA, 200 bp, Mycobacterium paratuberculosis
ccgccggctgcttctcacgcaacgaggcccgcaacgaggccaggctggaccaggtgatggggccgaacaccgcgctggtggtcaggtaggccacggccgccgcggtcagcaccaggatcacatggtggcccgaaagcagcagcgccacaacgacactcgcaccggtgggaacgagcagccgcagcacgaacgcgaccggg

SEQ ID NO: 945 - DNA, 200 bp, Mycobacterium paratuberculosis
gtgcggtagccgcagtggcggcgcagccaccaggtggagacggccatgttgaacagttccgtgcacaccagcgccacgcccgggccgacggcgccgtaccgccccgccagggcgaggttgagcccgacgttgagcgccagggtcgcgaccgtcaaccacagcagcacccgttggtgatgcgaggccaccaggccctggcc

SEQ ID NO: 946 - DNA, 200 bp, Mycobacterium paratuberculosis
cagggtgccgccgacgaaccgcagggccgccgcgacgaacagcaacgccagcgtgggcgtgccgcgctcgatgaacgcgctcttgccgaacaatccgatcagcggcccggcgagcagcgcgccgaccacggcgaccgggaccgccacgaaggacatcaattccacgctgcggcgcaggaagccggcgaatgcggcgacgt

SEQ ID NO: 947 - DNA, 200 bp, Mycobacterium paratuberculosis
cccgcgcgaacagctcggtggccgtcgacaacgtcgacttgtggaagatcagcgagaccacgatcgtgttgaacgcgatcgtcagggccaggccgtagacgcccacctcggagtgggtgctcagcagggacaggatcacgccgtcggcacggcagtacagcagcccgacgatcagaaaaccgatcagcggcaagctttcc

SEQ ID NO: 948 - DNA, 200 bp, Mycobacterium paratuberculosis
cgcaacaaatcggcggcctcccgcggggcgaacagcggccgcaccgagatgtgccgcatcgcggccgcgccctggatcagcagctgcacggcgggcgggatcagctgggcgacggcgaaccagatcacgttggcgtgcgctgcgaccaggcaggcgaccatggccagggtgcccacccgggcggtgacgtcggagatggc

SEQ ID NO: 949 - DNA, 200 bp, Mycobacterium paratuberculosis
caccgccgagaaccggacggtggcaaggaaaaccggctcgaatcgcgtcgtcatggtctgcagcagcagtccacccgacagcacgaccagcatcacccgcacctcggtgtcgtgatagatcagcaaccccgaccctgccgccagcgccgcgagcggaacgcagtacagcagggccaggccgctgttgatgcggaccaggc

SEQ ID NO: 950 - DNA, 200 bp, Mycobacterium paratuberculosis
gctccaaatcgccgcggccggaagtcacccgtcgcacgatcacggtggcgatacccagatcggcgaagctggtccacatggcgacgaacgccaccgcgatggtgagctggccgtagcgtccgggacccagatagcgtgcggtcatcgccaccgaaaccactgaggccagcatccccagtgcgcggcagatcaactggacc

SEQ ID NO: 951 - DNA, 200 bp, Mycobacterium paratuberculosis
gagaacgcgtgggccatccgggccagcggcaccgagggcacgaccgcggcggctgccgtcggctcactcatgggtggcgagtttaataggcgccgtggctcgtcaagacggctttgacggtcttggcgatgatcatgagatcgcccgccatggaccagttgtcgacgtaggacaggtccagccgcaccgattcttcccag

SEQ ID NO: 952 - DNA, 200 bp, Mycobacterium paratuberculosis
cggggtgacccgcgggtcctggcgcatcttgaacagcaccccggcgccctcgttcaccgacagcagctgctcgagctgggtgtcggcgccgtcggtcatggtccgaaacttcagcatggtgaacggctttccgtctaggccgatccgctcggacgggtagaagacggggcccttgctggtcagcttgatggcgagggcgg

SEQ ID NO: 953 - DNA, 200 bp, Mycobacterium paratuberculosis
ccgcgagcatgaccggcgccgccgcgatcagcgcggccagcgagaacaccatgtcgaaggcctgcttctggaagcgttgcgtcccttcgtattgcggcttttcgacgtgcagcaggggtagcccggcggtgaggcgcagggtcaatcgcgcttcggcgacgtccatcaccccgggcgacactaccaggtcgacgtccatg

SEQ ID NO: 954 - DNA, 200 bp, Mycobacterium paratuberculosis
gtctccagctgccacatcagctcccggattccgtgcacaccgaaatgctcggtgcgggtgaccgcgacggtgtccgcgccggtgctgcagatcgcggccaccgcgtcggtttcgtcaccgagaatcgggacctcgtgcccggcgacggtcaggatctcgccgcggggcgggccgtatccggggatgcagacgccgaccac

SEQ ID NO: 955 - DNA, 200 bp, Mycobacterium paratuberculosis
ggtgcagccgttgcgagggtcgcggaccagttcgtgcgccaggtgggtgacggcctggcggtcgccgatggcgaaaaccgttgtctggcaatgcccgtgggcacgctggcgggagatgtgctggcgccacaggctgcggctggccagcaggcccagggtgccgacgggtagggcgatcgccaggtagccgcgggccagat

SEQ ID NO: 956 - DNA, 200 bp, Mycobacterium paratuberculosis
ccaccttggccaacagggtgaccatcgcgatgatgccgaacgtccagaacgacgcgctgccgatccggcggtattcgtcgatccccgaaccgatgattcgcgtcgagcgggtctggaacaccgccagggccgacagccagagcagcgcgaacagcacggagaacagcgtcatgaccgggtcggagtagccggaggtgttc

SEQ ID NO: 957 - DNA, 200 bp, Mycobacterium paratuberculosis
gcgacctccccgaatcggacgtactgtgcgaacagcaccgagacgaatacgatcaccgagtcggtgacccgcaggccctgcgaatagtggtcctgccaccgccgtacggcggtgccggcggccgacgtcggcgcgccggcaaccgccggccggccaccggttccgtcgcgcgccacggtggtgagggccgccggccggtg

SEQ ID NO: 958 - DNA, 200 bp, Mycobacterium paratuberculosis
cttcggcgaccaccgagcgggcatggcgtccaccgtgttacggatcatcaccgactgaggcatggtgccacctgttccattggtgccaatctggtctgggctgagggccagctcgcgtcctgctcggagatgaccgtgaccggtatcggccaggtgactccgaattccgggtcgtcccagcgcaatccctgctcttcggc

SEQ ID NO: 959 - DNA, 200 bp, Mycobacterium paratuberculosis
cgccgcgtgccgcccactggtgtggtaggtgacctcggtgtcgtcgaccagcgtctggaagccgtgggcgacgtagggcggcaggaacaaagtccggtggtcgtcggcggccagctcgatcatcacgtggtcgccgtaggtcagcgagtcggggcggacgtccaccgcggcggcgacgatggcgccgcgggtgcagcgca

SEQ ID NO: 960 - DNA, 200 bp, Mycobacterium paratuberculosis
gcagcgtggcctcggcgtgcggcggcaccgtgcggtgcagcccccgcaccgtgccgcgggtgtagttgaagacgatattcgtctgcgccacatcgagattgagcccgtgagcggcgaagtcgcgggcgcagaacgaccgccaggtaaagccgcgatggtcgcgacggagttcgaggtcgatgatcgtcaccccggcgacc

SEQ ID NO: 961 - DNA, 200 bp, Mycobacterium paratuberculosis
ttggtgggtgtgtacttcacgtaccgctccttcttcccggcggggcttaggcgtatccggcggacggtgggcgggtcatcaccgtcgggatgacgccgtagcgcgggccgagcgtcttgcccgatgcggcggccagccgcggcagcgagcccatgacgctgggcggcacgttcgcgccggcgaggttgatcgtcggcagc

SEQ ID NO: 962 - DNA, 200 bp, Mycobacterium paratuberculosis
gcggagacggcgctgtgggcggccgggatcacgctcgtccagctcgccggcaccgccaacggtcccaacgcggccgctttacccagcgtgccgagcacgccggagcccagcgatccgagcgccccggccccggagctggccgcactcgcgacccccgacgccgcggccgccacaccgtcgccggcagccttggccaggcc

SEQ ID NO: 963 - DNA, 200 bp, Mycobacterium paratuberculosis
ctgcgcggtctgggcgatgccgaggatggacgacattccgtacaggggcgtggccgcggccgagaaggcgctgggaatggcgccgggtatgcccgaagccaggcccgtcatgatcgacgacgtggtcgagttggccgccccggccgcggcgcccccggcggccccgctgccggtgtccgtgaccgtgtccagcccggcgg

SEQ ID NO: 964 - DNA, 200 bp, Mycobacterium paratuberculosis
tcatcggtgaggaaagcccctgcagggtggtggggatcttggacaccgtgtggttgagttcggcctgggtggtgacctgcccgaccaccgcggcctggcgggcgacgccggcctcgtcggtggtgtcgggcggcggggtgaacggcgtcaccgcgcaggcggccgccgagccggcggcgtattcgtacatcgcggcggcg

SEQ ID NO: 965 - DNA, 200 bp, Mycobacterium paratuberculosis
ggcggcgccggccatccaggccatgtacggcgcgaacgcggaggccatcgccagcgacgacggccccagccagcgtccggtggtcagcccggcgatgaccgagcggtagcaactggccgcggcgtgcagttcggcggccagcgcgtcccaggccacggcggcggccgtcagggacagcgggccgggcccggcatacattc

SEQ ID NO: 966 - DNA, 200 bp, Mycobacterium paratuberculosis
tcgcggagttgacctccgggggaagcgctccgaagtcgatcacgtcagctcccggccctgcgcaggaccgcggcggcggaggcggcgccggcgccgccccacaccgtccatgcagcggaaaagtcctggtcagccgaggtctgtggcccctgcggggccggtgaccagcggttcgccgtgacgaacgacatgtgtttcct

SEQ ID NO: 967 - DNA, 200 bp, Mycobacterium paratuberculosis
cgcggtggcctgcgcgctggcctgctcgagcgcggccgccgtggtggtcaggtaggacacgatgggctgcgccgcggccgccgccgcggccgacccgccgcccgtccactgttcggtggtcagcagcgagatgatcgactcccattggctggcggtgctgctcacttcggcggacaggttggcgtacgccgtcgccgccg

SEQ ID NO: 968 - DNA, 200 bp, Mycobacterium paratuberculosis
gcagctggtgcgattttcgtacgttagacccacgctcgacgatgcgattgagcagccgctcggttgcgacgtggtatctcgccaaaaggccgaaaccactcgtaatgctttgctacagtccggttcgctaaacggaagactctgcaaagggatgcttgactcggcatggaagctttcgtaacgatcgtcttaattgggct

SEQ ID NO: 969 - DNA, 200 bp, Mycobacterium paratuberculosis
tgcggccatcgtcctgtacagggtcattctgtacatcctcaaggagcggtacttcgccagcgaggaattcctggcccacaagaaaaagatcgcatcggtggtcgccgagcacaacgaggtcgccgattacgtctcggagatccgcagcggtgggtcgttcaggcttggcgcgtcatctgccggcgcccaagcacatctgg

SEQ ID NO: 970 - DNA, 200 bp, Mycobacterium paratuberculosis
cgtcttttcagaacaccagccattggaattaccgccgggaccggaacgtagcgaattacgaagcgccggacgtacacaactgttccctacaggttgtccgcaacgccaaggccgatcccctcaagtacgtgatgaagtactttggaattaaagctgacgaggcccatctcgccgaggtggaaaacttgggcgatagcatc

SEQ ID NO: 971 - DNA, 200 bp, Mycobacterium paratuberculosis
agttcaaagtatgagccctagaacccgacgactccgaattgccacttgccccgaacctcgccacgggaaagtcttagggcatgacgacggaaaagcgcacggcgggttgggcggcgagcgtggcggcgggcggcgcgttggcgatgaccgtcgtcggtctcgccggcggccccgtcgccgcggcgggcccggcccccgca

SEQ ID NO: 972 - DNA, 200 bp, Mycobacterium paratuberculosis
ctgccgatgccccccgaggacggcggcgcgccgcccccgccggacgcaccgccgcccccgccggacgcaccggctccgccgcccgacgcgccgcctgcgccgccggaagcgcccgccgttctgatcgatgcgccggcgcccgtgccgccgcccccgccgggcccctgaattaccttttcccggcgacgcagtaattgcga

SEQ ID NO: 973 - DNA, 200 bp, Mycobacterium paratuberculosis
cgagggatacatgaagtcctgcgtgggcggcgcgtcggcgccgaacccgggcgccgccgcgggggccggcgcggcgtcgggtgcgcccggggttgccggggccgcggcggccggcgccggtggcggcggaaccggtgcggcggccgggacggtggccggctgaaccggcccgggcgcgggagccgcggcgggtgccggag

SEQ ID NO: 974 - DNA, 200 bp, Mycobacterium paratuberculosis
cgcacgctgatcccacattcggcgaaccaggcattagcgcgtgtccagaactcggcggcggtttctttgatctcatcgtcgagtacctcgctgtaggccagccgggaatatccatcgatggcggtgtggagatagtgatatccccgtattgggttgcggtgcttgctgaacaccccgctgctcttgtccgcgttggagtt

SEQ ID NO: 975 - DNA, 200 bp, Mycobacterium paratuberculosis
tccccagcagatacccgatgcgcgctggtccccaccggcggatcacccggactttgatgatgcgccgctcggtgcgcgtgggcgtgcggttggggctgtgatgcggtcgtgagctgcggtcggccattccggcctcgcccagctcgcggtagcgcctggcccagcgctctgcggtggttaccgagacctggaagcgttcg

SEQ ID NO: 976 - DNA, 200 bp, Mycobacterium paratuberculosis
aggccgccgaccaggtaggcgaggctgtgcagggtggccaccggcggccccgacggggtgggcggcggcgcgccgggtgcggccgcggcgggcgccgccgcggacgtcggggccggcgccggcgcgggggacggggccggtgccggcgcgggcggcggactcggtgccagcgccaccgggacgagcgttcggcgccggga

SEQ ID NO: 977 - DNA, 200 bp, Mycobacterium paratuberculosis
accccgaatcccgccacaactgccgcgcgaccacccccatctcgggaagcccggtgatgtcgtcgcggtagtagctggtcatcatctcgccgtcggccgccgcgccctgggcggccgcggcgatgacggccggcggccggcgcaggtcgcgggcgcgttcgacgctggtgacgaccagcgcgaccccgccgtcgctttcc

SEQ ID NO: 978 - DNA, 200 bp, Mycobacterium paratuberculosis
gttggaggcgtgcgcgcccggctgagcccgacgaccgcgccgccgccgggctaggctgtccgccgagcttgccttctttttcctacaagatcgagtccgaccaggatcgagttcctacagaatcgaggggatcaggtgtccgatcgtgacgggggagcgcgcacggcggtcaaactgaccgacatcgcagctcgggtgcc

SEQ ID NO: 979 - DNA, 200 bp, Mycobacterium paratuberculosis
aaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtgg

SEQ ID NO: 980 - DNA, 200 bp, Mycobacterium paratuberculosis
tgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggt

SEQ ID NO: 981 - DNA, 200 bp, Mycobacterium paratuberculosis
cgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgagcgtagcggtagcggtttgatcaccgcgacatggccggcgt

SEQ ID NO: 982 - DNA, 200 bp, Mycobacterium paratuberculosis
agcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgc

SEQ ID NO: 983 - DNA, 200 bp, Mycobacterium paratuberculosis
gtggccaccgcatcgtcgagcaccgtggaatccaaggcccgccgtgtcttgcccgccaacaccccggtctcggccaccaccgtcttgaccgcctcgaagatccggttgggccgatccgaagccgccaaccgacgccgccaatacgtcaacgtcgtcgaatgaaacgcgcccgccgtgatcggcaacccgcacgctgcttt

SEQ ID NO: 984 - DNA, 200 bp, Mycobacterium paratuberculosis
ccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggcct

SEQ ID NO: 985 - DNA, 200 bp, Mycobacterium paratuberculosis
cggcggtgaggtcggctgaacgcatgttcagcacgctaaacgtatgttcagcccgcggtcaaggggggcgcgcgtcaagaatcggtaaaaatgcggccggcccggcagaggcccgccaaggcccggcagaggcccggcaaaggccccgaaaggccccgccgacggcccggcaagggcgcgacgggcccgaggtgccgtgt

SEQ ID NO: 986 - DNA, 200 bp, Mycobacterium paratuberculosis
ctgcgggccggctagaccgggcccggcttcttcggcgcgttcggcgcggggccggccgccgcgggcgacggcgcttgcggtgcgggtccggccgggggcgacggcgcggcttgcggtgccactccggccgggggcgcggggaccggcccggcatccgggggcggcggcccgaacggtggcggcccggacggcggcggcgc

SEQ ID NO: 987 - DNA, 200 bp, Mycobacterium paratuberculosis
gcccgccgagcagcggcggctggggcgggtagccaccgtaatccggaccggggtagtagccacccgggtatccgggcggtccgtagcccggcgggggcggcggcccgtacccgggcgggggcggcggaacaggggacggagccggcggcgggtacgggggcggatagccgggtgggtagtcggccggatagcccggcggt

SEQ ID NO: 988 - DNA, 200 bp, Mycobacterium paratuberculosis
tgtgccggccaggcgaagtcggcacgccaccgtcggccgtgccggtcggtgatgctgtactgcagctccggcatcggcagcccactgccgatgaacagcagtcgtgcctcactctccatgggcgattcggcgcggccgtcggcgtaggccagcaattcccggaccttgacgattccgcgacgaccatgctgctcgcgagc

SEQ ID NO: 989 - DNA, 200 bp, Mycobacterium paratuberculosis
cgccgcgtccagctccgctgcggtgcatgcgccgacacgcagtgccgcatcaagcgtggccagggcacgcgcgggccgcagcgcgcgggctacttctatcgcggtccacgccggcatcgtcgccagatggcccttcactcgtcgcagcggcgccccaatccgttggtgcaccatgattttcggtgacgggcgcatccgga

SEQ ID NO: 990 - DNA, 200 bp, Mycobacterium paratuberculosis
ttcccggatcgaggacatggattctggtggtgcgctcggtgtcgaagccgtacagcgcggcagcggtgcccatgcacgcgaccaccggccgtccgaccctcagttgcgcggcgtccagcgcatcggacacgtcgggaacgttgggtgcgtataccccgtgacagacgcggatgagcatgccggacttgaccagaccggcc

SEQ ID NO: 991 - DNA, 200 bp, Mycobacterium paratuberculosis
aattgtttgcgcgagaccgcggtcagcagttgggaagtggttgccagcccgtcgccgcgcaggatgaggctctcgatgtccacagccgcagacaatgcggcaaggcaagtgtcggaaccagccagctgccgcggcgatgtggataagtcccccaccccctccctcgagcagacgcaaaagcccccgacacgccgggcgtc

SEQ ID NO: 992 - DNA, 200 bp, Mycobacterium paratuberculosis
tcgccccgttgcccggggccgcggcgggctggggcgcgggccgggccggctgggcggtctgagccggcggggccgtttgggcgggcagggcgggctgggcggtttgcggggcagccggcgccggggcggacgggccgtcggtgctggccggggcggccagcaccgagtcgccggtgggctcggggttgtagtcgacgagg

SEQ ID NO: 993 - DNA, 200 bp, Mycobacterium paratuberculosis
gccgcggtgtgcgtcttgccggtgccgggcggcccgtgcaccgccaggtacgacgagtccaaatccgttagcgcggaggcgatgtcggcgacggtgtcggcgctgcggggcagcgcggcgccgctgcgggtgcggggcgcgcgacgcagcagcacgtcgacgacggcgctgtcgggcagccgcggcaggccggcggccac

SEQ ID NO: 994 - DNA, 200 bp, Mycobacterium paratuberculosis
gcatcccgagggcggcccgaataccccggggggggccgacgggcggcgtcatgcggggagggtgacgaggtggccgccgttgccacctcgggcggcgccgccggggcggcgccgttgcccccggcggcgacggcggcaacggcggtcggtgcggccgagccgggcggcggcgggaacgcgtacggcagcggcaggtccgg

SEQ ID NO: 995 - DNA, 200 bp, Mycobacterium paratuberculosis
gtgacgcccggcggcccgattcgttgcgaatccgaagggcccgcgcgcgaccggctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaagg

SEQ ID NO: 996 - DNA, 200 bp, Mycobacterium paratuberculosis
ccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggc

SEQ ID NO: 997 - DNA, 200 bp, Mycobacterium paratuberculosis
ggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacg

SEQ ID NO: 998 - DNA, 200 bp, Mycobacterium paratuberculosis
atgcgggcgtcgaaatcgatgaggaaatcgtcgctggtgaagccacccggaaccggcgggcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacgg

SEQ ID NO: 999 - DNA, 200 bp, Mycobacterium paratuberculosis
cctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtg

SEQ ID NO: 1000 - DNA, 200 bp, Mycobacterium paratuberculosis
atcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcgaaga

SEQ ID NO: 1001 - DNA, 200 bp, Mycobacterium paratuberculosis
tccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacg

SEQ ID NO: 1002 - DNA, 200 bp, Mycobacterium paratuberculosis
ctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactc

SEQ ID NO: 1003 - DNA, 200 bp, Mycobacterium paratuberculosis
tgcgggtgttgcgcagcgtctcccgggtgcgcgtcgcggtggagcacagcacggcatcgatggcgggcgcgccggcgcgcagccagtcgccggccaggccggcctgccggatgccgcgcggcgccagcggccgatcatggtcggcgacgccgtcggggtagtccgacttcgcgtgccgcatcaacagcagggtgcgtcgg

SEQ ID NO: 1004 - DNA, 200 bp, Mycobacterium paratuberculosis
cgtgttcgacgtcgccacgggcaagctcgacgaggtcaagccctagacccgtgtagtcagcgcgaaaaaacggcccgaacgtcaccgtgggtgcacgctcggccgacaacttgagcgccggccgacacaactcgagcgccggccggctcaccccaccttgtaggtggccagcgccttggccaccagcgtgccctgcgggt

SEQ ID NO: 1005 - DNA, 200 bp, Mycobacterium paratuberculosis
ctggaattgctgccccgcggacggggcgggtggtgccagggccgtcagcgattccacctcggcaggactggcggtgcgcggtgcgccggccggcggggggttcgcggcggcgctggaggcggtggcgttgggggtgggcgccgccgccggcggcgcggggcagcagcgcggcttggtgccctgggcgtggatcatggcgg

SEQ ID NO: 1006 - DNA, 200 bp, Mycobacterium paratuberculosis
gttgccgatgcgcatgccaaacttgacgacgtgacacgtccgcgaccttctatcggccccgccctggccggggccgtcgatctttccggtctcaagcagcgggcccaggcggcgagcggcccggccggcgggcccgcgccggccgacggtggccccggcatcagcgcggtcaccgaggccaacttcgaggccgaggtgct

SEQ ID NO: 1007 - DNA, 200 bp, Mycobacterium paratuberculosis
tatcaggcgatcctggatgccaacccggccagcacggaggccaagggcgccatccgccagatcgactttctcacccgcgccaccgcgcagcgcccggacgccgtcgccgtcgccgatgccgcgccgggcgacatcgacgccgccttcgcggccgccgacgtgcagatcctcaaccaggacgtcggcgccgcgttcgaccg

SEQ ID NO: 1008 - DNA, 200 bp, Mycobacterium paratuberculosis
tggcgggacgagttgtcctggggttttggggatgattgttgggtgcagggtcgctctgatgatcagcgtgagttgttggatgcggagtcggttgccgggcatcttctgaaggccgacagcatgtttgcgttcctggcggcgcaccgcagccagttgtttcccgaggagatgttcgcggacttgttcccgtcgcagcgggg

SEQ ID NO: 1009 - DNA, 200 bp, Mycobacterium paratuberculosis
ccggcccagcgtgccggctgaggtgatggcctcggtgatcaccttgcaggccctgcacggtttttcggataacgagaccgtggatgcggtgactttcgatctgcgctggaaagcagcgtgcgggttgccgatcacggcgggcgcgtttcattcgacgacgttgacgtattggcggcgtcggttggcggcttcggatcggc

SEQ ID NO: 1010 - DNA, 200 bp, Mycobacterium paratuberculosis
ccaaccggatcttcgaggcggtcaagacggtggtggccgagaccggggtgttggcgggcaagacacggcgggccttggattccacggtgctcgacgatgcggtggccacgcaggacaccgtgacgcagttgatcgccgcgatccgacgagtgcgccgcgaagtccctggcgctgcagcggtgatcgaagcccactgcagc

SEQ ID NO: 1011 - DNA, 200 bp, Mycobacterium paratuberculosis
ctctgatggcaccgacgggcactggcgcatcgcgcagcaggtcagtggggatcgcgtgatctccaccgtcgatgccgacacgcggcacgctcacaagacggtgcaccgccgccaggacggcttcaaagcccaccttgccgtcgagcccgacaccggaatcatcaccgattgcgcgttgaccaaggccagcggcgcggaca

SEQ ID NO: 1012 - DNA, 200 bp, Mycobacterium paratuberculosis
accacgaggccgtcgtcgggctgagcctgctcgagggtgaacacaccccccggtgcgggtcctggggcgattcggcgtatggcaccggggccgcccgggcggcactggccgacgccggccatgtcgcggtgatcaaaccgctaccgctacgctcgccggttccgggtggcttcaccagcgacgatttcctcatcgatttc

SEQ ID NO: 1013 - DNA, 200 bp, Mycobacterium paratuberculosis
gacgcccgcatcgtgacctgcccggctggacacggaatgccgatccgtcccagtggcggagtcaccttcgaaagatactgtcgctcatgcccgttggcgtcccggtgcacgaccgccacgcgcggacgcaaactcacccttcatatccacgagcaattattgcgcgctgctcgcgtcgcggcccgcgaccccgattggca

SEQ ID NO: 1014 - DNA, 200 bp, Mycobacterium paratuberculosis
agccgaataccgccaacaccggcccatggtggaacgctcaatggcctggctcactcgcggcaaccgcaaggtccgctaccgaggaaccgccaaaaacaaccattggctgcaccaccgcgccgcagcactgaacctacgtcggctgctcaccatgggcctgacccgcaccgacaccacctgggccatcgcctaacacgccc

SEQ ID NO: 1015 - DNA, 200 bp, Mycobacterium paratuberculosis
tcacaccaaggccttgcctcagccgccgaccgctgccacgctcaacaacggcggggcgatctcttttctgtcgacccacagggtctgactacaacacgccgctagacggttcgagacgccccgccccaaaaaatcccctaattcagcaggctcctagttccctcgacacggtgccggcgcgagttcgccaccgaaatcct

SEQ ID NO: 1016 - DNA, 200 bp, Mycobacterium paratuberculosis
gcaacatgatcgcgcagtacatgctcggcctgggcaagccggcctacgcgccggtggcccagcgcgccagctgacggcgcgcgccggcgggcctcctgcgcgcctcctgccgcgcctcctgcgcgccgaacgtgcactggccgcgaaattccgcgcactttttcgcgctgggtgcacgctcggcgacggtcaggtggtca

SEQ ID NO: 1017 - DNA, 200 bp, Mycobacterium paratuberculosis
gccaagagccccgcgaaacgccccgccaagaaatcggcggcgaagaagaccgcggccacctcggcggccaagacgcgcgcgaaaaagactgtggtcgaaccgaagtcgcgcaccaccccggccgcaccgaacccggaagtcgccgcgtcgcacaacggggaagtgagcccctcccgcgcggccgacccgatcggcgccga

SEQ ID NO: 1018 - DNA, 200 bp, Mycobacterium paratuberculosis
acgtgctcccgccgagatccaccgcgcggccagcggcgccgaaaaacgcgacggcccggtccagttgtgccgcaaggcattccagtgctctccgctgttcgggtagacgatcaccggcttgccgatcgccgcggcgatctcgatcgtgggcaacacgtcgtccggcgcgcagcaattgacgccgacagcgacaatctcgg

SEQ ID NO: 1019 - DNA, 200 bp, Mycobacterium paratuberculosis
ggcgacgacgactccgacggccaggacgccgaggacgccgacgactccgacaccggtgacgacggctcggccgacggcggcaatcgccgccgccgccggcgccggcgccgcaaatccgggtccggcgacgacaacgaggacggaccctcgcccgacgatccgcccaacaccgtcgtgcacgagcggcctccccgcaacgg

SEQ ID NO: 1020 - DNA, 200 bp, Mycobacterium paratuberculosis
cgacctggaccccaacctacgcgtcgtcgactccaagtcggccgcgatgggcaccggcttcgtcgcgttggccgccgcgcgggcggcggccgccggcgcgcagctggacgccgtcgccgacgccgcccgcgccgccgtgtcccgcgggcacggcttcatcgtggtgcaccggctggacaacctgcgccgcagcgggcgca

SEQ ID NO: 1021 - DNA, 200 bp, Mycobacterium paratuberculosis
aaccacccaggtccacacgatctcgccgggatcggcccggccgtccagtttgggcgcgtacaccagcttgcgggcccgctgcgcggtgggcaggctgctgcgggtcaccggccggcccaacacggcggtgtccggcggcgggggtgcggcggcggcgatgacgttcgcggtgatcttcacggcctgctgcagctcgcgca

SEQ ID NO: 1022 - DNA, 200 bp, Mycobacterium paratuberculosis
tgcttgcagcagccctcctcctcgtcgggatgggttaattcacggaggcccggcaaccgaactgcccgcagagatgcggccgttcgttcgtctgtgctttcggcgctgagcgcttggcgctgaaagggtcgcgccaaccgcgttgacgacataagcttgccgggtcactcggaaggccagccgcttcggttaccaaagcc

SEQ ID NO: 1023 - DNA, 200 bp, Mycobacterium paratuberculosis
cgtgtgacttcggattattggcaggtcggccgccgtggcgaatccggcgggagcggcgcacaccgcgggtaccgcgttcaacacctgcatggcggtggccacgctggccgaacgcacatgttctgccatcgaggccgcgcgggtgaagcttgccagggcgaagaaatgcgcgcgcatcgacgggtcgccctcgatggtca

SEQ ID NO: 1024 - DNA, 200 bp, Mycobacterium paratuberculosis
aggtccagccgtgctgcggttgcggccaatgcttcggatattcaccgcccaccgtccatagcgtctcgatttcgacgagcacctcgccgtcgcgtccgcctgaccagttccagcgttgtcccgcagtggttcccgccttgagcaggtggtcgaagatctgatggtcggcttcggcgggaacggcctcgaccgatgcggtg

SEQ ID NO: 1025 - DNA, 200 bp, Mycobacterium paratuberculosis
acctcgtcgatatccgcgttgagtgagtcggcgatcaaccacacttgttcggtgaagatggcgctgttgaatgccaggaactggttggtgtgcgggctgatgtcggcgacgggttgcccgaaacgccatgttgtcgaacgtgatcgacgtgctctcgtacgccgaccaatcggcgcgttcctgcagggtgatcttgtcga

SEQ ID NO: 1026 - DNA, 200 bp, Mycobacterium paratuberculosis
tagtgggactcatccccgaaagcgcgagcggcagtgcgctcgagaggttgccgggattgaggcccccgccgtgcacggtggtgccgccggtgcggcaggcattgaggacgcgagcgcgatcggccgtgttgatgcgcgccggatgaaattggaaagccgttgtggcaacgttctttccgctcgacagaaggctgcagacg

SEQ ID NO: 1027 - DNA, 200 bp, Mycobacterium paratuberculosis
tcgtcgatgctctggctgcggggggtgtacagcacgcagtctgcctccagctcaagcaccgcattgacgtcggtggtggcggcaaccccgatgggagcacgcccggccaatatcccgacgtcttggccggctttggaatcggagtagacgcgcgcaccgacgatccgtaggtcgtcgcggtgatcgatgatggtggtaag

SEQ ID NO: 1028 - DNA, 200 bp, Mycobacterium paratuberculosis
catttcggctcccacggtgccgataccccaggcgatgacgttcagcggtctgcggtcagacatcggacagaagccgacgcgtgggcagcaccgtcaacgggacgccgcgatcttcgaactgccagttcggcccatgagagatgtaggtcatttcgacttcctcccggcgcttcgcttcggtgtccgaccaccggatgtcg

SEQ ID NO: 1029 - DNA, 200 bp, Mycobacterium paratuberculosis
acgaccaggtcgctggcctcgtaggtcgcgtgcagatccgaccagtgcggatcgacaccggtggccatgacctcgaggggactgacatcgtgcgtcgacagcgtcgccatccaactgcggtcgcggacggcgggggagttgcttgggatgcgcacccgcaccgcgtcgcgcgctcctgtcccgaggcgctccacggatgc

SEQ ID NO: 1030 - DNA, 200 bp, Mycobacterium paratuberculosis
tccggtgtaggcgaacgggcgcagggcgggatgcaaatcgaggaccgaagcaaggtcatctgcgccgacgccaaacccgaggctgctttgatgcgcgccgaaccgacgtaggcggtgccggtgaactgcctgcgcagcagaccgagcgccttggcctcgccgccgtgccggcgcaccgagcgctcgaacgcgagcgccag

SEQ ID NO: 1031 - DNA, 200 bp, Mycobacterium paratuberculosis
cagatgatgctgaatggcgacttcctcggccaaccggacgagcgccgagcgtgaccactgatcaaatcgaatgtccgagaacaacggaccggtgtagtcgccgaggccgtcgtccgagaggtcgatcgggtcgaactgcagggccgtcagctcgcagcgcgagacctcgaccgcctcggcggggatgggcaggtcctccc

SEQ ID NO: 1032 - DNA, 200 bp, Mycobacterium paratuberculosis
ggctgtcttcgatggtgaccgaccagtggcagtggggggtacggtcggccggcttgcgcgggggccggtggatgggtcggaaccgcgccttggggttggtcgcgatggccgtcgcatcaaaggtgaaatcctggatggtgtggcacatcgcgcggacccagacgtcgcccatcggctcgacgtcgatcaaggcgccgcag

SEQ ID NO: 1033 - DNA, 200 bp, Mycobacterium paratuberculosis
tagtcgttgcggaactccccgtggttgggatcgatcagcgagtagcggaagtcgaggaactgcggcggcgctccgacgtcgaactgcagcaccttgaagatgtcctcgacggtgtcaccggtgacaccgagcgcgtggcgcaggcgtcgggtgtagttgggactggctcccatccactcctcgatggcgacctgggtctg

SEQ ID NO: 1034 - DNA, 200 bp, Mycobacterium paratuberculosis
aacctctggatcgacatttgtgcggtgctcgcaacaagccgccgcgatcaggctgacgggattgcccgacggcggcaccgatgcgcccgaatcgattggaaccgtgtcaatttgatcaacggtgtctcccgccggtgaagcgactacgaactcgctgtccgcgacaccagggcggcggcgacctgggccacaggggtgtt

SEQ ID NO: 1035 - DNA, 200 bp, Mycobacterium paratuberculosis
tgacgcttccggatgaacgactccgccacctgcgacgcaggaccaaccgacgcgtcggaccgtgccaaattcgccggcagccgagaagtcccatccgcgatcgggggttgcggcaaagaagaccccgatgaaaccggacatcgctagcgccggctcctgtctaggtcgacggttcccgtgcactcgttgaggccatgatt

SEQ ID NO: 1036 - DNA, 200 bp, Mycobacterium paratuberculosis
gcgtctacctctcaaagccgacttcgggcctgcctgcgcggtgttgactttccggcgagcacgaacgaactgattgaagccgccaagcgaaaggcgacgataacgacacggttcaggtgttgcagagactggcaccagtgacctacacgaatctcgcacaggttgctgcgtcggtgaccatcgtggatgaagagggcctc

SEQ ID NO: 1037 - DNA, 200 bp, Mycobacterium paratuberculosis
ggcgggagtcctgtttcggtatagctggcacctcaacccaagccccggccaacagcgcaaaaggttggtgtatagctaaaagccgcagacgaacgtgccgcctgttaggtgatccaatttcaatccgaactgagtaacatgccctgccaggttttcggtgcattcgcccgcaccaaatccgactgccgataaagctggcc

SEQ ID NO: 1038 - DNA, 200 bp, Mycobacterium paratuberculosis
gttgggcgcaacgtatcgcccagtacgggggtcgtagtgcagcaccgcaactgaaggcgagacaccagaactgttggagtcgaacgcgcttggtgccgctggcgcggcagccacatccggcgctgtcggcggctggttgagcgaacccggcgctggcgggcctggcggtgttccagcgggcgccgccccgggcggcaacg

SEQ ID NO: 1039 - DNA, 200 bp, Mycobacterium paratuberculosis
gcgtcccctcgaccggaccgaaagtcctgtcctcgataccagcccggtcatccggtggcagaccctgcgatagaaggttcgggtcgagcggatacggccccagcgcgtgctgcctctccgctagcggcacatacggtttatcgctattgcagatttcgactgtgggcgcacgctttccgggtttgcccatgcaggggtag

SEQ ID NO: 1040 - DNA, 200 bp, Mycobacterium paratuberculosis
gtccgcgccccccgcacgctgatcggcgagtcctgcggaagtttgcagtacagattgtcgggggtgtcggcctcactggtgtcggcgggtgagcgccactgcgacggtggcaggaacccgaccgtgcacgccggcgggtcggcgatggtcagcgtgaagcggccgaccgccaaaccggtcgggttgttggtgacgccgta

SEQ ID NO: 1041 - DNA, 200 bp, Mycobacterium paratuberculosis
agacccgtaggccgcgacggacggggggagcagcaccagcagctgttccagcgccgggtgatatgtcaccccgatctggccgatggtggacaggttcgccaagaagaccggcagggtcggcttcagctggtccagcagtcgcgaaacctcttgctcgaagccaggtccggtgtgcagtagcttgcggaactgcgcatcgt

SEQ ID NO: 1042 - DNA, 200 bp, Mycobacterium paratuberculosis
cggtcaccatctggtcggtgaagccggccaggttgtgcgcccaccgtcgcgtcttgtcggcggtctgcgcctgcgcatccaggaacggcgcgccgtcgtcgaccagcgcacgggtgtggtcgacaacgccggacgcgtcgcgcgagagcttgcccgacgaatcgagcagccactccaggtcatagcccgcgccgttgaac

SEQ ID NO: 1043 - DNA, 200 bp, Mycobacterium paratuberculosis
gcggagaacgactcgttgagcagctgccccagtttgtctttggggatgctcttgaccaacgcgctgagcctgtccagcatcggccccaccggccgcgggatgctggtgtcccgcgcggtgatcaccgacccgtcgcacagatagggtccggattccgagcgcggcaccaggtccacgtattgctcgcccaccgctgacat

SEQ ID NO: 1044 - DNA, 200 bp, Mycobacterium paratuberculosis
gctgcgcaccgccgcgtgcacatcggccgggatcttcggcgaggtgtcaagctgcagcgtggctttcgcgccggtcgcggtcggggcgaccgcggtcaccttgccgatctggacgccgcgataggtgacgttgctgaagcggtacagccctccggtatccggcagctccaaggtgaccgtgagcttgccgatcccgagca

SEQ ID NO: 1045 - DNA, 200 bp, Mycobacterium paratuberculosis
gcgtcggcacctgcatgtactggaagaacatgaacgccatcgcgaccaccgacgcgagcgcgaagatggtcagctgaatccgcacgaaccgcgtcagcatcagccaccgcctcgcgacggttgatccacgggcgcaatgacactcatatcgggagccatgacaggcggcgccgaagcgggcgcgccgggagaaggcggcg

SEQ ID NO: 1046 - DNA, 200 bp, Mycobacterium paratuberculosis
gcgccaaaggcggattggtgacgccgaaaccgagcgggtcgtaggtgtagttcgaaaaccagggatcacccggcgcgggcaccagcggcgcgtccggatctccccaccgggtaccggcgagcagcgtcctcttcagccggggaatggtcatgtcgatgacggcgaagacgttgaagtagtcaccccgcaccgcccggtca

SEQ ID NO: 1047 - DNA, 200 bp, Mycobacterium paratuberculosis
ttcgcggatcagcacgtcgagcgcgggcggaatcttgcgcagcgcttgggtgatcacctcgcgctgggaggcgaatgtgccggcgagccggttcagtgagtcgatcgacgcaatgatcctgtcgcgctgttggtccaggacgccgacgaattcgtcgaggcgcgtcagcagttggcgcacatcggtctcgtggccggaca

SEQ ID NO: 1048 - DNA, 200 bp, Mycobacterium paratuberculosis
ccaccacatcgggtttcaccgagacctcgacgtcggcgtgatcgtgcttgacccgcatcttgccgacgctgcccacgatgacgtcggccatcatcaccggcgaattcgattccagggtgccgatattggcgatctcgatgtgatagatgctggcgtgtggcccgcgaccgacagcaccgggcaggggcaacgagttcacg

SEQ ID NO: 1049 - DNA, 200 bp, Mycobacterium paratuberculosis
ccctgaaaggaacagccaccaacggcgaaggcgcacgctacgatacaaagccggaccctcgtcatggcggcgtccccgggcccggcggcggcggctgatcgcccggcgccggctggcgatcgtcgggcagcagcaggtcctgcacgctgtgcggtgtcgagtcaccgttgatgccggtgtaggcggataccgccggcggg

SEQ ID NO: 1050 - DNA, 200 bp, Mycobacterium paratuberculosis
acgtcggggggcgtgggcgatggcccttcggcgccgggcgccaggcgcggttcggcgtagatgatttttccgggagtggcgatctgctgcaggatgatgttcgtcgggatgggcaggtagttgaggttcgcggtgcgcagaccggggccggcgtattccgcgcacagcttcccggtttcggccgcggtgacgttcgcgac

SEQ ID NO: 1051 - DNA, 200 bp, Mycobacterium paratuberculosis
ggcgccgatggcgtcgcagaagaagtgcaccgggttggagaggttgttgatgatgaagctgcccatggctccgggggtgttggggttatagatgttgtagccgttggagaatgcggtgggcgcggcgtgcaggatgttctccacatccatccggtggtcgaccagaacctgcgtgacggtggtcagccgctgaatctgtt

SEQ ID NO: 1052 - DNA, 200 bp, Mycobacterium paratuberculosis
cggcggtcttgtcccgggttccggcgacgaagcgttgcacctcaccgacggccaccgacaggttcgacagcgccgcatctagatcggatcggctgtcgtcgagcacgctgctcagtgtcgtcaaccggttctggaactggacgatctgttgattgctgtcgcgcagggtggtgacgaacttctgcaggttcttgatgatg

SEQ ID NO: 1053 - DNA, 200 bp, Mycobacterium paratuberculosis
ttcgacgggtatcgccgttcggtcggtatcgatcacggccccgtccagcatcttgggaccgccgccccggtgataggcgggggtgagctggacgtagcgggcggacaccaggttttgtgcgacgatgatcgccttggcgtcggccgggatcgacacgtggcggtcgacgtgcagaatcagcctggcccggctgggctgcg

SEQ ID NO: 1054 - DNA, 200 bp, Mycobacterium paratuberculosis
gctgtacggaggcgacggtgccgactttgacgccggagacgcggatttcgtcgccggcgtagatcccggttgccgacgggaagtaggcggtgatggtcagtggacggaagaacgtctggcgcaccaggaatccgctcgcacccacgagcagaccgaccaacagcgcggtcaccagcagccgcctgcgcacggtcatcgcg

SEQ ID NO: 1055 - DNA, 200 bp, Mycobacterium paratuberculosis
cagcgagttgaccccttggctgtgctccgagaggatgcccgtgacatcggtggcgctcttgagcagcgcgtccaggctttcgccgcggctgttgatcgcccgcgacaagcgggtcactccgtcgaacgtcgggcccagctgcggggcgatctgatcgatcgtcgccgacagggcgtccagcgattgattgagggtgtcgg

SEQ ID NO: 1056 - DNA, 200 bp, Mycobacterium paratuberculosis
tgctggtggtcgagaggttcgtggtcatgtcggacacggcctccgtcaacgaatacggtgacgacgtccgggacagcgggatgacctccgacggacgcaacaggccggcgccggccgactccagggtcagcacccgagcccccagcagcgaaccggtgcgaatgtgcgcggtgctcagcgacccgagccgcaccttgccg

SEQ ID NO: 1057 - DNA, 200 bp, Mycobacterium paratuberculosis
ttgaccccgaaatcgaccagggcgttgccgtcgtcgtccagcgaaaccctagaaaccgtaccgacattgacaccggagaccaaaaccttgttgccgggtaacagcccgccggcctcggagaacaacgcctcatagcgaatcgtcgtcgcccaggtcaccagccggtccggtgccaacccgacggcgacgacgagcaggat

SEQ ID NO: 1058 - DNA, 200 bp, Mycobacterium paratuberculosis
cagcaccgtcccgatgaagcccggtcgaatgaggtttgcgccacggtatttcagcatcagggctccgcgcaccttccctcggtttgctttagccaggggtagaccgccgtgcggccctgcagatcggtgacgcggaacgtcagcccacagatgtagtagttgacgaagctgccgtaggcgccggtgcgggcgagcttgcg

SEQ ID NO: 1059 - DNA, 200 bp, Mycobacterium paratuberculosis
gaagttgttgggcgcccgctgcagtgcgtcgtcgaggcgccccttgccgtgctcgagcaggggggccagccggttcagctggtcgaccgttccggacagcggtgggcgcgcggcgctgagcaggtcggtcaccgaggcggtgccggtggccagggcctggatcgcgtccccgatcggatcgcggtcgtgcgcgaggtcgg

SEQ ID NO: 1060 - DNA, 200 bp, Mycobacterium paratuberculosis
tgacgaggcgctgcaggcgttcgatcgcgccggagaactggctcccttggtccgacagggtccgcacgacggtgttgaggttgtcgatcagggtttcgatggccttgttcttgccggcgacgtcgttggagaaggacgacgttttcgccagcagggactgcagcgtttggccctgtccctggaacacctgtagtagcgcg

SEQ ID NO: 1061 - DNA, 200 bp, Mycobacterium paratuberculosis
ccggccagagcgttgacgtcctgcggattcaggccctggataacgggtttcagcccgccgagcagcaggtcaagatccagggagggcatggtgtggtcgatcgatatctgcgacccctccggcagcacccgcatggagccggggccgatgatgagttcgaggtagcgatcgcccaccaggttgagatatcgcacggccgc

SEQ ID NO: 1062 - DNA, 200 bp, Mycobacterium paratuberculosis
ccgggtgccggtggtgagcgcgacgtcgtcgtcggcgtcgaagtccacgactaccttgttgtccggctgcagcgcaatgccgttgaccgtgccgacccgaattccggctacccgcaccgaatctccggtcttcagctgcgaggcgtcgatgaagaccgctgagtaactgtgggtggggccgttgcggaattggccgaaga

SEQ ID NO: 1063 - DNA, 200 bp, Mycobacterium paratuberculosis
tgaagaagagggaggtcgtgagcatcagcatcacggcggcgaagacgccgaacttcaccatgatgcggccggtgccggtcatcccggttgcccgatctgtgcggtattgcgcggcggtccgtcgagggggccatagaggaactgcttgagcccgtcggagttcaacaggatgccctgctgtccgtactgccacgggttgg

SEQ ID NO: 1064 - DNA, 200 bp, Mycobacterium paratuberculosis
cgcctatgtcggcgacgtcgaagggcgggaaggtgttgtaggcgagcggtaattcgtgatcacactgcgggccgccccgggccgccaccttgggcaggttcttcggaaaccggtagcgctcggagcctagcgtgatgccgcccaacacctcgagccccggcaccggcgtgggcggctgcagcgccagcgggaacatgccc

SEQ ID NO: 1065 - DNA, 200 bp, Mycobacterium paratuberculosis
ttcaaagaacacgtcagcgcctggtggtactcgttggtcaggtcggtcgtcggtgccagcagatgcgttacttcggcaagcttttcgcgattggtgcccaggacgtcgttgccgaggtcggccaggccgatcgaactgatcaacagcgcgtcgaggttctgctgttcgtcgaccagggtctggctgatgcgcgtcgtgcg

SEQ ID NO: 1066 - DNA, 200 bp, Mycobacterium paratuberculosis
gtccgcgacggtgatgaggtcgggcgccgcgtcggcgtaggcgctcgacacctcggccgtggcctcgatgtcgtggctcaggttcggcaggctcggctcgatcttgccgagaaagttgttcaggtcgctgaacatctgtcccagccgtgcaccgcgtccgttgagtgcggtggccatggcaccgagcgtctcgttgagtt

SEQ ID NO: 1067 - DNA, 200 bp, Mycobacterium paratuberculosis
tggccgggtcgattttcgccagcaccgacgtgagttgttggaacaccgagttgatttcgacggtgacgcggccggcgtcgagcacctgaccggcgcgcaggcgctgcggcgacgggctctccgggggaatgagctggatgaacttcgcgccgaacgccgtcgtcgcaacgatgttgacgagaacgttggccgggatgagc

SEQ ID NO: 1068 - DNA, 200 bp, Mycobacterium paratuberculosis
tgcagcctggacggatcgagggccagatggatgtccgcctgcccgtcggctcggtcctggatggaggcgacgctgccgaccggtgcaccgtgcagcttgaccttggcgcccgggttcatcatcaagcccgcccgtccggcgaccaccgtgaccggcacggtttgggtgaagccgccgcgaaactgcgtgagcgcgagggc

SEQ ID NO: 1069 - DNA, 200 bp, Mycobacterium paratuberculosis
gaggacggcggcggcggcgatgacggtcgccaatcccgcgagcgggcgggcgtagcgaaacgtggggcggcgactggcgagggggtgcgagggcgctcggtgtccggccggcacggcctggattcgtctggtcacctaggccccttcgccgccgcgggatgtcgggtcgacgcaccaaacagccagtgcgacagtcgaag

SEQ ID NO: 1070 - DNA, 200 bp, Mycobacterium paratuberculosis
tggtgcgcacatgccggctacagacccccgtcacgctgtcccgatccatagtcatccaagccaaccggtccgcggtgtgatacaaatctcacgttagtagcgagcagaacgatacatccgcattacgagaacttcaatactgttcaacacgagagtatcgttctacgctggccacggctgaagcccaccggaggagcaat

SEQ ID NO: 1071 - DNA, 200 bp, Mycobacterium paratuberculosis
gtgaccggtatccgtgtcgtcgcgcccgagttggcgcgccgctacgaggagcagggctggtggaccccggacacgctcggggatctgctggcccgcggcctcaaagacaaccagcacaacacgtttcgcgtgcactccgcggtgcggccattcgcgggcacgttcggcgatgtcgagctgctggcccgcaggctcgcggc

SEQ ID NO: 1072 - DNA, 200 bp, Mycobacterium paratuberculosis
agggctgcgcgcccggggcgtcggcccgggtgacgtggtcgccttccagctaccgaactgggtggaagcggcggtcaccttctgggcctcggcactcctttccgcggtggtcgtgccgatcgtccacttctacgggccgaaggaattgcgctacatcctgtcgagcgtcaggccgcgggtcttcatcaccgccgagggat

SEQ ID NO: 1073 - DNA, 200 bp, Mycobacterium paratuberculosis
tcgggcgcatgacctacgtgccggaggtctgtgcgggcgtaccgaccgtcgcgctggtgggcgagagctttgacgcgctgctcgaggacgaaccgatggacgccacggtggcgaccgatcccgccaacccggcggtgatcgcgttcacgtcgggcaccaccagcgaccccaagggcgtgatccacagccatcagacactg

SEQ ID NO: 1074 - DNA, 200 bp, Mycobacterium paratuberculosis
ggcttcgaaacgcgccagctgttggcgaattacccgcaggggctcgggcggcagctcaccgcgctgcccgtcgggcatttcatcggcatgctcggcgcgttcctgatgctggttctcgacggcgcgccgatcgacctcaccgatgtctgggacccggacaaggcgatcgacctgatggacgccgacggcgtggcactcgg

SEQ ID NO: 1075 - DNA, 200 bp, Mycobacterium paratuberculosis
cgggggaccgccgtacttcgtcaccagcctgctagaccacccccgcttcaccccggatcacctgcgctacatcaaacacatcggactgggtggatccaccgtcccggcggcggtcacccggcgcctggccgacctcgggatcgtcgtcacccgctcctacggcagctccgagcatccgtcgatcaccggttcgcagcaca

SEQ ID NO: 1076 - DNA, 200 bp, Mycobacterium paratuberculosis
ccgcaccggaggccaagcggctgttcaccgacggcaaggcgcgcgcgggcgtcgaggtgcggttggccgacgacggcgaaatactttcgcgcggaccggatctgttcgtcggctacaccgatcccgtgttgacagcccgagcgttcgacgaggacggctggtatcacaccggcgacatcggggtgatggatgacgacggc

SEQ ID NO: 1077 - DNA, 200 bp, Mycobacterium paratuberculosis
tacctgaccatcaccgaccgcaagtccgacatcatcatccgcggcggcgagaacatcagcgccctggaagtcgaggaagttctgctcgccatgccggcggtcgccgaggcggtcgtggtttccgcgcccgatgcgcggctcggcgagcacgccgcggccgtgctgcgtcttaagcccgggtatggcatgccgaccatggc

SEQ ID NO: 1078 - DNA, 200 bp, Mycobacterium paratuberculosis
cgaggtccgcgagcacttcgagcgcgccggggtggccaagcagaagtggcccgaggagctgcacgaagtggccgactttccccgcaccgccagcggcaaggtgcagaaatacgttgtgcgccagagtattcgggagaaagcgtagcggtcggcgggcgggtcagcggctcgaccggccgaaaattgagagttgaacttct

SEQ ID NO: 1079 - DNA, 200 bp, Mycobacterium paratuberculosis
ggtcaaaatagaatacggttctaccgttacctggtatttaggagttgtcgtgacgatcgtcgcggaacaacgcacgtatgtcgcgggccgttgggtcaccggtgacgaagtggtcagcgtcgaaaatcccgccgacgagagtcacgtcgccgacatcaccgtcactccgttgcccgaggtgcagcgcgcgatcgccgagg

SEQ ID NO: 1080 - DNA, 200 bp, Mycobacterium paratuberculosis
cgcgccgcagcttcgacgacggggtgtgggccgacatgccgcccgtcgagcgggcgcaaatactgcacgcctttatcgaccacatcgagtccgagcgcgccacactggttcccaccctcgtcgccgaggccggccaatcggcgcgcttcgccgagatgacgcagctgggtgccggggcggccatcgcgcgccagacgatc

SEQ ID NO: 1081 - DNA, 200 bp, Mycobacterium paratuberculosis
gacctgtacctgtcgatgtcgcacgaggaagccagcccggttccggtcgatgacctggtgcgtggccgggtcgcgctgagcgtgcggcggcacgaacccgtcggcgtcgtcaccgccatcacgccgtacaacgcggcgctgatcatgggctttcagaagctgattcccgcgttgatggcgggcaattcggtgatcttgcg

SEQ ID NO: 1082 - DNA, 200 bp, Mycobacterium paratuberculosis
gcccagcccgctgaccccgatctcgtcgctgatcttcggcgcggccgccgacgcggccggcctgccgccgggagtcctgagcgtcgtcgtcgagtcgggcatcgccggggccgagttgctcaccagcgatccgagcgtggacatggtgtcgttcacgggctcgacgctggcggggcgcaaaatcctggcccaggcggcgc

SEQ ID NO: 1083 - DNA, 200 bp, Mycobacterium paratuberculosis
cgaccgtcaaacgggtgtcgctggaactcggcggaaagtcggcgcagatctacctgcccgatgcggtgcaccgcgccgtcggcggcgccttcgtcgcggtcgccagcaccgccggacaggcctgcgtagcggccaccagattgcttgtgccacaagacaagaaagccgaagtgctggacgcggtcagcgcgatgtaccag

SEQ ID NO: 1084 - DNA, 200 bp, Mycobacterium paratuberculosis
cagatcaaggtcgggccgcccagcgacgaaacggcgatgatgggcccggtcatcagcgcggcctagcgcgacaaatgcgagcagtacgtgaagttggccgaagaacacggcggcaaggtgttctgcggtggcggacgcccggcgggtcttgaccgcggctactacttcgaaccgaccgtgctcgacctgcccagcaacgc

SEQ ID NO: 1085 - DNA, 200 bp, Mycobacterium paratuberculosis
gaatccggctgcgcaggaggagatcttcggcccgatcatcggcgtgctgggctaccgcgatatcgacgacgcggtcgccatcgccaacgacagcatctacggcctgtccgggcaggtgtacgggaccgacgcggcggccgcgctgcaggtcgcgcgccgactgcgcaccggcgccgtcaacgtcaacaccaccgtcttct

SEQ ID NO: 1086 - DNA, 200 bp, Mycobacterium paratuberculosis
ccgcctacgcgccgagcggcggatacaagcaaagcggtctgggccgcgaacggggtccggacggcattcgcgagttccaggaggtcaagcacatgtcgattggggagttgaaatgagctcagaaaccaacggagataagacatacaacctggactggctgatctcggtcgacgaccacatcctcgagccgccaaacctgt

SEQ ID NO: 1087 - DNA, 200 bp, Mycobacterium paratuberculosis
gggtcgaccgggtcgccgccaaggaccgcgaccgcgccccgcacatggagaagaacgaccagggcgtggacaactgggtctacgacggcaagcgctacccgaactcgggcctgagcgccgtcgtcggaaagtccaaggaggagttcagccccgagccgctgtcctactccgagatgcgcccaggctgctatgacgccaag

SEQ ID NO: 1088 - DNA, 200 bp, Mycobacterium paratuberculosis
gcccgcgtcgaggacatggaccgctcgggtgtgcttgcgtcgctgtgctttccgacgatcacgcggttctgcggccagctattcatggaggccagcgaccgcgaattcgggttcgagtgtctgcagcactacaacgactggctcgtcgaggaatggtgtggtgccgcccccggccgctacatcccgctgatgctgatccc

SEQ ID NO: 1089 - DNA, 200 bp, Mycobacterium paratuberculosis
gatgtgggacccgaaactggccgccaaggagatggagcggatggccgccaagggcgtgacgtccttcgcgttctcggaaaacccggaaccgttggggctgcctaccattcacgaccccgcgggctactgggaaccggtgatggccgcggccaacgaactcgaaatggtggccagcatgcacgtcggctcctcgtcgaccc

SEQ ID NO: 1090 - DNA, 200 bp, Mycobacterium paratuberculosis
tgcccaagatctgttcggacgcgccgttcatggccaacctcacctggggtgcctcccgcacctcgggaacgatgctgtcctggttgttcagcggcatgttccagcgctaccccaagctgaagatcgcgctgtccgagggtgaggtcggctggatgccctacttcctggagcgcgccgaacaggtgctggacaagcagcgg

SEQ ID NO: 1091 - DNA, 200 bp, Mycobacterium paratuberculosis
tactgggtgatgcgcggcgcgaagttcgacacccacgccggcgccggccaggcgatcgacctcgacaccctcgacatccgcgagacgttccgcaaccacatctacggctgcatcatcgaagaccgccacgccgtcaagagtttggacgagatcggcgaggacaacatcatgtgcgaaacggactacccgcactcggactc

SEQ ID NO: 1092 - DNA, 200 bp, Mycobacterium paratuberculosis
cacctggcccgactgcatcggcgtcgcccgcaacaccatgaaggacctcccggagaacgtgcaatacaagctgttgcgcggcaatgccgaaaagctctaccggttcaccccggccgagccccccgtcctggcgagcgcctgatgcccggagtgctcgccggcaagagcgccatcgtcaccggcgccggctccggggtggg

SEQ ID NO: 1093 - DNA, 200 bp, Mycobacterium paratuberculosis
ccgggtgtcggcgctgcggttcgccgaggagggtgcgcgggtggtcgccgccgatatcgacctcgaccacgcgaaagagactgtctgccaaatcgaatcggccggcggcaccgccatcgcgatcgggaccgatgtctcggacgagcaacaggtgcaggcgatgatcgcggccgccgtcgaccagtacggccggctcgaca

SEQ ID NO: 1094 - DNA, 200 bp, Mycobacterium paratuberculosis
tcctgttcaacaacgtcggcatcccgacgccgcggctcggcatgatcttcgaggaccacaccctcgaggacttcaaccgcctggtcgcggtcaacctcggcggggtgttcctcggctgcaagtacgcggtgctgcgcttcaaggagcagggcgcgggcggggtcatcctcaacaccgcgtcggtggccggcctggtgggc

SEQ ID NO: 1095 - DNA, 200 bp, Mycobacterium paratuberculosis
tggggcggttcggtgtacggcgcgaccaagggcggggtcatccagctcacccgggcggtcgcgatcgaggcggcgcccttcgggattcgcgtcaacgcgatctgcccggcggccatgccgctgaccggtttcatggcggcgggcgggctggaggtcgacgcggagcagcaggcggcgatcgccgaatcggtcgggggtca

SEQ ID NO: 1096 - DNA, 200 bp, Mycobacterium paratuberculosis
gcatccgctggggcgcgccatcacggccgaggactgcgccgaggcggcgctgtatctggtctcggacgcggcgcgcaacgtcaccggggtggcgctgccggtcgacggcgggttcgtggcgaaatgaccgctcccgcactggatcgcgaccgactgcgcgagctgttcgacctgcgcagctcctacaacgcttgggccgg

SEQ ID NO: 1097 - DNA, 200 bp, Mycobacterium paratuberculosis
cggcgcatacgaggacgacccgtacccggtgtggcaccggctgcgcgagaaggggccggtgctgcccggcgtcctgcacgagctgaccggcagcaccgacacgatgttcttccacgggctgccgtacccggactgcccgcatttcacggtgttcgactacgactcgtgcatgatcgcttaccgcaatccggaggtgttcg

SEQ ID NO: 1098 - DNA, 200 bp, Mycobacterium paratuberculosis
cctcgtccccggagcccgtcgacctcgagcatggcccgctgggcctgaccaacagcatgctgtcgatgaacggcgaacagcacaagcggtatcgcgcgttggtccagccgtcgttcctgccggcgaatggcaagtggtggattgacaattggatctccgagaccgtcgacctgctcatcgacggactggttcacgagggg

SEQ ID NO: 1099 - DNA, 200 bp, Mycobacterium paratuberculosis
cgcgccgaactcaacgtcgacttctgcgcggccatcccggtgctgaccatcaccggcagcttcggcgtgcccgtcgagcaggccctcgacatccgcgaggcgctggcgcgggatccgcagaaggtggtcgacctgctcaagccggtgatcgccgcccgccccgaggagccgcgcgacgacctgatcagcgtcctcgtgca

SEQ ID NO: 1100 - DNA, 200 bp, Mycobacterium paratuberculosis
ggccgaactcaccgacgaggacggcgccaaggaccggctcaccgatcgcgaaatcgattccttcgtgctgctgttgctcggcgcgggctcgggcaccacctggaagcagatgggcaccacgctgacgacgctgttgcagcgtcccgaactcctcgaggcggtgcgcgcggaccgttcgcttttgcggccggcgatcgagg

SEQ ID NO: 1101 - DNA, 200 bp, Mycobacterium paratuberculosis
aggcgatccggtggatgccgaccgatccgatgttctcccgctgggtgatggccgataccgagctggccggcgtgtcgatccccgccgggtctgtcgtgcacctcgcgctcggggcggccaaccgggatcccgcccgctgggaccgtcccgacgaatacgacatcacccgaaagttcaagccgtcgttgggtttcgggcag

SEQ ID NO: 1102 - DNA, 200 bp, Mycobacterium paratuberculosis
ggttcacacatctgcctcggcatgcacgtagcccgcgctgagatgactatagcgatctcggcgctgctcgaccggctgcccaacctgcggctggatcccgacgccgaaccgccccgcttcgtcggaatgtacgagcgcggggcgaccgccataccggtggtgttcgatgtctgaacccggctacacaccgcccgacctga

SEQ ID NO: 1103 - DNA, 200 bp, Mycobacterium paratuberculosis
accacggctagcatttcttcggtgtcacgtgctgaagaacgggccgcggagcggtcggcggcggtgcagcgttcgcgcgaacgcatcgccaaccaagtcaggctgatgctcgacgccgctctgcggcttattcgcgagaagggcgacagcttcaccacccaggagctggtcaaagaggccggcgtcgcgctgcagacgtt

SEQ ID NO: 1104 - DNA, 200 bp, Mycobacterium paratuberculosis
ctaccgctacttcgccaccaaggacgaactgctgctggcggtgatcgccgacgcgatgaccgacgcgtgtgcccgctggagggacgccgcccgcgacctgcccgatccggtcgcgcggttgcgcttctacgtcaccgcggtcatcgaggtgctcgacaacgagcaaggcgatggcggcaccgctaagttcgtcgtctcga

SEQ ID NO: 1105 - DNA, 200 bp, Mycobacterium paratuberculosis
cgcactggcggctgcaccgcgtctttcccgacgagctcgccgaggccgagaagccgttcgtcgatctgctgctcggcgagatcaacgccggcatcgaggccgggctgctggcgccggcggacccgaagtgggcggcctggttcatcgccgaactggtgcgctcggtgtaccactactacgcctacgcaccgcgcgaggtc

SEQ ID NO: 1106 - DNA, 200 bp, Mycobacterium paratuberculosis
gacgtcaaagagcagctgtggcagttctgtctgaccgcgttgggcgggaccgcacgcaagtcgcgtggtagccgatcgaaatagaggtgcgacatgccccatgcaaaaccggacgagttgcccagcggaggaggggggcggtggccggcggccggcgacaatttccgttcggtgcagtggggcgacatggaggtcgggta

SEQ ID NO: 1107 - DNA, 200 bp, Mycobacterium paratuberculosis
cacgaccaccgggccgctggactgcacgcagctctaccaattcggcggacttcccggcggcgtatgcccttgtccgcactacggatacatcttcgaaggctcgatccgcgcgacctatccgaacaccgactggccggacgagacggcgacggccggcgaggtgtatttctttccggccgggcacatcctgatctatcggg

SEQ ID NO: 1108 - DNA, 200 bp, Mycobacterium paratuberculosis
aacgaaccaaggcgctcgagctgaacccggcgttcgcgttgcagcagtgcatggatgcgatgcaaagggctgggcagaaggccgaacgcgctcagcgggagcgagagttacaagcgtgacaacgtgaacggatacgtgtaggaaccggcgggcgctccatggcaacccgcgtcgaaggaggattgcagcgagccggccag

SEQ ID NO: 1109 - DNA, 200 bp, Mycobacterium paratuberculosis
cgtggtcggatcccacgtgtagacgtcgtgggtgggaacggttgggccgtaatagatgtcgtcacacctcaggccgtcgggaacgtcgaccgtcaagacgtattggccgtcgaccgaccgcgcgtccccgacgtacgggaatgccttggccaccggcctggcgatggcattcacatgcacgcagccgccgcccgggcatg

SEQ ID NO: 1110 - DNA, 200 bp, Mycobacterium paratuberculosis
cggtgatcgcccacagccaggtgtgaaagtcgtatctgccctcgacgtggaggtcgtagttgccgaaaggcatggcggcctgcgcgattggcgggcatgccgcggccgcgaaagccagagcgccggcgagcgtcgaggtcttccgggcgagccgtcgcgcagaacccatgacgttcctcggagatcttcgtttcttacgg

SEQ ID NO: 1111 - DNA, 200 bp, Mycobacterium paratuberculosis
ttcgagaagtcgattctacttgcacgacgcttttttcgatagaaggtgcgggaaagttgctgacatccctgcgcggttctggaatgcttgcggcatggccgtgaccgagttgcgggaggtgccttgcggttcgggggtttcggcccggcgcatcaactgcgcggcctgcgtggccgagctggacgccgtcttcgccggcc

SEQ ID NO: 1112 - DNA, 200 bp, Mycobacterium paratuberculosis
gcaagccgagcggcagccggatgcgcccgcggtgttcgccggttccggcgacctcagctacgcgcagctgcgcgatcaggccctggcggtggcggcggcgctgcgcgcggccggcgccggcgccggggacaccgtcgcggtggtcggcccgaagagcgccgagcagatcccggcggtgctgggcatcctgtccgtcggcg

SEQ ID NO: 1113 - DNA, 200 bp, Mycobacterium paratuberculosis
gcggcgatcctcgagtatctcgaccgcatcggcgaatcgaccgaagcgaccggtgcggtagccgcgaccttgctgcggctgcggcgggtgcgccggcaccgcgccctgctgcgcgcggcggaccgcgccgaactcgccgccggactgggggcgatcgcccgcggcgaggagcacgcgctgatcacccgctcggcccggac

SEQ ID NO: 1114 - DNA, 200 bp, Mycobacterium paratuberculosis
tcgtgcccaccgaagggggaatcatgaacaccgtcaaaaccattgccaccggcgtggcggcgctggctatcgtcgggggcgccgccgccggactggccgccgccgcggcgccgagcgcgccgggcaccgtgcggctcgcggccgtcggcgcaccgcttccgcaggatccgccgccggcacagccggtcgcgggcgccaac

SEQ ID NO: 1115 - DNA, 200 bp, Mycobacterium paratuberculosis
acaagtcaaggtatttcgaccattgaggccatctaaacactgtacctgaccaggtaaaacgtgctgaaacggcaactcagttcagtcaaatatctttgactcagttaactccttcatcgcaacgcgaaggagacacgccgaatgtgcaggcccacgctccactgggacgcggaccacgtgtccaggttgatggagtgcag

SEQ ID NO: 1116 - DNA, 200 bp, Mycobacterium paratuberculosis
gaacatccgtaaccgccgagccctggccaaagcgctcaggcgtcacccctccggggtctatcgtgcgttcgatgaggactggtcgggtggcgtgagcctcgacatcctcgcggccatgtcggtgcgattcaacgtgccggtcggctggttggtgcgcgaccccagggggcggtgatgcccatcaagaggtacccggtcgg

SEQ ID NO: 1117 - DNA, 200 bp, Mycobacterium paratuberculosis
tggtgatcgggtggatcggcctgggggcctacatgatcggggagcacgtgagccacaggtcagaaggggtgaacgaatcgttacccccttcgcgaacagtgcagataccgtccaacgtcgcgaagccgacgacaacggcgacgcccacccccgcgctgaaaatccagccgaacgcgtgggaggcgttcacctatcttctg

SEQ ID NO: 1118 - DNA, 200 bp, Mycobacterium paratuberculosis
cgggcgcgcgggggttgagtatcgacccggccgagaaggactacgacgacaaggccaaccgtcatctgtgctggacgctgttcagcaacgatgatccggcgtttcggcagaagacgattcagggctccattgaggccagcgagggcggtacgtggggtaagccggaagccacctacgccatccgcagcgcgatcatggcg

SEQ ID NO: 1119 - DNA, 200 bp, Mycobacterium paratuberculosis
tactgcccgcagttcgataggtagcccgtgggctcgctatgactcgtcgccccacccggcgttgggccagttcttcctgacacttgtgattgcaaattggccggtgttttccatctccacggtgaacatcgatccgtctttcgcgtggtagaccacgtgggcgcggagtccctgaacatccacgacgacgggcctcaagt

SEQ ID NO: 1120 - DNA, 200 bp, Mycobacterium paratuberculosis
catcccttgccacaccgaacccctgctcgattgctcccagcgccaaaggatttgcattttccatcaggaatcgttcctggggcggtgacccggcggtccacgagaaccgatgcgacagctttttcaacgcgtcatagatgacgttgtacgcaagggcagtgggcaaccccaccgcgaaggcgatcccgtattgagcgagg

SEQ ID NO: 1121 - DNA, 200 bp, Mycobacterium paratuberculosis
ccgccgccggggtagggagtctgcgactcggtgatgacgggcttggtctccgatgtctcggccagcgagttcacaaggttctgaagttcttcgcggaaagcggccgtgtcgcgccgaacaatgttggtaaagagaagggcaacttcggcaagttcaccttccggcgagggggccacaatcgagacgcgcgccgttctggg

SEQ ID NO: 1122 - DNA, 200 bp, Mycobacterium paratuberculosis
ctggtgtgcggccgcggattgggctgtgtttgcagcgtagtagatggcctcgtattcgaccggtgggatgcggcccaggcggtgcatgagccggtcggtgttgtaccagtgcacccagtcggcggtgagcatttcgacgtcggccagccggttcagcggtccgcgccggaacggtgaatccgcccgcaccgcttcggtct

SEQ ID NO: 1123 - DNA, 200 bp, Mycobacterium paratuberculosis
tgtacagccctatggtcgtctcggccagggcgttatcgaaggcgtcgccgaccgtgccgatggacgggaccagccccgacagcgatagggtttccccgaaccgcaccgaggtatattgcgagcccgcgtccgaatgatgaacggtgttgcccaacaatggattaccttcattggatcggagttgcgcggcgtcccggatg

SEQ ID NO: 1124 - DNA, 200 bp, Mycobacterium paratuberculosis
gcctggcgtaggaaccggtcctccttgctggccgagcaggtccagcccacgatccgtcccgcgtaggcatcgatggcgaacgcggtgtagacgaacgccccggaagccagtcggacgtaggtgaaatcggccacaagcaacatgttgggagcgggcactcgaaacttgcgtttcaccagatccgcagcacgtgccgcggc

SEQ ID NO: 1125 - DNA, 200 bp, Mycobacterium paratuberculosis
tggatcagcgatcgtggtgcggaccttcttgcggcgggtgaccccacgccacccgttggcccgcatcaggcgctccacggtgcagcgggccacgccgatgccctggcgttgcaggtgagcccacatcttcgtggctccgtacaacgactccggcttgcgtcgaccgtgctcgtcgggctcgtagtagccggccagcacct

SEQ ID NO: 1126 - DNA, 200 bp, Mycobacterium paratuberculosis
ctgcccttaacatctcgacggtctgctccaactcggcgaccttacgcttgagctcccggttttcccggttggtggccgtagtcaccccgtcacgctcaccgccatcgatctcggcttgacggacccacttgcgcagcgtctctgggccaacaccgatccgagtcgcgactgcccggatgcagccatactcgctgtcgtac

SEQ ID NO: 1127 - DNA, 200 bp, Mycobacterium paratuberculosis
tcgtcgcgatggtccacgaccagacggacagccttgctcttcgttgcttcgtcgtacttcttcggcatgatgcgccttaccttccctcgaaagaaggtgtgcatcaaacacggggcgattcaaagtctgaatttccggggctcagatggccgctgcggcgttttcagccggtgggtggggcgggtttgcacccgcttgtc

SEQ ID NO: 1128 - DNA, 200 bp, Mycobacterium paratuberculosis
ggaccagggttgagatggcgcttaggctgcaccgtccgatgtgacgagttggcgggtcagcacctcaaggcggccaaaatccttattaagtcggtctcgaatttcggtgtatgtctcgatggggtcgctgtcgacgaggtctttccaaagctgagcgactgtccgtatggcatccagagtcgaggaaattccggcgtcag

SEQ ID NO: 1129 - DNA, 200 bp, Mycobacterium paratuberculosis
tggtcaacagccaggctcgaatcgcaagctgttcaaccttattgagctgcggcgtgtgctcatcgcgtacctgcaaggccttgttgaaccgctcattagccgagacctccggccgctgcctatcggttttgtactcgtctgccgctgtcgcgagtttgtatgcggccttatccgtcgcccaacgctcaccaagcaggttg

SEQ ID NO: 1130 - DNA, 200 bp, Mycobacterium paratuberculosis
gcgacctcctcgcgcagtcggtcgttgcgctcggccgcccgatcggcacgcccttcggcccgagtggtgtctagctgctctctgtgacgcttgtctgcgttcctattggtgcaccaaaccccgaccagtccgccgacgaatagcacacccgagccgacaagcccgagtaccggaccaagccaggcccaggccgaagcctc

SEQ ID NO: 1131 - DNA, 200 bp, Mycobacterium paratuberculosis
gttgacgatgtctactggccacggatacacccaataatccacgcacgcatttaaccagtgactaccgacaaacgtcgtggggtatgtcggcgccgacgatgatcggcagccagacgacggggatcagtgcgggacggccatgcggtaaccgcccacgcagccgctgacaccattgatctcgctggtacgccaggagccgg

SEQ ID NO: 1132 - DNA, 200 bp, Mycobacterium paratuberculosis
gaccgtgggcactgtagccccagccggtcggtggcggtcgacttgccgcataccgggcagggggtggcggtcgcgcttgggttgctggaaccgcctcacggcaccccggccagatggtcgaagcgtttttgcagatcggcaagcacttcatcacggcctgcggtgtcgcggccgttcaactgatcgacgtacttgccttc

SEQ ID NO: 1133 - DNA, 200 bp, Mycobacterium paratuberculosis
tcgcccctgcgtcgggatgactattgccgccatgcgcccaggaattgggctagttgctaccaccgcaccactgaacatctcgccggtcggtaccttttccatcgcgcaatacagccacggatgaaactcccaccgcagcttacccacgatggtcactcctcgtacttgatgtaagttttcgtcggacaggcgtatgtaag

SEQ ID NO: 1134 - DNA, 200 bp, Mycobacterium paratuberculosis
gtggtacgcggctttcttgattgcgggcttgtaatagccagaggtcgaaacgatagcgcgatgggtcacgccgggcatatcgttaagcttcgcagcgagttgttcaacgtgagattcgttgagcggcttcttccaatgctttacctcgtagcccataaatgcgtactccccatctggggtgtcgagggtgacggtcacat

SEQ ID NO: 1135 - DNA, 200 bp, Mycobacterium paratuberculosis
cgacatcgcgaggctcgccggacgcctggtctagcaccatgtcgccgagaaccacctccttcacagacgcggcggcgccccatttcaatacacacaggccggcgaggtactgaacaagcattggcgacaatggcaacttttccttcggcgacatgacgccaatgttaggtacctactacgacacgctcccgtaaaagtcg

SEQ ID NO: 1136 - DNA, 200 bp, Mycobacterium paratuberculosis
cggtgcgggctgtcgggccgtcgctggtttggctctactgcaacatggcgggcgcggttttactcatcccaagagttggaacgccatacactgcttcgcgtgagtcagccgagcgagcagccctctgggcgcccgtccctggagagtctggttcgttctgcagccgatccgctggcagcaagcactgccgttgcggcggt

SEQ ID NO: 1137 - DNA, 200 bp, Mycobacterium paratuberculosis
agacgcgctgaatcagtcagaccgcgccctttcacggctattggagaatgaatcgatagcgtcgtcaccattcaggaactccgcgttgcgcccagcgaagcgcaaagcggcggcgcttcgccagcttctccgtgacgatctgtcaattcacccgttcaacgtggtcagcgaacatgatctaccgaaccttgaatcgatta

SEQ ID NO: 1138 - DNA, 200 bp, Mycobacterium paratuberculosis
gtgtgcctttcggtgcgctaattccgcgtgatcagttaaatattttgatggcccaatgcgcgtcaatgaattaagtgctgagaacgccagccgcaagtttttctgcattcgaaagtactatttcaggatttctgaagtatctagatgaattcagtgagaattcggttaagccggcgctagacgttttggatgggctccgg

SEQ ID NO: 1139 - DNA, 200 bp, Mycobacterium paratuberculosis
cagcttcgggacgagtaccacatcgagatcggtggtcaggcgctagacgcagcactcgcggatcgtcgccgtcaacttttggattcgtatgtcgagttgcttgaaagcgtcctgagtgatgcgcagagtcgcactcaaaggctcacagaggatgaacaggctgttgaaaaagccgtatcgcggaagggccgtcagcgtct

SEQ ID NO: 1140 - DNA, 200 bp, Mycobacterium paratuberculosis
ccaacgagacttcgccaccatggtcaaccgtgagacttggtgggcggcagggtggacggtaacagcgttcttgttgacatgcactgctatcgcgatccccgtcgtactgttttcacggggcgtacagtttcccgcagttaccggcttgtccgcgacgctgattaaggcattcattgggattccgctacttgcattcgctg

SEQ ID NO: 1141 - DNA, 200 bp, Mycobacterium paratuberculosis
cctactgtggcaaaattgcgtcccagcaccgagacacggctcggcacatgaacatcttggtgacacaaattgactcagtgagtgcttacgtaactgatctacccgccgaatcaaaaaatgagctcaaggtgattctgggcaaacgagcgttttcaacccctgaccttgattccggcgccaaggcagagtctgagcctagt

SEQ ID NO: 1142 - DNA, 200 bp, Mycobacterium paratuberculosis
tcgggagaagttgcgctgctgctgtcgaaggctctggatattctttcgaaattcggtgagaagtagtcgcggttagtctaagcgaggcatccggtgcttccatgcccaggtgtcatcacgaaacgctgtatccgtgcccttggcggttcatcgcgggcgaaggcgataaggcgatcaagctcggtatcactgagtacgag

SEQ ID NO: 1143 - DNA, 200 bp, Mycobacterium paratuberculosis
ccgccccaggatgtacggcaccgtctcgcggcacttctcgcacgtccagtactcgggccagccgtgggcggcgaccgcgatcaggtgagcttggctgaccttctcgcgccggccatcgcgcatttgtacgcgcacgaaaccgtgccgggtggccactacgcgggtaccgtgccggatcgcgctggttgtgccccgtgaag

SEQ ID NO: 1144 - DNA, 200 bp, Mycobacterium paratuberculosis
atcgcgctgccaccgctgcgacgccattggtagaccggcgcgaccgcctgggcggggttgttgggattctcaacctttaagtcatcccagattttttcgttcgtcatttccttcgttcgttcaggatcgcatttcaaagaatgagtgtgcgtatgcacacaatgctggatcacggagcggaagcgcagtgatcctgccct

SEQ ID NO: 1145 - DNA, 200 bp, Mycobacterium paratuberculosis
cgcctttaggcgagcctcttacgtaccgagtcggtacagtgagtcagcctggaaagggaagacaattacccaagtcgtgtagtgacgttgcgttctcgaatcagacgttgcattgtggtctgttcgcgcggcctgtcactgaccgtacttcggcggattctttcaagaatcgaagattcaaagaaccacaatcggaactg

SEQ ID NO: 1146 - DNA, 200 bp, Mycobacterium paratuberculosis
tcacgttctcgcactctccatgccccgcacttctggggtacggctgggtctagagactctcacctagcggtgagggtttcgccatctcgctgcgctcaatggctcacaaggaatagaccctctacttataaggacacttctgggcaaaaacgtgaatgttgaaatcgcatttccccaggtcgccccaaaagcgtgtgacc

SEQ ID NO: 1147 - DNA, 200 bp, Mycobacterium paratuberculosis
aacctcacattgacaggtggcccgcgcatcccggaggccatcacgccgcctcccgcgcggcgacgatggtggcccacaggttgtcggcagtgtcgcaacaatccaacaggtcttcgcgtaccagctcgcgacccaaccggtcctaaaaacagctcgcacacaaccagccctgcgtgggcgggccgtagatgcgccacagc

SEQ ID NO: 1148 - DNA, 200 bp, Mycobacterium paratuberculosis
tcgtcactcacccggtaacagtcggcacggccgccgcaccacttgcacggccaccatgcgccccggtcgtctgctatcgcgccagtctcgtcatcccggccggtccggtagccctcgcagaaggcgtccacccagccgccgtcatacccgtcatcccagccgccgacgtagccctcatcccaccccacgtcgaagccgat

SEQ ID NO: 1149 - DNA, 200 bp, Mycobacterium paratuberculosis
gtcacggccatcgttgaggccgtgggcgtagtcctcctcgctcacgccgccaccccgtcccggcgacggcgccgggactcgacggacttcaacgccatcttcttgaagtgggccgcgcgggcgttctcggccatcttggcgcgcagggcggggggtagcttgccctcgggatcgacctgcttttcgaagcggtcccatgc

SEQ ID NO: 1150 - DNA, 200 bp, Mycobacterium paratuberculosis
cgccttacgggcgttatgcgttcgcgcggaacggttttcggtgcgcgcccagctctcgtgaacggcgacctgtaagcgcaaacggcgctcagtagatgttgacacttgcgtactcctggcatccttgatcaggcccccgagatgccaactcgcccaagggtggacgaatctgccgggtggccaatgtgatcaaggcacgc

SEQ ID NO: 1151 - DNA, 200 bp, Mycobacterium paratuberculosis
cccaaagtgggggagctacgctgtacgcgcctttaggtacggctgcaaagctacagcgttgaccagccgtgctcaagcggaaagtgtcacattccccaaagtcgcagtaacactttggaaagtgccagctcagatatcgcccaagttgagcctgcgggcctcgtcggcggcaaggctggcggcagcggcgccgacgtacc

SEQ ID NO: 1152 - DNA, 200 bp, Mycobacterium paratuberculosis
tgtcaatcatgctgcggttcttccacccggccacgctcatcagccccgactccgacccgccagcgcgtagccagcgggtcgcggcggtgtgcctgagcatgtgcaagtggaaggtctcgatgccggcggcggtagcgcgctgcttcaatgccttgctcagcccgtagtaccccaggctcttcccgcccccgcccagccac

SEQ ID NO: 1153 - DNA, 200 bp, Mycobacterium paratuberculosis
agcgccccggtgttggacagccgatgcgcacgccgtgcccgaaggtagcggtcgatggcggtggcggtctgcacgctgaagggcgatacgcggcccttgccgcccttgccgcggacaatcgtcacgatcccggcgtcgaggttgacgtcggtgatctgcaggctgagggtctcattggcgcgtagtccggtctcggccat

SEQ ID NO: 1154 - DNA, 200 bp, Mycobacterium paratuberculosis
gaggcggactatcgtctcgtcgcggcggtccattagggatttgccctggcaggctgcgatcagccgtttgagctgatcttcggtgagggcgttgaccaccttctggtcacccttgggcggtttgagtcctagtaggggatcggagctaagctcgccttcatcaaccagccatttcgcataccgcttcaaggcgaggtccc

SEQ ID NO: 1155 - DNA, 200 bp, Mycobacterium paratuberculosis
cagggcgaccggcagctcggccgccgcgagttgcgcggcgacgtccgcggcgagctcctcggcgttgccggtctgcgacgcccacaacaccacgaccggggcccgctcgggcgcgggtgtggcaccggccggcgcggccggtggctgctgggcggccggctggggcggctcgggcagcgccgcctgctgggatgcgtcgg

SEQ ID NO: 1156 - DNA, 200 bp, Mycobacterium paratuberculosis
gtagctgcgttcgtgagcgcctcgcccagccgaggccctccttactccgcaagtccgaggaagactaggagcgccatgtcgagccgaacgatgtctccgtccggtagccggccgacccggcgggtcaggctggcgcgcgggacggttgtgatcttatcgatcatcagccggctggtctccgccaagccggttgtctccga

SEQ ID NO: 1157 - DNA, 200 bp, Mycobacterium paratuberculosis
acggcatcgacgaaggcctggtcgtcacgatcctgttcgctggcagccacgagcgccgattggcggtgcgcttctctgacgaactccgtggcgttcacatcgggaacccagagctggatcggccgcaggcctcgttggcgcagccgttccctgtgcctgcgaacgcgctcacgaccgagtgacattcgctcatgtaacgg

SEQ ID NO: 1158 - DNA, 200 bp, Mycobacterium paratuberculosis
tcgcggcgaaggcggccgtcaccagaccccacgtgtgcgcatgggcggcggcgtccccggcgacgtagcgagcattcagatcgtcgaatgcggcctcgatgtcgtctgggtcgtatgcgacgcgtgccaggatccgtttgtcggcggaggtttcgacgatgatgagcatgtcgatgtggaatcctccgggttgctgatct

SEQ ID NO: 1159 - DNA, 200 bp, Mycobacterium paratuberculosis
tcaccccggatacaggtccggcagaggactaggcgttcacctcgagtcgcgatgaccgtcgccgtactcctcgtggccccaagaccggcgaaggcgcgcatgttcgcgatttcgacgtcccggccgcgtcgggtctcggcgctcacgactcgtcggtggtcgtcgacagttgtctcggccgtgagaagtctcgccatggc

SEQ ID NO: 1160 - DNA, 200 bp, Mycobacterium paratuberculosis
gtcccagtcgcgggcggcaaagcaacttcggaagcgttcgtacgtttggctggccgcgttttcgagccgaccggggtgcgggtgcaattcatcgaacctcgcgatcgcggcgtcgacgtccgcctcgtcgaagacttccaaccggtcgaccagatcgcggtcgaccgtgataacggcgatactgcgccactcggctttaa

SEQ ID NO: 1161 - DNA, 200 bp, Mycobacterium paratuberculosis
agccctctcgtgaggtttcgtgcgataccgtactgaacacggctccaaggctgtccagccggtgcacggcctcgacggcgctgctcacatcggatgcgagttgccattcggccagcaatgcgggcagtccaccgggcgggaacgacgacgcatgccggtggtcgatagtgacccaatctgacgtggtcggcggcgtctcg

SEQ ID NO: 1162 - DNA, 200 bp, Mycobacterium paratuberculosis
gtggtggtaccgccactccgcgtcgaccccttctggggaggtcccccgcgcgacgtgtgtgacgagcgcgcccatgtcgttcagccgatgaaccgcgtcgatgtagctggtgaggtcaggcgtgtcgtcccatgccgcgcgcatgtaactgaacaactcacccggtgcgaacgcagtcccgcgccggtggtcgatgctca

SEQ ID NO: 1163 - DNA, 200 bp, Mycobacterium paratuberculosis
gggctggggctggagcgtcgaactgaatcaatgcgtgttcctgctgccggccgcgaacggacccggcggacccgggggaccgggagggcccggtggaccgggcggacccggcggacctggagggccgggcgggcccggcggaccgggcgggcccggcggacccggagggcccggcgccccggggcatcccggcccgcact

SEQ ID NO: 1164 - DNA, 200 bp, Mycobacterium paratuberculosis
aagtagccacgttgggagtccccatgccagggaccacccgggccgccggggtgatcgggcccgcccggcccaccggggcggccggggtgatcgggaccgccaggtccacctggtccaccagggccaccgggatgaccggggccgccgggaccgccaggcggcccaccgggcccacccggcccgccgggaccgcccggtcc

SEQ ID NO: 1165 - DNA, 200 bp, Mycobacterium paratuberculosis
gcgcctgggctttggcgcggcttcgatcacggtgggctggctcgggcactgtcggccgaacggggcttcgaggtcatcaccgtcgacctggcggcgccgccggccgccggtgcgctgcgcctgcccggcgccgatcccgattccctgccggcgccgccgcaatccgccgacgaggcgcgctggatctactactcgtcggg

SEQ ID NO: 1166 - DNA, 200 bp, Mycobacterium paratuberculosis
acaccaagtcctggcagggagcggtagatgtcggcgtccgggtgtgtctcaaaatgtgttgccagttcggcctcaaggtcggtgatctggcggttcagttcagcgatgatgccgaccgtggcgcgggttggttgcgccgaacgcggcggtgaccgcggcaggggcggcgagctgctcagcgcgtaaagcggtttgaatgt

SEQ ID NO: 1167 - DNA, 200 bp, Mycobacterium paratuberculosis
gttggtgtgccgattgcgggtccagatcagattctgatgtgcccgggccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccg

SEQ ID NO: 1168 - DNA, 200 bp, Mycobacterium paratuberculosis
ccatcgggttgatcgcatacacctggtaatcggccgcggtgagcgcctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcagg

SEQ ID NO: 1169 - DNA, 200 bp, Mycobacterium paratuberculosis
tggacgtcgtgatgatcctccgcccaatcgtcgccgacaaatatcacgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggcca

SEQ ID NO: 1170 - DNA, 200 bp, Mycobacterium paratuberculosis
cagtaggggcctcgacgccgggcggcgtcgggcagggccggttcggtccgacttgctgcgggaaggttgccatgacgagccatcgcacggtttttaatcacgttgggttatgcgtggcggaccgggagcgctcccgccggttctacgagggcctgctggggttccagttctggtgggagatcgacccgcccgacgatcgg

SEQ ID NO: 1171 - DNA, 200 bp, Mycobacterium paratuberculosis
accgctcagctggtggggctgcccgagccgctcggcgtgcatgcgacgtatctagtgcgcgacggcctagtgctcgagctgatcgactactccaagcgctgggttcatgccggctcgcagcgggcgatggatcagatcgggctgacgcacatctcgttctcggtgtccgacctcccgggtgtgttggcccgggtgcgcca

SEQ ID NO: 1172 - DNA, 200 bp, Mycobacterium paratuberculosis
agcacgtgcggtgcagagtcgcaggggcgaatgcgttccagtcacacgccggtacgcgaatggcggtggagttgagttcactcttcgctcgctgcttttctgtcggaccatcaaattagttgtaagcggtacttccggcttcgggatgcgtcgtgctgacgagcttggcggcgcagtgatctcggtcaaacccttggaac

SEQ ID NO: 1173 - DNA, 200 bp, Mycobacterium paratuberculosis
ctgcaccaggccaacgggccagaggagtcggcgaaggtaaggccggcaacggtaacccagaagtccggcccggaaaaagtcgaccaatcacccgaccaaagcaactttacgttgggataccgctgcctcagctgcaagtgctcccggagagtcattgcgttgtcccacacaacaccattgtctacgacacccggacgttt

SEQ ID NO: 1174 - DNA, 200 bp, Mycobacterium paratuberculosis
ggagctaagttgtggaacccagcggtcggcgagttgcgcgcgaacaaacgcgcggtcgtcattggcgatctggtgtagctgctgtgtggcgtcttgtggtgccgacgtcggcgtgctgggtaatcgggccggctcggtctcataggtaggcacggggttggtataggaaacaagcggtgaggttgatggctccgaggtgc

SEQ ID NO: 1175 - DNA, 200 bp, Mycobacterium paratuberculosis
ttgaatttcgttgtgtggtaaggccaatgaccagtccggtgccgccgaccaagagcgccaccgcgaccccaacaatggtcagcaccatcaatttcttcgagccgccttggtctgcgtcggtagcacttaccggacctgttgcgggataaggatattgggcagcgaacggcggatagctagaaggcgcactgacgtattgc

SEQ ID NO: 1176 - DNA, 200 bp, Mycobacterium paratuberculosis
ggcgccagcagtgtattggtgccggccgaagtggccggatcgggagccagcgcgcgctttgccgcgcgtcctaaggccccagcactcccatagcggtcatctggatgtttagccatgccgcgggcaatgacatcgtcaaacgacgccggaacgtgcggattcacggcactcggccgcggaggcggtgacgacagatgggc

SEQ ID NO: 1177 - DNA, 200 bp, Mycobacterium paratuberculosis
gcggatggcctgctccgcgctgtgaaccggaaacggtttcgcacccgtgagtgcctcgtacaggacgcatgccaacgcgtagacatccaccgctgaggttgtttcctcatcaccgaatcgttcaggcgccatgtagtcgaaggtgccgactgtgtgccctgccatggtcaggtgcgtatcacctctcgcttccgcgatgc

SEQ ID NO: 1178 - DNA, 200 bp, Mycobacterium paratuberculosis
caaagtcgactaagtatgcgaagtcgtctggcgtgacaatgatgttctggggcttcacgtcacggtgaatgaggcctgcggcatgggcagcgtccaacgccgatgcgacctgccgaattatgtcggtggcccgccgcggctcaagtgaacccgtcttgagcatttcgtgcagtgtttgaccctggaccagtcgcatgtcg

SEQ ID NO: 1179 - DNA, 200 bp, Mycobacterium paratuberculosis
ggtcggggccgcgttgcgggtggcgcacgcggacgccggcgcgacgttcaccgcaccggccgcacccgccaccgccaccgcccgcgcggcggcacggccggagccgcgcgcggacgcgaccgcgaccgccgcggtgccgccggcgaatcccgcaccgatggcggtgcaggcctggtcggacaccgggaccgacgccgcgg

SEQ ID NO: 1180 - DNA, 200 bp, Mycobacterium paratuberculosis
cagccgtcgcaccagcggtgtcacgtagggggtgccctcgccgccggcggccggctgggcttgcgccggttgggctttcggctcgggcgccggctgggcttgtggctgtggcgcgggctgcgcctggggttggggtgccggttcgggtttcggttcgggcttgggggccggcgggggttggggcgcggcgggggcgggcg

SEQ ID NO: 1181 - DNA, 200 bp, Mycobacterium paratuberculosis
gtcaccgactcgcccagctcgggcatcagcaccggggtggcggcgccgccaccggactcctgtggcgccggctgggccggtgcctgcggctgggccggggcctcgggctgggcctgggccggttcctgggcctgaggctcgggctgggccggtgcttggggctggctcggctggctgggggcctgcgccccgccgccggc

SEQ ID NO: 1182 - DNA, 200 bp, Mycobacterium paratuberculosis
gcgtaaccgggttctgtgctcatccgcatcaccctaacggtccgccggtcgcggctggctagggtgagaagtcagtgtcagggtgaggttgccgcgtgttgcggtggttggatcctgatcacctggtgtctggctcgtagggtgcttgccgcgttggggttggcgttcatgcgttttgtcgacgccaggtgtgaaggacc

SEQ ID NO: 1183 - DNA, 200 bp, Mycobacterium paratuberculosis
ggggcatgccgaggcggtgatgtgggcccgggaacgcttcggaaccgaggtggtgtgggcgatcgaggattgccggcatttgtcggcccggttggagcgtgacttgatgggctttggccagtcggtggtgcgggtgccgccgaagttgatggcccaaactcgggcgagtgcacgcacgaggggtaagtctgacccgatcg

SEQ ID NO: 1184 - DNA, 200 bp, Mycobacterium paratuberculosis
  misc_feature (1)...(200): n = A,T,C or G
atgcgttggcggtggcgcgggggtttttgcgggagcctgatctgccggtcgcttctcatgacgaggtttcgcgggaattanagttgttggtggatcgtcgcgaagtccctgtggcgcaacgcactgcgacgatcaaacccggctgtgtggcgggtgcacgaactcgatcccgaccacgcacctaaggctggttcgctgga

SEQ ID NO: 1185 - DNA, 200 bp, Mycobacterium paratuberculosis
tctggccaagcatcgccgcatcctgggtgactggctggtcacggtgcccggcctggtcgccgaactcgcccgtgacgagctggccgacatcacccggctcaccgagaccatcaacgcgttggccaaacggattggcgagcgtgtccgcgttgtggccccggtgctgctgtctcttcctggctgcgcggagttgaccgcgg

SEQ ID NO: 1186 - DNA, 200 bp, Mycobacterium paratuberculosis
tcgccgacacccacggctggatgacccggctcggctgatttgcgggctcgcggcctgcgggcgccggctgcccgcgactgtcggcgccccgcccgcgactgtcggctcgcccgcgactgtcggctcgcctgcgagcgtgaagttagtttcacgctgggctccgaccgtgaagctagtttcacgctcggcgggttgctgag

SEQ ID NO: 1187 - DNA, 200 bp, Mycobacterium paratuberculosis
ctccggcgcggccgaacagctgctcgcgcgttgggtgcggttcggtcagcagctctgacgcccgcagggcctgctcgcttgccagccgggccgagcgcgccgccgccgcccacgccgcccaggccccggccgagcgcagcggggaggcccagcccgccgcgtccggggtgccctttacccggacgatgcgcacccccggg

SEQ ID NO: 1188 - DNA, 200 bp, Mycobacterium paratuberculosis
gacaccctggccgcccggctggccgggctgctgggcgactagcggcggccagcgggccgggccgcgccgcggccgtcacgcggggcctcgagcgtcacgccagcgtgacgctcgcgcgccggcgccacgccagcgtgacgctcggcgccgaagagccgtcagagccgtcagtccttggcgtagatggcctcgaggtcgga

SEQ ID NO: 1189 - DNA, 200 bp, Mycobacterium paratuberculosis
gtgctgaccccgcacctgtccggcgagccgatcgggcccaaggcgctgggggcgctgctcgacgccgcccggcgccggggcggggccgcgccgcccggcccgctgcggcccaccgtggacctggaatccgggacgggacttgggtcgatctaccggatgcggctagcgttgccgcaactcgacccgtcggcgctgacgtt

SEQ ID NO: 1190 - DNA, 200 bp, Mycobacterium paratuberculosis
cctgcaacgaacgcaagcaccgcaggcgaccgggaaaggcgattgatgagagcagagcgcgagacggcgaaacggcgcggcggcagcgatcgtcggggcgcccgcgacggtgccgcccgccgcggcaggcgtccggcggccgacgccggcgcggcgcggcgcgcccgcggtggccgggcctcggcgcccgcccgggaatc

SEQ ID NO: 1191 - DNA, 200 bp, Mycobacterium paratuberculosis
ccgtcgagcagcaccagtggcaatcgcatgccggttatcttgtcacgccgcgtgttgccaggccgtcgagcgtcgagttgttgcggcccgttctcgcttaccttctagcgctggatgcaacagcctctagctgaggggttgttgatgaggtcgtcgcggtatgccgttgtgggtcgtcggttctgggaattggtgcgggc

SEQ ID NO: 1192 - DNA, 200 bp, Mycobacterium paratuberculosis
cggaatgtctgcggatgacgctggggtggctgtcggcgtgtcgatggccgcagggcggctctggtttgctgatgctggcggagtgagaccacgattcgttgaccagtccatcccgcgacggcgtcctcggttgacggtggaggaacgcgaggagatccaagacggtgtggctcgcagcgagtccatccgtgtgatcgctc

SEQ ID NO: 1193 - DNA, 200 bp, Mycobacterium paratuberculosis
gccgactgggccggcatccgtcgacggtgatgcgtgagatcgagcgcaacgcgatctgtcgtggccggtatcgggcgcggtatcgattcggggtgcgctggcgtggtggtcacgatccccggccgcgatatcgcgccagcttggcgcacacgcgtgcgcacgttaaggcgcgccgttcgcggcccggcaagctggcgacc

SEQ ID NO: 1194 - DNA, 200 bp, Mycobacterium paratuberculosis
aatcagctgctccacgacgaggtacagacgcggttgaatgagcagcacagcccgcagcagatcgcttggcggctgcggcgcgactttcccgacgatgcggagatgtgggtgtctcaagagacgatctatcaagcgatttacgttcagggcaaagggaatttgcgacgtgagttgcacacctgcttgcgtaccgggcgggc

SEQ ID NO: 1195 - DNA, 200 bp, Mycobacterium paratuberculosis
cctgcgcaagcctcggcgtcgtcctggtgagcgtcgcggacacctgcgcgacatggtcaacatcagcgagcgcccccctgaggtcgccgaccgcgccgtgcccggacactgggaaggcgatctcatcctgggtagcaccgcgtcgggttcggcgatcggcacggtggtcgaacgaacgacgcggttcgtgatgctgctac

SEQ ID NO: 1196 - DNA, 200 bp, Mycobacterium paratuberculosis
aacaccaacgggctgcttcgccagtactttgccaagggcaccgacctctcggcgttcccggccgactatctcgactacgtggcatccaaactcaaccgcaggccacgacagacactcgactggaaaacaccagccgaagccctcgatgaattactctgcaaaccgttcacaccaccggctgttgcttagagcgctagaaa

SEQ ID NO: 1197 - DNA, 200 bp, Mycobacterium paratuberculosis
agcccccgcggctccggcgggcggtcctggtggcctgggtggtgtccatgatccggcgcccgcgccagcgccggccactcctttcggaggctctggtggtccgcatgatccggcggccgagcccgagcccgcggcagcccccgccgcttcgggcagcccgggcgatccggcgtccgtgccgtccggcggtccgcacgagc

SEQ ID NO: 1198 - DNA, 200 bp, Mycobacterium paratuberculosis
cggcggcaagccaagtggtgatggggacggccatggcggtccaccggacggcaaggatcctgatggtcatcacgtgtcggggcacggccatgatggatcatccggcggcgagccgcaggatccagtgcattcgaaggatccgtctggcgacgggtggcatcggctgccagatgagccacttgacccgcattacggcgaac

SEQ ID NO: 1199 - DNA, 200 bp, Mycobacterium paratuberculosis
cattggacgagcattgggatttcgccgacgacccggtcgatcttgacaagattaatagcgacgtccgcaatctaattcgggatccggaagcgctatacggccgagatccggaggggcatccgtatacgcaagagcaatacgcggaacgtttcaacagcatgggcagtgaaggtcaacattggatgagctttcccggcaat

SEQ ID NO: 1200 - DNA, 200 bp, Mycobacterium paratuberculosis
cacggcgctgtcccgcagacgcgtgtcgcttacacggatgccgcatcctacttgcgggattatggtcccttgctcgatcgcatcggcaagacaaacggaaagtacttggcagttatgcaggatggacaagcggcatcatgggagcagcgagccctccacgtcaactcccttcaagatccctaccacgcttatacctttga

SEQ ID NO: 1201 - DNA, 200 bp, Mycobacterium paratuberculosis
acacctaccggacaattggactatcgaagtgtcggaggtcgcgcctggggtgggtcaaccgggtggttccttgcaggtacgcgtattcaactcagagggtcggccgatgacggttgaagagctcactgagcctgacattggagtgttgagatgacaagcggcatacaactttcccaacgccttgaggaatgggcgaagct

SEQ ID NO: 1202 - DNA, 200 bp, Mycobacterium paratuberculosis
gccgggcccgccgagctgcgccagttgtgcgacgcgctgatccaggccgcccgagccgccgacggctggcgccgcgccggtgtgtgacagcctcgtgcctgccgcgccgcccgcgccggctcggcggccgaaccggccgcgacccgcgcctgaccatgcacgacgggcggccgggtacagtcgcgccatggaccaggggc

SEQ ID NO: 1203 - DNA, 200 bp, Mycobacterium paratuberculosis
gcggtcccgcccgcgcccgctgaaggccactacatcgcccaaagcctgttccgctgagcaaattccgccgcgcggcgcgcggcggtaaccgcgccgccggtggccggcgccgatgtgggccggctcaccgccgcagcaggccggcccgccgtcacgcgtcggcgcccgccgagcaccaactccgtgaagccgcacaatca

SEQ ID NO: 1204 - DNA, 200 bp, Mycobacterium paratuberculosis
ccgtcgggggcaaagccctcggcggccaccacggacagggtgtaggccgccagcgccgcaccggccagcagcacgggttcggcggcgcgcgcgggcagcggcacgccaagcagtggcagcggcgcggcgaaaagccttcgggcccaccacaacagcaccatttcgaccgccgtcaccgcgctcaggacggccacccattc

SEQ ID NO: 1205 - DNA, 200 bp, Mycobacterium paratuberculosis
ccggggattgtcgagggccagacgcagtcacgctcgagcacaagcactttcaggccaagccggccgagcaggttggcggcggtcgcgccggtcggcccgtacccgatcaccgctacgtcatagatgtctgaagtgggcacggtcgtctcgcatcgtcgagtgcttgtcctgtagtgatcgctacggtgatgtagtgatca

SEQ ID NO: 1206 - DNA, 200 bp, Mycobacterium paratuberculosis
ctacggagtcaagcaccccgggtgaggagagcggagatggcggccacgaagcagccgaaacggcgcaaacgcgccgacggtgaaatgtcgcgtgaacggatcctcgacgccgccaccgagatcgccgccgagcgcggttatgaggccaccagtatcgggctggtcagcgcgaagtgcggcctgcccgccagctccatcta

SEQ ID NO: 1207 - DNA, 200 bp, Mycobacterium paratuberculosis
ctggcatttcaaaaacaaagatgacctgatcgccgcggtcatcgagcgcagtttcgccgactggcgcaaggcgtggcaggttcccgacgaaggcgccccacgcgaccggctggccgggctggcgatgcagatcgccaaggtgctgatggactcgcccgacttcatccggctcgggctgatgctggcgctggaacgccgac

SEQ ID NO: 1208 - DNA, 200 bp, Mycobacterium paratuberculosis
cggtcgagccgcgtgcccgcgcgatgttcatccaggcccgggcccaggcctatgacgagcttgccgacatcgtgcgcgaactcgccccggggctcaccgacaagcagatcgaccaattggtcacttatgcgatcgccggcgccgatggattgttcatcgccagggagatcggtggcgatgcggtgaacctggtggggctc

SEQ ID NO: 1209 - DNA, 200 bp, Mycobacterium paratuberculosis
ttcgagctgcacgccggagcgttgtacgacgcggcgctgcggatgatttcggagaatgccggtcaatgatgctgaggcataacgcgatccgcgaggcggccgatctgctacacgacgcgcagcgcacccgcaggccgatcgggccgctcaccgaacgcttccccggcctggacgtcgccgctgcctacgccatccagcag

SEQ ID NO: 1210 - DNA, 200 bp, Mycobacterium paratuberculosis
gccaacctgaatcgccggaccggggagggccgcctggtggtcgggcacacaagctggtcttcgacgccacctccgccaccgcgcatcgtgccaactggtccaaactggtcagcagtgggcgtgcgcgacgacgcctgatcgctggggaccgcgacttagaggagcgatacggccacgccgacgctggccgggctatcaat

SEQ ID NO: 1211 - DNA, 200 bp, Mycobacterium paratuberculosis
ccggccaagtcgacgagccggcttcgatcgctggcggatgcatctgctgcctgcccgacggcggtgggctcgacgaagcactcggcaagctcgcggacccggctctacgcctggatgccatcgtcgtcgaggccagcgggttggccgacccggtggcgatcgcgcggctcatcgggttcagcgaaatccgtggggtccgt

SEQ ID NO: 1212 - DNA, 200 bp, Mycobacterium paratuberculosis
ccgggcgggttggtcgacgtcgtcgacgccgtgaaccacttcgacaccgtggatcgtggcccgctgccgccggtacgctacggtgcggcctcgctgatcgttgtcaacaagctcgaccaggtgcccgagcgagaacggtcggtcgtggtgcaacgcgttagagaacgtgcggcgcaacgcaatccgcgcatacatgtggt

SEQ ID NO: 1213 - DNA, 200 bp, Mycobacterium paratuberculosis
gggcacaatcggaggtcggatagccccggagctgctcttcgacgcgtccgccaggcctgagcagattgggcagctgtcctttgtggacctggtgcccgagcacgagcatgaccacgtccatgcggacgccgtcaccgcccacagcgatggctgcatcgaccccgatgccctcctcaaccttctcgaaaacccaccgccgc

SEQ ID NO: 1214 - DNA, 200 bp, Mycobacterium paratuberculosis
aggtgttccggatgaaaggcgtcgtggcggtgcggcagcgcgcgaccgtgcggaactatgtcgtcaacctggtgggtagcgcaatcgacatcgccaaggcgccgccgaaggccacggccaaccgtctggtggccatcgggatgcatctcgacgtcgccgctgtgggggcgcgactcgatcgcgcgctgcagccggtctac

SEQ ID NO: 1215 - DNA, 200 bp, Mycobacterium paratuberculosis
ggtccggcgtcggggcaggcgtcgcggcggctgcagcgatacctgcggctcagcgcctgagaggcgatccggcaagatacgtcgtgatgtcatcttcgctcggcgacgtgctcgccaccttggagctcgagagggtcggccagtggcgcttcgtcgggcagcagcttccggcgcccgccaatcatattctcggcgggcac

SEQ ID NO: 1216 - DNA, 200 bp, Mycobacterium paratuberculosis
gagggcgaagcgggcggccacctccttcggtacgtgctgcccttcggggatcagcgcggacacgccggcgacgctgtcgggagaggacatcagcgaagccgatccgggcgggccgtaggacggcaccatcaccggcggacgtccgagccgggcgccgatggcatcgcgcacggcgagggcggtgaccttgaccgaactca

SEQ ID NO: 1217 - DNA, 200 bp, Mycobacterium paratuberculosis
ccggtgggatggcgaatgaggaggcgaagccgtcggtgaatgggcactgcgagatcgcggcggcgatgcgcttgtcctgggcggcggtgattatggtgtggccgccaccaaaggaggtgccccacaccacgactcggtcggggtcgatgccatcgagggtccgcgcgtaggcgacggccgagcgccagtcctgcagttgc

SEQ ID NO: 1218 - DNA, 200 bp, Mycobacterium paratuberculosis
ttgtcgatgtcgagcagttggcgcggttcgccggaactcgcgccgaagtggcggtagtcgaagaccaggcagacgtagccggcagcggtgaaccgctccgcgaaggcatccagccgcatctctttgacccccgcaaggccgtgcgccatcacgatcacgggccgtcgatcgtctgcggagtgcgaggagggtgtgtagag

SEQ ID NO: 1219 - DNA, 200 bp, Mycobacterium paratuberculosis
ccaggcggcacaggtgccgtcggccgaggtaaaagtgatgtcgcttcgagtcatgacgcccacagtaatggaagggatacaaacattagaaggccatccaactattgtatgggttacagttctggtgtgaacgccgccgctcctgcacctgcgccgatgacccgcacccagcagcgcgctgccgaaaatcgccgtacggt

SEQ ID NO: 1220 - DNA, 200 bp, Mycobacterium paratuberculosis
catcgacgctgcgcgggagatcatcgcgacccagggcgtcgaggccctcactcttgaggccgtcgccgaaaaggccgacgtggttgtgcagaccatctacaaccgcgtcggcgggcgctccgctctactgaccgcagtggccgaacaggcactcgaacagagtcgcgtctacatggatccggcctatgaggcggacggca

SEQ ID NO: 1221 - DNA, 200 bp, Mycobacterium paratuberculosis
ccgtggaagagcgaatgatgttggcggccaacgcctatgcgcgttttgcgcgcgaaaggccacacgagttccggattttggtcgagccgccgaacgaacccgaggctgtcgcacgcatcgccgagctcacccgtgcccagaacgcacgcctcactgcggtgctccgcgaaggcatggccgccggtctcattcgcgcagac

SEQ ID NO: 1222 - DNA, 200 bp, Mycobacterium paratuberculosis
ctcgatcccgacgacgtcaccactgcactgtgggcaaccttcaacgggctactcgcactggcctggcgtcccggggggccttcaggaaagccacgaaaccgtcgaccgccttcttgccgcgtacatcgccacggtgagtgacggcctgcgaacccgctgatgccaaaaccattggaatcccgttcggtgccacctgccgg

SEQ ID NO: 1223 - DNA, 200 bp, Mycobacterium paratuberculosis
aaccgtcgaatggcgctaccaaagcagccgctgagtcctgcggatctacggccgcaacgtaaagccggtacggtgcggcagccgatccaatagacaggacgatcgcatggaatacggtggaatcgaatactgagggttaccagtcaagcccgtcgtattgcatggtgaatcagagcccgcccccctgccgtcgccgaact

SEQ ID NO: 1224 - DNA, 200 bp, Mycobacterium paratuberculosis
ttcgttcccgggctgcgcggctagccccgaaaatgcggaagaggacggtgggcatggagcccgttgagcaggatggccaagaggacgaaacaccaggcgacaccgagcgtcgccgccgcttcacgctgactcggcggaacgcattgctcggcatgagcgcggttgccggattcgccgcggtggacgtcggcgggttcgcc

SEQ ID NO: 1225 - DNA, 200 bp, Mycobacterium paratuberculosis
tacgcgggcgggtggctgcgccccgactccccgctcacgccgccgcggttcgccgatcgcttcgagcacgtctacggccgccacgacgggttccggcgaaatcacgccaagggcctcagcgctaccgggtcgttcacgagcaccggcgcgggcgcggcgatctgccgggcggcggtcttccgggagggcaccgtcccggt

SEQ ID NO: 1226 - DNA, 200 bp, Mycobacterium paratuberculosis
cgtcggccggttttcgctaggcgggggcctgccggaccaggcggacaagcccgagactgtccgcggcctcgggctgttgttcgacgcgggtggccagcaatggcgcaccgccatggtcaacgtgccggtcttcaccgatagcacgccggaggggttttacgagcgcctgctcgcgaccaaacccgtgccctcaaccggga

SEQ ID NO: 1227 - DNA, 200 bp, Mycobacterium paratuberculosis
agcccgacccgcagaagatggccgcgtttctcgatcgtcaccccgagacggccgcggcgatgaaaatcatcaagcagtcgccgccgagtgccgggtttgcagacaccacgttctacgggctcaacgccttcttgttcaccaacagcgccggcgccaccgttccggtgcggtggtcggtagttccgcatgacggcggcgtg

SEQ ID NO: 1228 - DNA, 200 bp, Mycobacterium paratuberculosis
gccggcgcaccggggccgacgcgtggcaaggactttcttttcgacgacctgatccgcacgctggcccagcggccgctgaagtggcggctgattctgacgctgggtgagcccggcgatcccacccacgatgccaccaagccgtggccgcaatcgcggcgcaccgtcgacgccggcaccgtcaccatcaccgcggtgcacac

SEQ ID NO: 1229 - DNA, 200 bp, Mycobacterium paratuberculosis
cgaggaagagggcaacgcgcgcgacatcaacttcgacccgctggtgctgcccgacggcatcacgccgtccgacgatccgttgcccgcggcgaggtcggccgtgtacgcgcggtccttcacccgtcgcgccgaggagcccaagtcgcacagcgaggtcaacgtgacgcgggtgctgccatgaccagcgagacaaacgaaac

SEQ ID NO: 1230 - DNA, 200 bp, Mycobacterium paratuberculosis
aaccacggccccaatgcgtttcgccctcccgacgcgcatcctgcactggctgatggcgccgatggtcatcgggcagctgctcatcggggtggtcatgatcacgtcgttgacctactatccgctgctgctggccatccaccggccgttgggcgccttgatcctggcgtttgcggtggtgcgcctggcgaaccggttcaccc

SEQ ID NO: 1231 - DNA, 200 bp, Mycobacterium paratuberculosis
accggctgccgcccttccttgccacgatgggccccgtcgaacgccgcgtcgcgacatggtcggagtacctgctctatgccctgctgctagcccagcccttgatcgggtgggcgatgctgtcggcggcgcggttcccggtcgtcttggtgggacccgtgcatctgcccggcatcgcaccgcacaacgtcgacgtctatgcg

SEQ ID NO: 1232 - DNA, 200 bp, Mycobacterium paratuberculosis
gcgctgcgccaagcccacaacgtcggcgccttcctgcttttcctgaccttcacggcccacgtctgcgcggtcctctttcatacgctcggcctgcgcgaccggctcctcgatcgcatggcgctgtggcccaccaagcccgtcgcctcgcggcaggacgaaatcaaggcgtgacggccggcctcgatgcccctcaacacctc

SEQ ID NO: 1233 - DNA, 200 bp, Mycobacterium paratuberculosis
atcgccggccgagttagtgcgccaaaaggggcgacctctccccctccaggcaaaagcacgggaccccggatatggcgaccatcgcgagtagttgagcgcgatgatcaacgagccccatggtgtgtgaacgtaaacacgccaccgggcgcccaattagcggcagtcacgatcgagcggacaggcatgtaatccccaccccc

SEQ ID NO: 1234 - DNA, 200 bp, Mycobacterium paratuberculosis
tatcgacctcttcgccaccatcttcgatctcaatcccgtccatgctggccatcctcaccgccatcactgacaaggcaggccggttttcgccgcaaagctggctggtcctcggaaatgcgatcagtcctgtttgagggcgtgtaaggcggagagggggccgccaccaacctgcatgagccgaccgccgtctcggaggggcc

SEQ ID NO: 1235 - DNA, 200 bp, Mycobacterium paratuberculosis
ctcgggctcgccgataccttcaacttgccagtcaactggggttgagctgagggtaaagccccataccgaccgccgagcgtggagttgttggcgttgaaatggccgattcggcacaacaactcgacgttcggcgtcagggtccgaggtgccgctcggcgagcttggcgaacgtcgcaccagccggttgcggtcccccgtgc

SEQ ID NO: 1236 - DNA, 200 bp, Mycobacterium paratuberculosis
gtcggccagcgtaggacttcggtcccctgtgacgcacgagacatagttagttggattaaccatttcgtccgtgcgggtagacgagatggcatgaacgcgaaactttcgaagctcacaccaattctcttcgccggtgtcgctgccgcaggaatcgcagtcgcaccctccgctttcgccgatccggaacccccgccgccggc

SEQ ID NO: 1237 - DNA, 200 bp, Mycobacterium paratuberculosis
ccctccggctcccggttgctataaccctgacggcaccccctgcacgccgtcggcgggcccgcagggagccggtgccgaaattccgggcggcccaggggcgttggcgcgctccgatggccacgtctcggccggaaccccggtggcccctgggctaaagcggggccgggtggaggaatcgcgtgcgtaccaggcggtccgtg

SEQ ID NO: 1238 - DNA, 200 bp, Mycobacterium paratuberculosis
ccgaaccatcaccttgcccggataacgcttcattcacttcacgttcggcgcgaggggcgactgtcgagtcaccccttgcgccgaactcgtctgaaggtgcgctcggaccgttgacgctgggacgaggcaaaacctacaaaccgttcgcaacccctgaaaagcgcctcatccgtgcgcggtcgagcggatccggtccttaa

SEQ ID NO: 1239 - DNA, 200 bp, Mycobacterium paratuberculosis
ctcagtgtcaagatcgtgcccacggcgacgctgatcaccaccatgatggacaccaagatcaccgttatcgacgcgcccacgatctcttcttccgtgaggcgccagcggggtttgtcggcaagaacggtgcgcctttggggcgcaaacgcgttcattgccgcgaccgccaaaagaagatcgtccgcgtcgtccgcatcctt

SEQ ID NO: 1240 - DNA, 200 bp, Mycobacterium paratuberculosis
ctcgattgcctcgtgcgcggctaatgcggtcgtcatatgaacccccaggattgcggtcgccaataggcgttatctcgtatctccacgctaagagtgcgagatcaagattgcggcaacgctccttaacggtcgcagcacaacgtccatgctctaggagcaatggaccatgcgcagcgcttgacgtctcgccgccgagtcca

SEQ ID NO: 1241 - DNA, 200 bp, Mycobacterium paratuberculosis
cgccgcgatcagccgcacgggcaggtgctcgtgtcggtgaatcgcccgtcgactggcccacgcgaatcgcgtcgccgccaattgtgttgcgatggcagctacttggtccgccgataaaccgaagtagatctcaccgtattgggtcgggatgggctcgccgggcatttgttggggagccgatagtgatcggcacgccggcg

SEQ ID NO: 1242 - DNA, 200 bp, Mycobacterium paratuberculosis
gccgacagcaggaactggatgccgtcgattgccttgtcgaccgagccaacttggtaaaggtcaccgctgtttggcctttctctggccggccggtatccgatcaagactaaagccagccgcgggtgcggcggctgagaaatagcaaacgcgtgcttgggtcatccctgtccggcaccttccgcgacggtgaagtagtcgcc

SEQ ID NO: 1243 - DNA, 200 bp, Mycobacterium paratuberculosis
gtgctcgaggtcttccagcagcgtgtggtggctcgggttccagccgagcagcgcgcgggtgcgcgcactggaagccggcacgtcagcggcgaaaacggagctcagcgccgcgctcccgaaatgggctggcgcgtcgtccaattcgaccgacacgaccggcagatcaagctttcgaccgatcttttcggcgatgtcccgca

SEQ ID NO: 1244 - DNA, 200 bp, Mycobacterium paratuberculosis
gcggcacaccgctttccgccgttccgtgcagcgcagttccggccggcgccttctccagcgcaagccgaaacagggttgccgcatcgagacggtggaccgcgggccaccggttggtcccgtccccgatatacgccgagacacccgttttgcgggcggtcgccaccaacatcgccacgaacccgtaatcacccgggccgtgc

SEQ ID NO: 1245 - DNA, 200 bp, Mycobacterium paratuberculosis
acagtcggggcgagccggatcacgctcgagcgcactccccgctcggcgtaccccagacaagcccgctcgccggggatccggtacgcggcgaacgcgtcggggtcgggcgcgtccgtctcctcgctcacccgtcccggagccatcaccatggtcccggacgttgacacgaacggtttgccggtcccggccaacgcggcccc

SEQ ID NO: 1246 - DNA, 200 bp, Mycobacterium paratuberculosis
catggcctcgatcgcatcgacgtcgcgtttggtgatgccggacaaatcgccggagtccccaccgatagccatatggatgacgccgtcggcggctgccgcgccctcgcgcagccggtcgagatcgtcgagcgaacccgtgaacggctctgctcccaggcgagccaggcgatctgccgaggcggccgagcgggccaacccgg

SEQ ID NO: 1247 - DNA, 200 bp, Mycobacterium paratuberculosis
tgacccggtgccccgcagacagcagctccgatacgacggcgggcccggtcaggcccgagcctccagtgacgaacacgtgcacgagattccccctcgaagctaagtggagcgcgttccgattagctgacgagagtacataaccggaacgtgttccgctagagtggcctgcgtggctcaacccgttcgcagcgacgcggcgc

SEQ ID NO: 1248 - DNA, 200 bp, Mycobacterium paratuberculosis
gcaatcgcgaggcgctcatcgaggtcgcgaccaggttgttcgccgcggccgccggcggcgacgagccctcgctgcggttgatcgcccgcgaggccggtgtcggggtcggcacgttgttccgccacttccccactcgcgaggcattggtcgaagccgtgtaccaggaccaggtgcgtcgcctgaccgaaggcgccgatcag

SEQ ID NO: 1249 - DNA, 200 bp, Mycobacterium paratuberculosis
ctgctggcgaatcatccacccgcgcaggccatgcgccgctggatggatctgttcaccgactggttggccaccaagcacggcatgctcggcaccctgcgggcgatgatcaataacgagcaactcggctctggtcacacccgcatcgagttgctggccgccatcgataagatcctcgcggccggtcgcgccgcgggtgacat

SEQ ID NO: 1250 - DNA, 200 bp, Mycobacterium paratuberculosis
cggcgaccacatcagctccgaagacgtcgcggccggcctcatcggcatcttcacggtggctccgaccggcggcaacagcgagcaagccacccggttactcgacatcttcatgaacggactctcggcaccccagtcgaccgtgcacactacgacgagcacgacggacaacccgtagcccacgcgggatcgagcccgatcga

SEQ ID NO: 1251 - DNA, 200 bp, Mycobacterium paratuberculosis
aacgcgcgccagcaaatgccagggtttgaaattccacgctttggatagacctcgcttcaactgccgctccccggatagcggcacatcaggaagggagcccgacgtggcgttctcacacattgcatcgaaaacgacggcagcgacggccgcgctggcggcggccggactcctcgccgcggccccggcattcgccgatccgc

SEQ ID NO: 1252 - DNA, 200 bp, Mycobacterium paratuberculosis
aagtcctgcaattcggccagatggcagagatttccagcaacggtggcaccatcgactacaccgtgagcaacctgcaacccagcggccacaacgacggcgtgtggtactccgacgtcacggccaagggtgtcagtggtaacgcggttcccaacattgccgacttcaacgcgcgggccgtcaacagctccacgttcgcggtg

SEQ ID NO: 1253 - DNA, 200 bp, Mycobacterium paratuberculosis
atgaagggcaaccagaccgacggccttcccgagggtccactgcccctgggcacccccgtcacgggacgcctttacttcgacgtgcgcaacggcacgaaccccgacagcgtcgtctaccgggacgccggaggcacggacaaggtggtctggaagagctagccggtcgggtgaccgcctgattcgggctacagcccggacgg

SEQ ID NO: 1254 - DNA, 200 bp, Mycobacterium paratuberculosis
gccgaatcccgcaccgcgcgatggtagcaaaacccgcggtcgcggtttcgggtcgtcggcgccggtcagccgggcgcagccggtgcgccgccgggcgcgccgcgcgccggccaccgaccggtcggacggaggacgcccacgagccagtggcatgatctttgcgtgtcggacatcccgggagccgcctacgcgcgggacgg

SEQ ID NO: 1255 - DNA, 200 bp, Mycobacterium paratuberculosis
cgccgcagacgttgcccacgcaaccgccgccgccgcccggtccgccgccgcccccgccgacacccgggatgctgccgccaccgccgccggggccgccgccaccggtcgggccaccggggatgctgccaccgccgccgccggggccgccgccaccggtcgggccaccggggatgctgccaccgccgccgccggggccgccg

SEQ ID NO: 1256 - DNA, 200 bp, Mycobacterium paratuberculosis
ttcggcggctgatcggctggcggcccttcaggtcctcagcggcgttgtactcggggtgaaggtgatgccgcgcctgccgcgacatccggcgccggcgagatagcgaccgtcgatcggaatgacaagtcctggaaccccttcgggccgggccggtcacgctgcacgggaccgggcctgtctagctccagcgatctgaattt

SEQ ID NO: 1257 - DNA, 200 bp, Mycobacterium paratuberculosis
cagatggctgatagctgaactagctattagacatatggattttgggcggccatggttagtaccgagcttgaattccgattcgccgagagaggacaggggtgagggattgtggctgtatttcgcgatttgcgcgattacatccaaacgctgaccgacaagttgggcggcgaggaggtcaaaaccatccgcggcgcgcattg

SEQ ID NO: 1258 - DNA, 200 bp, Mycobacterium paratuberculosis
ggacctcgaaattggttgtctgaccgagcttttagccgaaaaagaggggccggcgccgctcttcgacaacatcgagggatacccgagcggctaccgggtcttcaccaacttcatggggactgtgccacgctgcgcggtggcgttagggttgcccccttggaccccggccatggatatcgtcaaagcttggaaggacctga

SEQ ID NO: 1259 - DNA, 200 bp, Mycobacterium paratuberculosis
gcaagagcatcgatcccgttgcgccagtgctgctttcgacgggatcggtacttgaaaacgtactggaaggcgatgacgtcgacctgaacatgtttccgacgccacgctggcacgatggtgacggcgggcgctatatcggaacggcgtgcatggtcatcaccaaagatcccgataccggttgggtcaacgtaggcacctat

SEQ ID NO: 1260 - DNA, 200 bp, Mycobacterium paratuberculosis
cgcggatgtgtgcagggcaaagacaggctgtcgttgtggatgctgggcaatcggcatgcacttgcgatcgcgcagaagtactggcaccgcggtcaagcctgccccatcgctgtggtggtgggctgcgatcccatcctgacgaccgccgccgcgatcgccgcaccctccggggtctgcgagtacgacgtggccggaggcct

SEQ ID NO: 1261 - DNA, 200 bp, Mycobacterium paratuberculosis
acgaggtagcggtgtcgaagtactggccgcgccgggtactggccttcccgttccagcgcacgccgagattgttctcgagggcgagatgcccccggtggaggaggagtcggttcccgaggggccgttcggtgaatggacggggtatttcacccatgccggcaatgaaaccgtggtccgggtgcaacgcatcttgcatcgcg

SEQ ID NO: 1262 - DNA, 200 bp, Mycobacterium paratuberculosis
attcaccgatcattttgggcgcgccgccgatgattccaaccgtccctgcgggggaccaagcggttccgctgtattccgcctcggtgacctgggatcaccttgaagcctctggggtgcaaaacatcaagggcgtgtgggcatatgcgcgccagttgatgatggtgatatcgatcgagcagaccggcaccggcgacgccatg

SEQ ID NO: 1263 - DNA, 200 bp, Mycobacterium paratuberculosis
catgcgttgttggcggcggcgggacgaaagagaacgggcggcatggaccgctactttgtcgtcgtcgacgaagacatcgatatcaccgacatcaatcatgtgctctgggcgctgttcactcgcgtcgacccgaccgaatccatccacgtcctgcgcacaccgacaacggcgatcgatccgcgactgtcgcctgcgaaacg

SEQ ID NO: 1264 - DNA, 200 bp, Mycobacterium paratuberculosis
cgatgcgggtgacctgtcgatggggatcgtgctcatcgacgcgtgtaagcccttcgcctggaaggattcttacccgcgagctaaccggttcgacgacaactatcgggccgcgattcgcgatcgctggcaggccgcgttgccgttgtagacacgatgacgacacagacggccttgatcagaccagtcaggaggtgacgatg

SEQ ID NO: 1265 - DNA, 200 bp, Mycobacterium paratuberculosis
atggcggggatgccggaggaggtcgctgcgcttctgcgcggtttcccacgcatcggcgcgcgcgagcaggcgtttgcgttcttgaccgttgacactggcgggtttccacatgcggcgttgctgtcgcgctgcgagctcgagcctgggcgggacccccaaacactgatggccgccatagctagccgacagacccgcgccaa

SEQ ID NO: 1266 - DNA, 200 bp, Mycobacterium paratuberculosis
cttgcggcgtagcggcaccgcggggctgctcgcaatcaatggcactagttgccaccacctcaagctgcgagtggtcgcctcgctcgtcggtcgcggaatactcggatgtgtgtttgccgtgaccgaacataagcgcgatgacatgggaatacccttgcagcctacgctatttcggacctcggccgagatctcggtgcttg

SEQ ID NO: 1267 - DNA, 200 bp, Mycobacterium paratuberculosis
aggactggccgcgtagtcgggccatgttcgaccgtctcgcagcgctgcgcagcgcagcgcgggaggtcctatgagcacgcaaccgatacgaatcatcgtaggggtcaccggcgccagcggcgcgccgtttgccgtgcggttaatgcagacgctgcacgggatggacgacgtggagacccacttggtgatgagcgggtggg

SEQ ID NO: 1268 - DNA, 200 bp, Mycobacterium paratuberculosis
ctcggtcgagtattggaatcgaaacaccctatagcgttcaacaggtttcagcgatggcggatgtcacctacaaactcgaagaacagggcgccgcgatctcatcgggttcgtttcagaccgccggaatgattgtagtgccgtgcagtatgcggacgttggcagcgattcgctacgggctggcggacaacctggtgtgccgt

SEQ ID NO: 1269 - DNA, 200 bp, Mycobacterium paratuberculosis
gccgctgacgttgttcttaaggagggacgacggttagtcctagtgccccgtgagacaccattgaatacaatccatttggagaacatgctggcactcagccggatgggcgcgcggattgtgccgccgatgcccgccttttacaaccggccggaatcggtcgacgacattgttgaccacgtggtggtccgtgttctcgatca

SEQ ID NO: 1270 - DNA, 200 bp, Mycobacterium paratuberculosis
gttcggtatcaatgccccgcaggcaaagcgctggcagggaatgaagtcggcgaggaccaccggcttcggcaagaactcagcgatcctggcgtagctcggccggtcgccgaagtttagttgtcgccgtggtggcgtgttcaacgaaggcacgagccgctgggctggcggcttgcccttctggccagatgatgcctaggcgc

SEQ ID NO: 1271 - DNA, 200 bp, Mycobacterium paratuberculosis
ccgggcggatgatcgctgactggcaatcctattacgtgatcgctttgcgcgagggctgattgaggaacgagacccacgcccagccccttcgcaacgagcgcaacgagtacgtcgggatcgccggcttcgaaggcgatgtgggcttgaacgccggcccgccgcagcgcgcggttgagttgccagcgcaagcctgatccctc

SEQ ID NO: 1272 - DNA, 200 bp, Mycobacterium paratuberculosis
cgggagcgtgatgagcggtctatccgccacgtcggccaatgtgagcttccggcaaggagataacggatcggacggtagaaagatcgcgatcaccggctcccgatgcaactcgcgcatccgcacgccggctactgcctcatccgtcaggctggtgaaagctacgtctaaagcgccattggatatgtggcgattgagcatcg

SEQ ID NO: 1273 - DNA, 200 bp, Mycobacterium paratuberculosis
ctgcagtgtcctcaaccagcgacaggtctacccccgggtgctcatggtgaaacgctgctagaagctcggggaggtcgatgctgcgcggtgagatcgaggtgatggtgccgatggcaaggcgaccatgtagtagaccggtgagtccgtcgatcgaggcgcgacctgcggccagcgcatcgagtgctgcgcgggcgtatggc

SEQ ID NO: 1274 - DNA, 200 bp, Mycobacterium paratuberculosis
agaagcgcgtttccagccgcggtaagccgtaccgtgcgtggccgccgttcgaatagctgctgcccgatttcgcgttcgagcgccttaatgtgtgcactaacaccagattgcgccagatgtatccgctgtgccgcggcggtgaaggtgccttcctcggcgaccgcgataaagcactccagctgatgaagatccatgctgac

SEQ ID NO: 1275 - DNA, 200 bp, Mycobacterium paratuberculosis
cgaaaatctattacagagcatcgtctcgtcgcgcagggcatctagtaagccgactagccgcaatcgcgggcgcgctccactgcggtcgctccgcgtcgaaatcggtgatcggtaccaccaagggtcacctttgcgaggcgcaaaacgtcgggatggatgagacggcctacgtaccgtctcgacagaaaacgcatcagaga

SEQ ID NO: 1276 - DNA, 200 bp, Mycobacterium paratuberculosis
aagtaaattgccatgagcgtacagatagtccgattccgcatctcaccggaacacatcgcaccggtaacgaagaagatcgaagcgatctttagcgcattgcgcgaggcggatccccctccttccatgcggtatgtcgcgctgcgcgatgacgtcgacccggtattcacgctgatcctcgaactgcccgagggtgctgccaa

SEQ ID NO: 1277 - DNA, 200 bp, Mycobacterium paratuberculosis
cccgttgttgtcgattcccgacgcgttggccttccgcgagtcgctagcgggatgggcgcatgacgatgttgctcctcggcccaccaccgttgtcgggagatactgcgcatgaccaaggtgctgttcgcagccacggtgttatgcatcgtggctaacacattgatcgcgattgccgactacgttcccgcaggcttcgtgct

SEQ ID NO: 1278 - DNA, 200 bp, Mycobacterium paratuberculosis
gaagaactctgctgaagttcatgttcctgccgccgcattgccctaccttgcgacattgaagttagcgggcgcggtgggtctcaccctggggctagtcgccctgccgcggctaggcgtggcagcgggaatcggcctggtgttgttcttctttggcgcggttggtgcgcatgtcagggcccgcgtgttccacaacatcgcgt

SEQ ID NO: 1279 - DNA, 200 bp, Mycobacterium paratuberculosis
ttccaggcgcatttctgcttctcgcactcgccgcgaacggctacctcgtccatcttgcgagcggcgcatgaaacgcgttggacactgagggtgggggaacctgctggttcccccactgacctcggaaacggcgggcagtcgctcgctcttactctgaggtccacgggcgcgtagaaactcttcagtgagaatccggttgt

SEQ ID NO: 1280 - DNA, 200 bp, Mycobacterium paratuberculosis
accgttccccttttccgttatgacgcggaatgtagggcttgactttctggtggcgctcgaacgcgatgcgcactactaaccattttcgcgtgcgccacaatagttcgatacgggcgaagcgccaatggcgacgcgcgcgggcgcagtctcaggagggcttcggcgtttctccccgcgcttggagattcggttcgagtgag

SEQ ID NO: 1281 - DNA, 200 bp, Mycobacterium paratuberculosis
ctagatagcttggtgcatagtcgatttcgtgccgtctggacctaaccttccgccaacgtgacgtcctacaacccccacttcggagggccgattgtctaacctacatactagtatgtatgctgatctcgacaccgcgataggggtagggatgactgttgacgacgaaatgacccaggccaaccgcagcgctggtcctccgg

SEQ ID NO: 1282 - DNA, 200 bp, Mycobacterium paratuberculosis
gcgaagccggcgcgggttctgcctcgatgccacagcgactcggactggccggcctgtgcctgggcaccgctctgatcatcatggaagccaacgtgctcaacgtggccattccctcgatccgacaggccttgcacgccagcccagcgcagagcttgtggatcatcgacgcctacaccctcgtgctggccgcattactactg

SEQ ID NO: 1283 - DNA, 200 bp, Mycobacterium paratuberculosis
tcggccggtcgtttaggcgaccgcatcggcgcacggcgttgctatctattgggtctggcagtgttcagcatcgcctcagtgctgtgcgccctcgccgcatcgtcggccgagctgattgccgcacgcaccattcagggagtcggtgccgccgtgctgatcccggcccctctcgggctgatctcggcaatgtttagcgatct

SEQ ID NO: 1284 - DNA, 200 bp, Mycobacterium paratuberculosis
caccgcgcgcgcgaaggcggtcgctgtgtgggtcacaatcggtggggtcggttttgcggcgggacccttgatcggcggtctgctggtcagcacgttcggttggcgctcgatcttccttatcaacattcccgccgcggcgatcattgcggtcatggtgcgcctcacagtcgctgaagcctctcggtcccccttgccgtttg

SEQ ID NO: 1285 - DNA, 200 bp, Mycobacterium paratuberculosis
actatgtcgggcaggccctggcaattgtcggtctgtcggcagtcgtcttcgcctgcgtggaatcgagtgccctggcgtggatgtcgccattcgtgttattgcctgctgtggcggccgcgctgatcctcgggctgtttgtgatcgatcaacgccatcgaggccgtgccggcgcctgggtgctactgccggtcgagctgttg

SEQ ID NO: 1286 - DNA, 200 bp, Mycobacterium paratuberculosis
aataaccggccggtgaacgccggactgatgtcaggatttgtttacaacttcaccctgtacggtctggtcctcgtctatagctatgtcttccaatccgcccgcggctacagccccgtgcagaccggtctggccttcgcgccgttgactgtggcagcgctggttacctcgctgcccgcgggacgctttgtcgccgcgcacgg

SEQ ID NO: 1287 - DNA, 200 bp, Mycobacterium paratuberculosis
tgcgcgaagaggcatcatgatcggaatggcgctgtctgccatcggattatgcgcactggcattcgatgcccagcggatgccgttcgtggtcctatcgatcgcctttggcatcttcgcgaccggtctctcgctttcggcgaccggacaaaccatggcggtgatggccaacgccagcgaccagtacaaaaacacggcgtcca

SEQ ID NO: 1288 - DNA, 200 bp, Mycobacterium paratuberculosis
gcatgctcaacaccgcgcgccagaccggcggtgtcatcggcgtggcggcgctgggtgcgatcacgtcgcgcgacctgctggccagcgcgccggtggcgttgaccatcgctgccgcagcatgtctggtcgccgctctgggagttgcaacgttgattgcgcgtcacgcccgcacacatgattcggaccaacactgataccgg

SEQ ID NO: 1289 - DNA, 200 bp, Mycobacterium paratuberculosis
catacataccgctaggtatgcttgccttatggcggacgaacaggccgattcacgcgagcgattgattagtggaacccgagaactgctgtgggatcgcggctacgttggcaccagtcccaccgcgatcctgcagcagtccggtgttggccaaggcagcctctatcaccattttcgtggcaagcacgacctggtgctggccg

SEQ ID NO: 1290 - DNA, 200 bp, Mycobacterium paratuberculosis
cggagcagcaggccgcagccgatatgcagcgcagcatcaaagaggcgtttgcgggcaacagatccgcccacgacaaaatcgccgactaccttactcgtcaacgagaagtgctgcgcggctgcagcgtcggtcgcctgacagcagatccggtgattgtcggcgacgatcaactgcgtgcccctgtcgcacagacctttgag

SEQ ID NO: 1291 - DNA, 200 bp, Mycobacterium paratuberculosis
gtactgcatacctgtctgacacgaacgatccgagaagggcagcggtcgggtgagatctcggtcgagcttgagccgcacaaagtcgcggcagcgatttctgcaaccatccagggcggttacgccctggctagggcagccaactcggtcgaacccttcaatcgcgcgattaccggcatcctgcaactgatagaagcctccac

SEQ ID NO: 1292 - DNA, 200 bp, Mycobacterium paratuberculosis
cgcccaccgtcgacgcacaaacccagcggctcacgatgccgtgccagcccaacgacgccgaacgtcccggtcaaaaaacccaagcaatcacaaaccagcccgataagcgaaccggcggcacggccacgaggacgagctgtcggcgcggctgcccgaatcggttgcggcctaccagaatgccgttgccgcaggggatttcg

SEQ ID NO: 1293 - DNA, 200 bp, Mycobacterium paratuberculosis
acaccgcagcgatcctcatcggcgaagcggtgggggtcatccgagaggttcgtcccgccgcggggatcgtcgccgagatggtcggtgcagtacagcgcatcctgcaccgcgacggcgcgccctagacagcaccttccacgagacctaccacgcctacaacccggcgctgcggttcctgctcgagcgccccgtgcacgcga

SEQ ID NO: 1294 - DNA, 200 bp, Mycobacterium paratuberculosis
accacgaccagcagctgcacctgctcggcggcggcccgtggcagctgagcccggtggaaaaggagcccgcgcgggtttgatgcgcgcctacgctttcgcggcgcgccgcgccgcgtgcgctccggcgcggcgcccgaagaacgaaccctcacccagctgcgtcccgctggcgtaccccttgccgtcctgagccaggttcg

SEQ ID NO: 1295 - DNA, 200 bp, Mycobacterium paratuberculosis
gcagtgaaggatatggattttccatggattcacccgccgcacccagccgtcggttgaccgccggcgtgccccgcctggcgccgagcctggccccgcctagcctcgccccgcctggcgccgagcgtgaaactaggcgcacgttcggcggcgagcgtgaaactaacttcacgctcgcgcggcgttcacgctcgccgcggcgc

SEQ ID NO: 1296 - DNA, 200 bp, Mycobacterium paratuberculosis
gaggccgaacgcctggctggattgccggatcgcgatgatgtcgacgtccggggccaccccgctgaacgcgtcggggcccggcttgggcggcgccggcggcgggtcgagcgggcgcgggccgcgcaggttgtcgacgttggtcacccgggcggcgcccgcgtggcccgggatggtcaccgtgccgccgccgtggttgccgg

SEQ ID NO: 1297 - DNA, 200 bp, Mycobacterium paratuberculosis
agcacgctggcagcagattatgcgctgactcacagctagcaccggggtgacgcagttgcggcggcatgaccggcgttcgtctggcaggtgcggctaaccccgccggcgccggcgcgaattttgcgcgcccccgcgccgcccgccgaacgccgcggccggccgccccgcgagccgcccggtcctttcccgatccgatccaa

SEQ ID NO: 1298 - DNA, 200 bp, Mycobacterium paratuberculosis
cgggggctgcgtgctgctgtacctgacgcccctgatcctggggctgtggcgcggggagacgagtcacgatcgccgcgccgcggcgcgcgcgcggcgcgagcgcgccgaactcgacgccgacaccgcgatcgcgatcaagcgggccgaggttcgccgcgaagccgaaatcatgtgggccgagcaccaattgacacaggcgc

SEQ ID NO: 1299 - DNA, 200 bp, Mycobacterium paratuberculosis
cgcggtggcaccctcggtgctcagcgattggtccaccgcggccgtcagcgccgcgccggggcccagttccaggaaggttccggcgccggcctgctcggcggcgcgcacccccgcgaggaattgcaccggcgcgcgcacgtgctcgacccagtactgtggcgtgccgtagccggggccggcgagttgtccggtcaggttgg

SEQ ID NO: 1300 - DNA, 200 bp, Mycobacterium paratuberculosis
ggccgagcggtccaacaccggcaagcgttagcgccggtggcgtcggttgcgcgcgtgcggcgtgcggtcttcgcgcggcactgccacccgtgcagcgcgtggtcccgatgggcgagcacgccgctgatcctggtgccgccctggacgcgacgggccaagcacgcggtatggattgcgctgtggctggcggtgaatccgtt

SEQ ID NO: 1301 - DNA, 200 bp, Mycobacterium paratuberculosis
catcttcggcgaaccggcccatcaccgcgcctgggccacgcgggcgatgctgggcgaggaactgtggattacccgccggccccgggacgcggcgatggtggtcagcgcggcgacgtcggcggccgcgctggttgcggtgatcgccgcccatcgccatcggctgagacccgcgctggtcgcgaccgccctgcagatggcgc

SEQ ID NO: 1302 - DNA, 200 bp, Mycobacterium paratuberculosis
tgacgctggtgtactggcagcagatggttcggtatctcgaacgcgagatgcggtaacgcggccgatcgtctgcgagacagggcaatacgcgcgtatcgctgagcgatacgaaggtattgtcaggccgtgggacccacccggctgtttccgtacgatccgccccccgcgcaacgatcggcgaaggagcggatacgcgacgc

SEQ ID NO: 1303 - DNA, 200 bp, Mycobacterium paratuberculosis
cggaggtacccgccgatcgcacgtttcagaaacggggtcccgcccacgacccaggtgctatacacgagacaccatgcatgagtccgccgtatccgcctatgccgcgcaacttctcgacgccgacaaccccgacgacatgccggagttgcagcggctgcaaggcgatccgaacgtggaattcatcgatcggctcgacacgc

SEQ ID NO: 1304 - DNA, 200 bp, Mycobacterium paratuberculosis
gcccgatcttgcatggcctactcggcgacctcgacatcggcctactcccgggtatgagcagccgcgagaaggtcccccacatcttgcgtcaccttgaagcggaacgactttcgccccgcacggccgcatcattggtcgagatcgaccgcacggtgtcgacctggccccagctcgcgtcggacgtcgtcctcggtgccgcg

SEQ ID NO: 1305 - DNA, 200 bp, Mycobacterium paratuberculosis
tcaacgggtcgccggtgcgcgccactctgaacctgagtgatggcaccgacccctggctcgcggatctctatcagtcgatgatccggcgcgagacaaatcgccatcacggaagcccgcgagcggtcgacgccgcgaccatcgaggcgctcggcgacgcggcaaaccgcgagtgcgcgcgactgcacctgatcaccggccgt

SEQ ID NO: 1306 - DNA, 200 bp, Mycobacterium paratuberculosis
tcttgtacgcccacaaccgggcagagttcgaccagctgtcaccccaattcgccgacgagctaatgcaattggagcgcaacttccgagcactggcggagataaccaaagacgaagccgcggtgctgctgctccggttcaccgccgcaccgccggcatcggtgccgagccggcgcagcgtcgaacgaacccgggtgcgcaat

SEQ ID NO: 1307 - DNA, 200 bp, Mycobacterium paratuberculosis
tgagcggctggctgctcgcacactgcatatcgattgtgagtccggcgctcggccggattcgtgactccgggcacattgcccgccccgttcccccgttgaagctacggtaatggaaatgtcgggcacgttggactacctggtcaccgccgctgccgccgaattgatggcggcgacggcggcggactcggccgcgatcagcc

SEQ ID NO: 1308 - DNA, 200 bp, Mycobacterium paratuberculosis
gaaggagtcgaaacggtggccgccgcccaaacgctgctcagcttgggttgtcatcgcgcccaagggtttctgctatcgcggccgctggacagcgccgcgatggagtcgcttctcgcccagcgcgtcgtccccatgaatttctccgagaccgggccagcggtctagatccgccaagagcgcagtacccccacgctcacggg

SEQ ID NO: 1309 - DNA, 200 bp, Mycobacterium paratuberculosis
cggcgttgaaataggtagtaatacgtcggggtcttgtcgtcgagcgcccgctcctggccagtggacaacagcgtccaacccgcggtgaaccgccgttcgatttcggcgcgatcgatgcccggcacgccgaaccggcccccgggaggaaacgcgacgatgaacagccgtgcgtcgggcgccgcaacggcgctgacctcccg

SEQ ID NO: 1310 - DNA, 200 bp, Mycobacterium paratuberculosis
agccgtgctgagcgaggtaaacagcgcaatcccccgtgccgcaccccaagtcgagggccgagcccgtgggcagcgcctgcgtgccagcggccccttcaaccagatcccgcagaccctgcccgatcggatgcccttcccagggggtgaagccgacccggtagaagaaccggaatcgtgcgcgccgtgaagccatagccgca

SEQ ID NO: 1311 - DNA, 200 bp, Mycobacterium paratuberculosis
atgatggcattcaccgcagccggagcgtcgcccgccccccggcgacgagcgaggccaagcacgacagcgtcagcgccgtcgtctcaccatggccctgatcggcgccgccgcgaccatggtgaagggcacggccagcgggaaatcgtcggacagggactcgatttcgacgcggcgaacgatggttgccaacgcgagcgtag

SEQ ID NO: 1312 - DNA, 200 bp, Mycobacterium paratuberculosis
gcaatccggcgatgtcacgcttgggttcggcgaccgacacgattcgaccctagaacactttcgcatcgggcacgcggaacttgcgacctcggaccgacatcgcctatgccgataggcggctgaggatttcggtgttctcggcgcacatcaacttgaattgcgccggatcggcatgggcggcgagggtgcggcggtcccac

SEQ ID NO: 1313 - DNA, 200 bp, Mycobacterium paratuberculosis
ggacaacgtctctcccaaactcgctagcgcatccgctagcaagtttgaaactcacctcatggtgtccggagacccggcaccccgaggcggcaataggtgaggcgcccggagacggcgcccggagtcgaggcgccaaaagacaactacccagcgggacgcgtccacgtgcgggtgaccggatcgcactgcagcaggtagcc

SEQ ID NO: 1314 - DNA, 200 bp, Mycobacterium paratuberculosis
ctccgggccgccgaccctgacctggaccgcgatcaccgagcagaccaacccgacgcgcccgacgcggcgcccggtgccgccccgccggccggcccgaccgccgagcacaccgccggaggaacgcaccgtcatcgtccccggctcgccggcccgatcgcgcgtcgccccggcgagcgctccggccgggccaccgcggacat

SEQ ID NO: 1315 - DNA, 200 bp, Mycobacterium paratuberculosis
cgctggaatcgactccgctgtccaggcggggaacgctgtggagctacaccgagaaccgctatgccccgcccccgccctacccgtccccggacccgttcgagccgttcgccgtcgccgccgtggagttggcgaaggagggtctgatcgtgctgggcaaggtggtcgagggcacgctggccgccgacctgaaggtcggcatg

SEQ ID NO: 1316 - DNA, 200 bp, Mycobacterium paratuberculosis
aagtcctggcagggagcggtagatgtcggcgtccgggtgtgtctcaaaatgtgttgccagttcggcctcaaggtcggtgatctggcggttcagttcagcgatgatgccgaccgtggcgcgggtggttgcgccgaacgcggcggtgaccgcggcaggggcggcgagctgctcagcgcgtaaagcggtttgaatgtcctggg

SEQ ID NO: 1317 - DNA, 200 bp, Mycobacterium paratuberculosis
ttgcgggtccagatcagattctgatgtgcccgggccagcactttgaccgcctcggtatcagcggagtcaccggcgacgcggcggtgattgtggcgatcggtgcgcaccagatccgccaagagcttggcgtccccggcatcggatttggcccccgacacatggtggcggtcgcggtagcgggcggccgccatcgggttgat

SEQ ID NO: 1318 - DNA, 200 bp, Mycobacterium paratuberculosis
cgcatacacctggtaatcggccgcggtgagcgcctcgacccacaaaccacggtcggtttcgattccaatcacgacctggtcgggctcttcggcatggcgggccaaaagctgatggaactcgccgatgccggcaagtccctccggtaaccgacgcgaggccagccgggccccggattcatccatcaggtggacgtcgtgat

SEQ ID NO: 1319 - DNA, 200 bp, Mycobacterium paratuberculosis
gatcctccgcccaatcgtcgccgacaaatatcacgtagcgcctcctcggtggtcatcgaacatgttcgagcccaagggcacccggcgacaagctaatggatcagtgctcaacggcacgacaccccatcagtgctacaggaaccctcaccaaccggccggggcgtgatctagccttagaagtcggccatcgcttcagctgg

SEQ ID NO: 1320 - DNA, 200 bp, Mycobacterium paratuberculosis
gtcggcggacagcgcggcccgggcgtactcccccagcgccggcgagatggccggctcgccgtagaggaccgcgcggccggaggccgggcgggccggcgcggcggcggcgaggggtaacagggcggggtgcgggttgccggtcgacaggtcacgcacgccggcggggacgtcgagcccgagcagcgatcgcggggtggtcg

SEQ ID NO: 1321 - DNA, 200 bp, Mycobacterium paratuberculosis
gcggacgcccggtggtgttgccgacgacgcacgcgcgccggggcgagacgctgtacctgcacggttcgacgggcggcgggccggtgctggcggccagggcggccgcggccgcgggggcgggactgccggtctgcgtcaccgtcacgctggtcgacgccctggtgctggcgcgcgccgcgatgcaccactcggtgaacttc

SEQ ID NO: 1322 - DNA, 200 bp, Mycobacterium paratuberculosis
catcgtgcgggtgcagcccatgtgaccgccggcggcgcggcgagcgcggcggccccgcgcctgccgcccggcggccccgcgcctgccgcccggcggccccgcgcctggcccgcggcggccccccggcgagcccgcgcctgcccccggcgagcgtgaaattagcttcacggtcgcggccgagcgtgaaactaacttcacgc

SEQ ID NO: 1323 - DNA, 200 bp, Mycobacterium paratuberculosis
ggttcgttgatcgcgggagcgctcggggtggccgcggcgggcttcggcgccgcggtggcgagcgcggatcccccgccaccgccgccgggcccggggcagccgtgggggccgggcggcccgggcgggccgggtggaccgggtggaccgcccccgccgccgggtggaccgctgggcccgccaccgggcgggccgggcgggcc

SEQ ID NO: 1324 - DNA, 200 bp, Mycobacterium paratuberculosis
gccgtgctgatcacgctgtcgtcgcaggtgaagctgccgtcgctgctggcactgggcttcgtcacgatggcgctggcctaccggtgcgggggcaacctgcgcgcgctgctgctggccggcggcggcatggcggcgctgtcgctggcggtgatggcgctggtcggctgggccagcgggctcgggttcggctggatctacac

SEQ ID NO: 1325 - DNA, 200 bp, Mycobacterium paratuberculosis
agccgctgtatgcccgggtgatgcgcgccggcgacggcgtggtgctgcagttcgctcaactgtcggtgagcgccggatccgaccacgaggccgcgatgctgttcctggccggccgcgccgagccgttccgggtggccgagctgcccgggctgagcgccgcgcagcaggtcgggctggcgcagacgctgatcctgaacggg

SEQ ID NO: 1326 - DNA, 200 bp, Mycobacterium paratuberculosis
tttctggcccgactgtccgacgactgacagtcagcttcgcatttccggtgaatgcgccggaatctatccgtatctgcggatctactcgggttacgctccattacctacgggtcgcctcgttcgtcggggaggagcgcgtcatggcagcagggtccgccgcgggcaggcgccgatgaccatgccgatctgggccgccttcc

SEQ ID NO: 1327 - DNA, 200 bp, Mycobacterium paratuberculosis
cgccggaggtgcattcggcggcgctgtccagcggacccggccccgggtcgttgctcgcggccgagcaggcctggcaggcgctgagcgccgaatacgcctcggccgccgccgaactcggcgatctgctggcggcggtgcaggccggcacctggcagggtcccagcgccgaggcgttcgtggccgcgcacgtgccatatctg

SEQ ID NO: 1328 - DNA, 200 bp, Mycobacterium paratuberculosis
tctgcagatgtggctgcaggcggccaccacgatggcgatctacgaggcggtgtcggagaccgcgatgacgtggaaaccgcccaccgcgccgccgccgcagatccagaaaaccggcgtcgccaaccaggacgccggcggcggccccacccagctgagctggtgggtgacgcgggtgcaggaggtggccagggccatcagcg

SEQ ID NO: 1329 - DNA, 200 bp, Mycobacterium paratuberculosis
gcgacctgagccagtcgccgtcgaacccgtccgcgacgttgtcggacctgatgagcgatccgctgctggccaccgaggtgccgcactgggcgggcgagtcgctgctgtacttcaccccgcaggtgccgcagttgacccagctctcgttcggtctgatcgcgcccttcatccccgccgcgggggcgccgggggtggccggg

SEQ ID NO: 1330 - DNA, 200 bp, Mycobacterium paratuberculosis
ctggccggactcgccgggttggccgggggcgcccccgcgcccgtcctgcccggggtggcggccgcgccctccggcggtggagccgctgccgtgctggcccccggcccgggcgcctccgccgcgaccgtgtcgccggccccggcgcccgcgggcatgccggccaccgcaccggccccggtcggaccacccacgccgccgcc

SEQ ID NO: 1331 - DNA, 200 bp, Mycobacterium paratuberculosis
taccgccacgaatacctcgacaccgaccccggcgggggccccgcgtccgtgaccgcctcggaccggggcgccggcccgatcgggttcgccggcaccaccggcgcgaccggttcggcacccgtggggttgaccacagtcgccggtgatgcgctggacgacggcccgcgaatgccgctgctgccaggcagctggagcgccga

SEQ ID NO: 1332 - DNA, 200 bp, Mycobacterium paratuberculosis
ggcgctcgaacgggcgtgccgtgctcgccttgctcgccgagcgtgaagttaagttcacgctcggcgccgagcgtgaagctagcttcacgctcggcacgacgcggcggcgcgacgcggcgcgactcggcggaagctcgagacgggtcagacggcgcgcttgagctcgtcgaccttgttcagctgctcccagggcagttcga

SEQ ID NO: 1333 - DNA, 200 bp, Mycobacterium paratuberculosis
cggctcgccggcccaccgggtcagggcgagcaccgcggccttgcgcacgtccaggtgcgcgtcgcccagcgcctcgcccagcagcggcaccgcgacctcggcggccgcaccggccagcgcccgcgccgcgccttcgcgcacctgccacgccgacgcgcgcagcgcctgcgtgatggccccgtaatcgtctgggccgcagc

SEQ ID NO: 1334 - DNA, 200 bp, Mycobacterium paratuberculosis
taagtcgagccggcggaaatccaacagcaaggacggacatgagccagccccccgaatatccaggcacgccgcccgagccgccgccggggtacggcccgccaccgggctacggcacgccgccgggctacggcacgccacccccgccgccgccgggctatggcccgccgcccggctacggggcacccccgcccggctacggc

SEQ ID NO: 1335 - DNA, 200 bp, Mycobacterium paratuberculosis
agcagcgccaccgcctccggcgtggaccgcgacgccaccacatactcgaacatgtgttcgaccatagcatcgtccaccgacgcatgctttttggcagttcgcgacgtgtggataactgcggcagctgaatgggtaaggagatgcgtcggtcgcggattccggccgaggagaaaacccaccgtgcccaccccgttttgcga

SEQ ID NO: 1336 - DNA, 200 bp, Mycobacterium paratuberculosis
gaccgcagctcacgaccgcatcacagccccaaccgcacgcccacgcgcaccgagcggcgcatcatcaaagtccgggtgatccgccggtggggaccagcgcgcatcgggtatctgctggggatacatccctcgacggtccatcgggtattgacccgctacgcgctggccaaactgcgctggctggaccgatctactggccg

SEQ ID NO: 1337 - DNA, 200 bp, Mycobacterium paratuberculosis
gattatccggcggatggaaccggctgggtgcggggatctagtgcacgtcgatgtcaagaagctcggcaaaatccctgccggcggcggctggcggatgctgggacgcgcgattggcggccacaactccaacgcggacaagagcagcggggtgttcagcaagcaccgcaacccaatacggggatatcactatctccacaccg

SEQ ID NO: 1338 - DNA, 200 bp, Mycobacterium paratuberculosis
ccatcgatggatattcccggctggcctacagcgaggtactcgacgatgagatcaaagaaaccgccgccgagttctggacacgcgctaatgcctggttcgccgaatgtgggatcagcgtgcggaaagtgttgaccgacaacgggtcctgctaccgatcgcgcgtttttgcccaggccctgggcgatatcgaacaccgccgc

SEQ ID NO: 1339 - DNA, 200 bp, Mycobacterium paratuberculosis
cgggctgggcgacggcggcgggtcctgcgggtagggccgcggctgagcgggtgcggcgcccggctgggcgggcgcaggtacgggctggccgggggccggctgccccggcgcgggcgcgggctggcccggtgcgggtgcgggctggcccggtgcgggctggccgggcgcgggttgcgcgggctggcgcggcgcgggcttgg

SEQ ID NO: 1340 - DNA, 200 bp, Mycobacterium paratuberculosis
catgatcaacctggcggcggcggccgtggtggcgattttcctgctgcggcaagtggtttcggcgaggcaactggcgctggcgctgtgcgcgctggccgccgcgctggcgctgctggccggcctgctgctgcgctcggcggacgtcgaaaccaccagcaggcaaaggctttacgccgacccgatcatcgcctaccggcaca

SEQ ID NO: 1341 - DNA, 200 bp, Mycobacterium paratuberculosis
ctcggcgatcagcccggccggcagcgacgccgggtcgacggcggccagcgcggccgacagctcgttctcacgcgcctcgcgggcggcccggggcgcggcctcggcggcgtcggccagcgccgccagccggcgcccctcggaggcaccgccgtaggcgtcgatcgccacggcgcgcgccaccaccgcgcgccgggccagcg

SEQ ID NO: 1342 - DNA, 69 bp, Mycobacterium paratuberculosis
cgcagccgccaggtgcgcagcaggatccggaccgcgaacagcgcaccggccagcggcaccgcaggggat

SEQ ID NO: 1343 - DNA, 19 bp, Artificial Sequence
  Oligonucleotide
gtggtgcagccaatggttg

SEQ ID NO: 1344 - DNA, 21 bp, Artificial Sequence
  Oligonucleotide
ggacgcaaactcacccttcat

SEQ ID NO: 1345 - DNA, 19 bp, Artificial Sequence
  Oligonucleotide
tttccagcgcagatcgaaa

SEQ ID NO: 1346 - DNA, 20 bp, Artificial Sequence
  Oligonucleotide
acagcatgtttgcgttcctg

SEQ ID NO: 1347 - DNA, 21 bp, Artificial Sequence
  Oligonucleotide
tagcggaccttgcggttgccg

SEQ ID NO: 1348 - DNA, 22 bp, Artificial Sequence
  Oligonucleotide
atccgaaaaaccgtgcagggcc

SEQ ID NO: 1349 - DNA, 22 bp, Artificial Sequence
  Oligonucleotide
gtgttgtagtcagaccctgtgg

SEQ ID NO: 1350 - DNA, 21 bp, Artificial Sequence
  Oligonucleotide
aaaaacaaccattggctgcac

SEQ ID NO: 1351 - DNA, 22 bp, Artificial Sequence
  Oligonucleotide
tggatatgaagggtgagtttgc

SEQ ID NO: 1352 - DNA, 20 bp, Artificial Sequence
  Oligonucleotide
gatcaaaccgctaccgctac

SEQ ID NO: 1353 - DNA, 20 bp, Artificial Sequence
  Oligonucleotide
tcaacgtcgtcgaatgaaac

SEQ ID NO: 1354 - DNA, 20 bp, Artificial Sequence
  Oligonucleotide
tgtttcccgaggagatgttc

SEQ ID NO: 1355 - DNA, 4830849 bp, Mycobacterium paratuberculosis (residues 1-1,610,283 of 4,830,849)
  misc_feature (1)...(4830849): n = A,T,C or G
tttgcctttcggtagagccgggatcgctggccgcaatagcccttcgaggccttcaggatgctgcgcctctttcttgtgggcgttgaccgcccgcttcacgcgtgccatgggatgttcctactctcgttcaaacgtcattcggtcgaaggtgccgtgccagctcgcggacgggtctggccggcgcggggtcagccgttcagcaggctgttgacccgcttggtgtcgttggccgacaccgtggtgcggccttccagccgccgcgtgcgggtggtcggcttgtgttcgagcagatgccggcggttggtcttctgccggacgatcttgccggttccggtgcgccggaaccccggcggacggcggctcgctaccgccggcctcgccgccctggccgtggccgtcgtctgggccggcgccgcgcctcccggcgcgcccagggtggcgctggtttccggcgaggcgatcgccatcgcccagggcgtctcggtcacccccgcgcccggctggacgctgggcaaccgcggcccgaactgggtggcgctgaacaactccgacaccaccgcgcagctgcggatcacggtcaaacccggggccggcaccgacgccgccgcgctgctgcaggccgacgtcgaccagtacaccggcggcgcctcggccatcctgaccgatgtgaaccggctgggcccgccggagaccacgccgctgcaaggccccaactttcagcagcaggcctcgctcaattacacggccacggtggtgcatccgcagggctcgatcccggtgatcggcaccttcaccgagctgctcaacacctcgaccggccgctcggcgttcgtcgacttccggcaggacagcagcgcgaccacccaggccgccggcgagggtgcggcgatgatcgcgtctttgcaatagcggccggcgctcgccggggccgccgtcgcgggcccgggcccgaccgcgtaggaagaacggggacaaaccgaacgcggaggggttcatgccagcagccgagaccagggagacgctcgccggaatcgtggaacggcacgcgcagcgccggcccgacgcgatcgccatccgctacggcgaacggcagtggtcctgggcggagtggagctcgcggatccggcgcgcggcgggggcgctgcgcggcgccggcatccagcgcggccagtgcgtggcgttcctggacaagaatcaccccgcctgcctggaggtgctcatcggcggcgcgtccgtcggcgcggtgaccacggtggtcaattggcgggtgatcggcgacgagctggtgcacgtgctggccgacagcggcgcccgcgtgctggtggtcggcgccgagctgcgtccggcggccgaggcggccgcccgtcgggtgccgagcctggaacgcatcatcgaggtcggtgacgagtacgaatccttgctcgccgcagccgaaccggcgccgagcgatgcgggcgtcgacaccgacgagacggcgttggtgatctacagctccggcaccaccgggcggcccaagggcgtgctgctgagccagcgcgcgctggtcaatcacgcggcgaacctggcgccggcgttcccgttcggcgacggggacgcgaatcttgttgcgatgccgctgtttcacgtcggcggaatcggctacgcgctgttcgggatccgggccggggcgccgaccatcatgacccgcgagcccgacgcggcggcgctgatcggggcggtgcgcgccggcgccacccacgcgttcttcgtcccgccggtgatcgcccggttcctggacgcgggcgaggcggcgcgcgccagcatcgccggtctgcgctacatcgtgtacggggcggcgccgatgccgctgccgctgctgcaccgggcgctgtcgacgtggccgggcaccaaattcgtccaggtgtacgggcagaccgagttgtgcggtgcggtcaccgcgctgtccgacgacgatcaccgcgatgcggcgcgcccccagctgcagctctccgccggaaaagcggtgcagggctgcgagattcgcatcgtcgacccgaacagctgcgccgagttgccggccgggcggtccggcgaggtgtgggtgcgcagcaaccagaacatgagcggatacctcaatcgtgccgaggcgacggccgagacgatcaccgccgatggctgggtgcgcaccggggatgtgggacggctggacgccgacggctacgtgtacatcgaagaccggttgaaggacatgatcatcaccggcggcgagaacgtgtacggccccgaggtggagagcgtgctcatcgagcaccccgcggtcgtcgacgcagcggtgatcggggtgcccgacgacttctggggcgaatcggtcaaggcgatcgtggtggccgacggtgacgtcgacgccgccgacgtcatcgagttctgtcgccggcacctggccgggttcaaatgcccgcgcacggtggatttcgtggcggagctgccccgcaacgccagcggcaagattctgaaaacccagctgcgggaaccgttttggcgcgaccgggacaggcgggtctgaggcctacaaccgtccgtcgacccgcagatccgggtgcacccagtcgggtgagcggcgttgtttgaacgcgcggaagccctcgatggcctcgtcgtcggacaggctggcggtcatgccgatgcggtcgtacaggcccaggtagttgtccaggctggacttgatgacgccgcgggcgcgcggcgcggtccggcagcattgcgccagtaggtctttggccgcgtccagcaggttctcgtgcggcaccacccgggtgaccaggccccagtcgagcgcttcgacggcggtgagcacccggccggtgaacatcaggtcgcgggtgcgcaccggcccgatgacccgggccagcatctggctgtagtaggtgtcggcgtagccgcggaacaactcgggcacccggaaggtcgcgcgatcgctgaccaccgacaggtcgctgcacagcgcgatctggaatccgccgccctggcacagcccgttgaccgcggagacgatcggcttggccgaggtgcgcaccgcgtcgaacggggtgacgtccatgcccagcgcggagccgaaggtgatccagttgtccgcgccgcccccgccgcccatgtcgccaccgggggcgaagacgtcgccggttccggtgagcaccagcccggccagatcggggtcctcgttgagacgtccgacggcgtaacggattccgaagtacatcgccgggctcagcgcattgcgcgcctggggccggtcgatggtgcacagcgcgatgggtccgtagcgctcgaagcgcaggtacggcgtgcccagccaatcgccttcgggcggacgggggggtcgggcggtgtggggttctgcgccacggggctcctttcgggtcggcgccgccgcggatgcgtcgcgccgcaacgccgctacggtagctcttacagtatctgcgggggccggcggctacacatatggcagggcggccgtcgcggcggtggcggcagcgtcggcgaccacctcggcgagtttggcctgcagggtggcggtggcctcacccaccggctggtcgcagaaccggcagcgggtggtgaagttcggctgctcgtcttcgtcgggccagaaccggcgcggccccacctgggcgccggggtcgaactggacggcctgatgcggggcgtccttgaggatcctgccgacgggatggtgttgcgggcattcgagtttcagcatgccgatgccttcttgattgccggccatggttcaccgtcctctcgctgtcagtgcaggatccgcgcgagcctgcgccaccgccggtgccggtggcggaacatgacccgggcgaaggcgcgggtcggcaggccgcgcaggccgtcgtcggtttcgatctcgtcggtgtagcggcagctgccctcgtcgatgggctcgaaggtcaggcggtggttccaggtgcggacgggtccgccgtgctcgttggtgtagatctcggtggggtcgagccgcttgatggtgaggtgatgcgtccaggcggggatcactccgaacaaccagaatcgcgctgatccctgggtgccgacctcgatgcgcttggggacgtcgaggcggtagatccgcagcaccgggctgagcacgtggcgcatcatctcgggcttgcgggccagcgccgacgcggtttccaccgggatcggcagctcggtagttagggttaccttactcacgccgtttatggtggcccagcgggcgcgatcaggcaatagccgaccgcaccggtggccaaacggccttaatgacggtggtcccggctgggatcgacccagcgaccttccgcgtgtgaagcggacgctctcccactgagccacgggaccggcgaacgacgtcgaagactagcacgagccagacccgacgataccggccgcatcggcttcggcgagacgacgcgatagcctagacacggctcgtaccaagaaatttgtatgtgcccgctcacgtcgactatcgtcgtgcttcgcaccgggcgacgatctcgtccgtggcgcgcggatgtagcgcagttggtagcgcatcaccttgccaaggtgagggtcgcgggttcgaatcccgtcatccgctcgaaggtgcaagtggcgtggaccccaacggtggagtggccgagtggtgaggcaacggcctgcaaagccgtgcacacgggttcgattcccgtctccacctccagcttttggtttccccggcgcgattagctcagcgggagagcgcttccctgacacggaagaggtcactggttcaatcccagtatcgcgcaccatagtttttgcaggtcagagcatgtttttgaggctcaaattcgcctgcatgccagatacatgccaaacgctgtaggcggcctcgggacaacccgaggagcgtcaaggcatgaacacttcttcctctctacctgtcgacaccctggacgtcaccgcaccaccggatgccactgaggtttacggctgggcagcgcacccagacggtctggccgcccgtgcattcgaagcagcggtgcgtgactgcgccggctaccgggtccgggtgcgcggtgcgcaacgctccaacgtcacctgccgccgctgggtggccatcgaagccgcacccggcgccgacgagcaagcgttggagcccgaagcggtgcggcagctggcgccgcagatgagcgtcacgcctaccacgcgccggacagctgagatgctcgacgacgccgccttcgatgcgatcgtcgcggtgttcagtcaacgggcccgatgcgagatgcaaacgctgtcgggaggcaagtgcccacgggctgcgcgctggcgcattgatttgcacgggtgcgaacaggccattgtgtgcgggcagcacaagaaagcgtggctgcaggaggccctagccaacctctggcgcggcattcaacctcgctgcgcccactgcggaagagtgttcaacagcttccaagacgcggtcaggatcaccgcgatatgagcgccgcactacggctagtcacagatacgggcactggcacgagcgacggcgagctaccgccattgcaacggtacgagatctggatgaagggccgcggcctgtcagcccgcaccatcaccgactccatgctgacgctgcggcgccttgaacgcgtcactaggcggccggcacacgcggttgcggcactggcgatttcacggttcctcgccgacgaggcgctgggcccgcggtcacgctacacctaccacgtccagttggcagggttcttccgctggctggccaacgaagacggcgcccccaacatcatggcgcagatcccgcgtccgcggctgccgcgcagtgttccgcgacccatcaccactggtcagcttcaagcgctgttggcggtccgaatgcacaagcgcaccagggtgatgatcttgctggcggccttcgccgggctgcgggcccacgagatcgcgaaggtgcgtggccaagacgtcgacccggacgctcggacgctgcacgtggtcggcaagggcggtcatgcggcgacgattccgctgcatccggtgctagttgaagcggctgagacgatgcctcgtcatggttggtggttccccgccaattcccggcgccccgggcagcacgtcctgtctcggggcgtcgtcgatgccatcggcgatgcgatgcgccgggccggcattcccggcggcacggcgcaccggctaaggcattggtacggaaccactctggtcgccagcggcacggacctgcgcacagcgcagacgctgttgcggcactccaatctggcgtctacggcgatctacacagaggtctatgacgaccggcgaattgaggcgatcgaccggctgacgataccgctgcccggcgaagccgagcgggcgcaggacgaccggctgcggcggcaggtggatcgttgtaagcagtccatcatccgcctgctgggcggcctggagcccggcgagcacatgtcgcgcacgaagctcagtcaagcactacggtccgacgtccggcctcatatcaacgaggcgatcgacgagctgaccgcgggcggcatgttggtcacggtcatagctggccacggccgccactacaggctcgattccgggtggaccgaccgacccgaatttcacggctagcggccggcgcggacagctgtcccggacaagtttcccggacagctgtcacccgccggtgcaaccattagacgcgaaccaaacaggagacccaatatggccaccaacgacgaccaagacgacgggaagccacccattaccgcggccgctggcggtgatgagaccgcgatcggggcggccgctgatgaaaccgagctcgtcgcgccgctcaccgtgcccgcgtccgagttggcctggtcccacgaggacagcgacgctggtgattactcgtggggccgggctgcggaacgcgccagcatcatcgtgctcgcctgtgcggcggtcgctgtcgtgatcggtttgctgacctggctcgccttgcacctacacgaccaggccaagccgacagccggcccgacggccgcgcgtccggtcacgatcgagccggcggcggcgcttcccacggtcaccgcggtgcaggcgccggccgccgcgcctccggcgacggtcacggtcacacccccaccggcgccgcctgcgacggtgactgtgcaagccgcgccggcaccggcgcctacggtggtgaagccagctcccgcgcttccgccgccgggcggcacgaccgtcttctccatctgcccggacgggcacgagggtgtcgtcggtggccacacttcttgtgcgttcgccgagaacgtccgccgcaccttctacgcctcaggcatggccgacacgttcaccgcgttctcgcccgtcaccggtgacgcgtacgaaatgacgtgcgccggcaggtatccggcctatttcgaggacgggtcgacgaaggtctcgacgcgctgctacggcggcaacaacgccgaagtggtcatctggtagttgatcgatcaccttcgagtacgagggcactgtctacggctcgaacgcgtggaagtcgaacagccgcgaccgccgctactaccgccaaggaggcacggatgggtaagagtcttgaggatcggctcgccgcgatcggcgacgcagccgaagccggcgaagcagaccagaccgaccgaccgatccctgcgcacgtcaaagtcacccgcggtaacccgcggagcaaggtgctgcaggtgcggctgaacccggaggagctggcggcgctggaggcgatcgctgaacggcgcgacctgccggtgtcgacggtggcccgcgagcagctcttgccgctggtggcagaggagttgaatcggtgactaccgatcaccccgaccagccgcggcgggaactcccaaacaccctcgcgggtcacaacctcgtcttcatctacgacgatgacgacgacgattgggatgacgaggatttcgacgcggaccatggcgactgcgcattctgtcttggccgcgaagccgcccaccgcggcgaaagcgaagaccagaacccctactcgaagaccggcgcgcggcccggctcaaccgaatggtacgaaaccgactacgggctgtggctcctcggccacgacgtcggaactaagattgaccctgaaatgagttgaggtcaaacagttctgggcaagaaggcgcgtcgccaagcttgatccgcccatctgtcgaaccttcctcgtgctcacccggtgccgcccgcggtgccgcggaactgcgtcccgatcatgttggctgagttcgccatcgccgcctgggaattcaggccctcgtggagctgcttgggatcgttggcctgcacgtgcactgggcccatgatctggatcggcgcctgcggctgagtgttaccgacgttggcgtactggtcggaggaggcgttggaggcgaagggctgctgggtttggccggcggtgttctgctggccggccgtccgcacaccggtcacgcccatcagcaggcggccggggatggttttcgaccaatccgccccggtcgcatcggaattcgggatcaacgcctccagcaggccttcgacgccgatgccgacgtcctgggcgccgtaggcggcggcccggttgagctcttggaagccgatgttcatcgcggaggagacggcgccgccggcgccgccgaaggtgcccatgtcggcgcccatcgcggcggcctgggtggccgcgccttcgaggccgccgatgatgccgccggagaaaccgatgcccggcagggctccttgcccggttccgggctgttgaacatcagcaccgggtgtcgcggtgtcggacagtccctgcttggatccggggctgaccgcgccggggccggtgggttcgtggatgctggcgttgtcgccgggcttcggcgcgcctggcggcggctcgatcgcggggccaccgggggcgccgggcgccttgaccatgttctgcggctgctgggccggcgcctgctgctgcggcggaggctccggttgatcggtcacctcgccgccgggcgcgtagtagcgcaccgacgttgggtcgatgcggccctgccggatcgcgtccatgaagccgggtccgtatttgtcgacggcctcgctgggctcgacatactcgtgaggcgagagccacgccgggatcgtgtcggtgccggacgggccgccggacgcgaaatgcgccgtcccccagcgtggatcgccgccgatgaacggacccatgggaagtggtttaggtccactaggaagggggccaccgcttcctgcaccgcccagcatggactgctgctgctcaaggggggacttcatcggaccgggcggagccgggggcgctacatgaaccgggccccagcgccaatccgagccgtgcgacggcggcccgtatgcgttcggggacggcgttgggacgggcccgagtggagtcggataccaagtgcggtagaaggagtccgatgcgccttggccgtaccagctcttgtaatccgccggtggcggggcgctatccggcgcgggcggccgggcaagcggtcccagaggtaatccgggcttcgacggagacttcacgaactcgaattcactgcctcccccagcaccagcgccgccgccgctgctgggtgcttgtccggtggtgttgccgcgggctgtgtcgagcccggcggcggccgcgtcgtcagcgcccgcagcgcccggcggcgcggcgagcggggcgggattcgggaagccgaaccgcgccgcgccgagaccaccgggggcgctcaggccgccgaagccgccaccagtgccgcccgcgccgggtggggcttggccgatcgcggcccacgccgcggtctccaacggccccagcaccaggtcttcgaggaacccgacggtccactccgcgagcccgggcagccccttggacagcccgaattggtcggccagcggcaccggcaggaatgggttctcgccgccgccggcgccgcggtggccgtgcatcgcgtggaacgtgccgcgctcggcctcggccagtcgctgctgctcctgggtgcgttcggccttgaggtggcggatctcttcgtcgaggcggtcgcgttcggactgcttggcggtggccttcagctcggagcggcgtttctcggcgttgtcgatctcggcgtcgaggtgccgcagccgttcctcggccgccgcgacgcgctgcgggttggccgtgtagtagccgggctggccgcctggcccggtgcccggtgtcgcgcccggcggaatgccgccgcccatgccgccgaaaccaccggcgcccatgccggcggcgaagccgggcatcccggtggccgcgccttccccgtacagcgtgggcaggaacatgtggtggtcgaactgggagctggccgcgccggccgcgccggcgccgatcacgaagttgccgtggctgccgccggcttcggcgttctccccgttggacagggtcatcgcggcgtgcccgtcgttggggttggggccgtggtcgtaccagcccacgctgatggagccggggccgccgatgccgggctggaaacccagtgcggccagccactggcccatgttcttcgtcgtcggcaggtttgtggccggcaaccccatcgcgccgagaattacacggccgaccatgcctgagcagtcgtcgcgggcgccctggctgtagggggttccggccagcgacgaggcgaccgcgacgtcgggggccatgccgccgtagccgagggcgccgccgccggcgcggccgagcacgatgcgcccgttcatcagatcggagcggaacttgtacacccccgagtggccgcccatcttctgcacctcgtggtgggtcaggacgtgctcaccgtccgcgccccaaaacagcgcggagtcatggcctttcgggccaggcgcgtgcagcgggccgccctcggcgtggccgaacaactggccggcaacccaggcacccgaacctgggatctccccgagcttggtgaacagattggtgtggaatctgcggtccaggctgccgaagatgtcgttggcagccatggagccggccgccgcgatgccgagggggccggcagcagcggcgagtcccgcaccgccggtcctgccgccggacaatgccgcgttggcttcgccggctgccgccgtgacgcggccttcggcggcgacttcggcgtccgcggcggccagcacctcggcttcacctgccatggccgcggggcccatgttgcgcatcgccgtgctggctgtggtggcctgggtctcgacgctgaacagcttgtccttcaacatgcccagacccgtcccgatcggtgacaggatcgtcgaggcgatgttgtagcccttgatcgccaaccatgccgtgcccattgcacccacaccgacggtcaccgcatccagcaacggcttgtgctcggtgagccaatgcgccgactccccaagcaccccaacgacttcagtcatcgctggcagaaagtcctggccgatctcgatgcgggctgcgctcaacgcccccttgaagtccttcatcttggcgttgtaggtctcctgggattcggtgaatcccttggtattgcccgcaccgtcggcctgcgcctgactgacctccttgaccgcggcagcggctttgggcccgttctccccgaccaactgcaataccgtccgcagattgtcttggccgccgaccatgagggccagcgcttggatcatcgactggacatcacccttgccggacttgagctgattgttgaagcctgtcaatgctttttcttggttccaccactgctcgacaaggttggcttcctcaacgctcaagccgccgcggtccttgcggaactgcttgtacgcctcagcattgttctggatcgccgtcgcgaccgcctgcgcctgcgcgggcagcttcgagaacatctcattagcgctgtcggccacctgcttgctcttgaaccaggcgtccagcgtgaccatccccgacgggccaagcttcgactggatcgtgtcatacaacaggttcgcggtgccgatcaggccgcgctccccgaaatgctcctgaatgtcacgggcatccaaaccgagctgtcccatctcctgggacatttgctgggttggcttggccagcgacgtgatcgcgtgcgtcatattctgggtggcctgatcagcacccatacccgactgagtgagcatcgccaacgacgcatacaggtcattgacgctttcaccaactccggccgcgaccggctcgacgttgtgcaacgcccccgcgaagtcttgcagcgaaaccttcgacaaccccacggccacattcaatttcgaggtgacgttggcggcctgctcgaccgggatgtggtagtcgtgcatcgtggtcgtgaccgcgctgatcgtctcgcccaggtccgcgccctcttcggacgcaagctgcgctgaagccgtcaacaccttgatcgcatcactgccccgatagccggccttctcgacacccagcgcagcgtccatcagcttttgaggcgcataaccgaccacgctcgacagtttcagcacgccatcgctgatcgccttcagattggccggcgactcctcggccaccgtgtgcagcctctgcaacgactgctggaaattccccgccgcatcagtcgccgagacaagccctatgcccatcgctgcgacggagccgataccggcggcgttgaagatcgggttcgccccgagcttctgcatccggctgaccgagtccgcggtctcgttgccggccttggccagccggccgtgcgcggcttcggccgcgatcatcgcgtcgatatggtcgcgctgcgagcgggcgagcatcgcctgcgcagccgcggtgcggctgctgtcgtccccgtacttcacggtggcctcggcgagccggcgctgatcgcggatcatccgggcggccgcatccgcttccacgtccgcggcgcgccgccactcctgctgcagcgccagcaaatcccggcgggcggcggtgccgtccaccgcggcgaacgccttcgacagcgaccctcccaggccgtgggagatgtcgttgccgacgcgggcgaagtgatcgaccagcgcccgggaggtcgccatgagcgcgcgctggtctatccgcgattcaacgtcgagatatacaggaattccaaccaccgcctcgcgtgagatcccagcgcttgagcgctcgcctcacacgctagagaccaagcggcacagacgcttcactgctcgcgtcggcgcgagcggtgcgcgatgatcgccggtatgcctagcggaattgagcatctacgagcgatgactgaagaggagctcatcgcggcgcacgacaacatcaactccaacagggcccttccctcgagttacttcctcgacgaattacgtcgcagagaagctgagcgcgccgagttagcgagctacaaacttgcagctgagagccacaacctggcacgacgcgttttttggctgactgtcgtcagcaccgtgttcgctggattcgctgccatcgtcgcgatcatcgctctatttctacggtaaagacccaaccgaaactattgacgatgtctcgtgtttaccggttacccttgacaggtcgcaagggaaacgaggaccatgaacagtgacatcgcggacatcgccaagtgggcgcgatcgcagggatggacagtttttgacgactcaaagggctacacccggttctacaacccgcaaggcgagtacatcaccaactacccggccacaccgagccgccccaaccgacggatggccgacctgaaagtggacctgaagaaagccggcctgccgatcccaccgccgagcaagaaagaacaacgcgcacaacgcaagaagggagacacgaagtgacgaaaaccgattgggtcatcacgttcaccttcgacgtcgacccaccgatcgagacgatggacgaatgggagtccaggctcgacggattcgacgcgtcggtcgcgcgcatcccagaccgcggcgtggacctcacggtctacgcacccggcgacctgtccatgttcgacgcactcaacaagacgatcaacgaggtcgcccacgtggtgcagtccgggccgccgatcggcctggaggtcgtcaccgagcgtgagcacacgcgccgcgccgaagctccgagcatgcccgaactgatgtcggcagcagaaatcgccgacgaactcggtgtccgccggcagcgggtgcatcagctgcgcgctacttcggcgttccctgccccgctcgcagagttgcgcgggggcgccgtgtgggacgccgccgcggtgcgcaagttcgcccaggattggcaacgcaagcccggccggccgcgaaacagcgccgtcgacagtcagcagagggactacgcgctgggacactgagcggtcggacttcaccggtcaggtttgcgttctgcacacgagcagtcgaactccctgcggccgagcccaccgagcggtcaagtcgccgtagcagcagaactcgatacgctcgcctgtatcactggtgagcgcgacttcgtgccagtcctcgtagaacgtgcggaagaacgagcgccgaaatgcgagcatcgcaggggacgccccccgctttttcttggaccacccccacccccgagcgaccgccgcgccgtcgcttttttgtgtgtacggagcgaaaaaattcgggggaacccctaatgcgaggcagaaactcgccaggtcggaagtcgctttagggccttcgtcagtccgggatcaaccgtcaccatcgacggcaagcgttgggctgtcgccgccgacatctgcgccgccctcgacatcaggaactcccgcgacgccgtaacacgcctcgacgaagctgatgtcgctaccaccgacatcaggtccggcggccagatccgcaaggtcaccgtggtctccgagaacggcgccaccgatctgatactcgactcccgcaagcccgaggcgcgcaggttccgccgctggctcacccacgaggtatggcccgcgatccgcgacactggctcctattcgacagccccaccgctgacagatcagaacgggacgtgcatgtagtccatgcccgcatcttgcccggcccgggcacgacggcattggttgagtagcgcggtaatcgggtcttggcgaagctgtccggggtgctcgctcatgccgtcgagggcatggtgtgtggccagcgccaccaagcgctggcattggatcgcgtcggagtccacgatgctcagactcctctcgggaagcgcggcacggtaactgcgccggacgccacgactacgaaatccattgctcagcttcccttctccgttttggggttccggcaccggccaccgcgccaggggacgcgccgacgaggattacgttcccgtcgcaggcagccggtgccgcctgtccgagcgctacccgagaatgacgcacggaccaggtttatggcgctcatctccatcgctattcctgggaaacgatggttatcgtcaactgaccaccagggccggccgcgaccgcgtacagcggcagcggccggccattgctcggctggcgtagcgagaacacgaagaactcgccgggtttgagccggatccccgtctgcgggtccagcgaacagcctccggagttgttgacgacgatgtcgacgccggcggcatcaccgagcccctcgctggagttgaggacttgcaccgagtcgacgtccggcggaatccctgtgatcgcagcgggtgtcgtgccgactggcaccgtcgtggtgctcatgaccctgccggcgtcccggacggcgcggcacgggccttgcgcgcgcggacagcagcagcgatggtctcgttgccccaggcttgccccctgtcgcgcagggctttccgcgcggtcggggcgccggcatcggctggcacatcgaaacggtcgagcgcggcgatgcactcgtcgacgagatcggtattggggccggcgactgcatcgctgggcgggggctgtgacagggcggccgcggcgtcgtcggggatctcctcgatgaggcccatgcgtagccagcgatcccggtagtcagggccaatccacgcaatgatcggaccaaggttgcgggcacccccgacaggtctttggtagtgatgccaaatgatcccgttctggtccttgacggccagcatctcgacgcggggactcattcggtatgccatgtcagtcaccccgcggccggtagtcgggcttggcgcgccactcgatctgaccgccacccaggtcgacgggctcgtagggctcgatgccggtcggctggtagtacccggagcctccgggtgggcgtgggatcccacgcgccgccgccgctgcggcgaaccgggggccgagcccgtacagcagcgcgttatcgcgctcttctttggaccacgtggccggatctttgccgtgcacgatgcgcacaggtggcggcaacggcgcgatcggtatgcccaaatcatcgacgcctggtgacggcggtggcgatgacgcagcgacagtctgcgatgtgggagcagatgccggcggccggatgcccatccgagcaaggactttcgcgtggacatgttcgatctgcgggtcagtagggagcttttcaggcggggccagtcccggcgccaaagccgcgaggatagccctgttgccggcgcggtctcgttgcattgcttcgcaccagaagtcgatgcggctctgcggaatccggccttcgttgtaggcagcgatgacgattcgccggtcatccgcgcgggcccgctgctcggccgcagacaccgcgtgagcgtgcttttcggcctcattctgcgcgagcttggaatcgatggcctgctgcaacgttagatcgtcgacgtccggcgaaacccccaccagccgcgcaagttccgcacgcggcacgttgaccatgcccatcacgcgctcctttcagccttgcggcgtttgtagtcctcgatcgatgcggtcgaaatcatgtactgccggccaactttccggtgctcaagatgactctcccggcaaagccaaccgacgctgcccgccttgatcccgagcatctcagcggcttccgcagtgcccacccacgcgtcatgggctgagaatacgaatccagccccgatcgggcgatcccgctcgcttcgaggcgagtgagtaaccgcggcgtacgcctcggcaagcgccgtctgcgccgcaactaacccctccgggacaccgggctgcccaggctgctgcttgagccggatgtaatcaccgagccagtgcacgaggcaccgcgcaagatccggggtgatctcgatttcgctcacccggactgcatcgaaaatcaccttgtagcgctggcgtaactcgtcgctcatcagcggtccgcgctcttcgcatcggcagcggccgcggcctgccgagctgtccgccgggccgcaatctcatcggcaatccgacgttgcggtggccgtacccgcgccgcctcgatctgcgccaggacagcggtgaactgccgcaacaacgcggccaaatcacgtttcgacccgcattcatcgatcgccgccgccaggacgtcgcgcaacgccgtcaacgcggtcaacgcatcaccggacttcgccgccttagaaaccgaattacgcggtgttacaacgtgactcgtagttccagcattacgcctgaccatcagtcaatcatccccttgacgtgtggaaatctgccaggggagagaaacaagcgacccggcggcggtcgccgaggggccccctcccctcaagaaaatcggcgggtggggtcgacgtgtgctcctcgggcattacacgtcggtgcttgggcgtgggtccgatcgcaggcgcgcaccgttggtcggcggtggctctgtgttcttctcggcgtgggtcgttgtgtctggtgtcgcgggtgaccggtcgtggccggtagctgttcatgagggctgtccctctccggcggcgagcagcacggtggccaggtctgcggtgactgcgtcgatggcggcttctcggctgccgtgctcgtattcgtaggcgttggcggctgctgcggtcaggaagccgaggacgccggcggtgactttctcgccggcggcgatgatgcgctcgatctcggtcgtgaggcgtccgtcgttgacgaggccggccaggagcacgccgagtgctgtggcgtagagggcggccagtgcctggtcatcagagggcgtggggttgtcggtggtcatggtgtgcctttcgggttggggtggatggggtgttgctttctgggtcggccgcgctgttgggtgcggagctggcccgctacgacgccgtgcggccggtgtctggcgggtagggcgttgaaccatgcgcggcagcggtcggcggccggacaccgcgaacacaggccgaggacctgggcgtggcgctgctcaacgacttcgggggcctcgttcggtgctgcttcgtcgaacaggtgatgccggccgcggcatctggcacctggcaacgacggtgcagcggccagcgcttcgaggaggtggtgcagcgcggtcatcgggtggctcggttcaacggggtcgtccctccgggatcgggttttcttgactgttttccgactgcgtcccgcgaccgcgtcctgcgtcccccctacggggggtgggacgcagtcggacgcagtcgcagtccgcttgaacgccactgcgtccggacgcggtgggacgcagtcggacgcagtcacgtgctgtccccatcggcgtcctccacaacggccctgaaccccttggcgccacgcttgcctgatatctctacgagacggcctgacaccacaaggtcatcgacgacgtcgcgcacatcgtcgtcacggaactggatgtcgacgttgcgtaactcagcgaacaacagccgcatcgacccaacagcgtggtcgggagccgcagcaacgacgcgaaagacagcgtcagccagctcggcgttcggatcgctctcaggcacgtcgtcgtccctgggcgcgaagaaccgcatcgtgaagtcaggaccgaacgcctgcgagtcatcgacgaccagagttcccatgaacgtcttgccgggcgacttcgttgcgcgcccgttggcccgtagatgcccggggcggtctttggtcacgaagacgtaggagacgccgcgcagccgccggccgaacggcgccgagttctcgagcacgaaccgagccccgtcgagcgcgttgcccttatgcaccgaaccgtaggcatcgcggcggctgccgtcgcgcaccatcgggaggtggtcgcacgccagcgtggccgcgccgacacgtaggcatggcaggatcagtcggcggcgaaacgccgcggcgccctcgacggccttgatctcgtcgccgtgcagcgccatcgcttcgttgacgccgtcgtggatgaccagcgtcggtgaagggtcaagtagtgcgttcagccactcctcacggacggggcggctgggagcgacgaaccgaaaccgggccttgatcaccgcggggtcgaccccaagcaagcacagcttctcgacggtgctcgtcgcgtcgggttcttcgtagtggatatacacgacgtcgttgccggcgttgagttctgcggcggcgcagcccaacgcgaaccaggttttaccgctttcggtttcaccgactatggcgtgctcgcgaccagggtagagcgaccgctgcccgtcggagcgtgatatgccgataccgggatgtgggcgttcgatttcgccgcgcaggtagggtccgagatcgaacgcctcccacgtggtcggctcggcgcttgcctgctgctgtcgttggccgtttcgctgcggtggttcgtccggcggttcccacgggggaacatcggcccattgcgcggcgaaatcggcagcggttagcatcgaggagccttgcgccgcaaccatggccgctgccgatggatatcctcgtggtcccggttccgtcgcccgatgcgagtccagtccgccgcagccgaaaccgcctgggacgcttcagccatggccgtttgagctgtctcgacgcgcaggacatgatgctcccccgcgacagctaaggcgagcaacttccgcggatcgccatcagccagtgccgaccaggccggtgtgcccgccggcggcaaggggccggtattcgcctgcgtgattagcgcttcgatgaactgatgagtttcccaccacgacacttgccgggaattggttgtacccggcgtttctgccgacggtgcagtaagctcagtcgtgcggttgtaggcggttgcgtggctgccgaccttgctggttgagggtcggtcccggtggtgcggggctcggccctcgacttctatcggtggaccgtttcggttctgcgtcacgacgcgccaccgaacggcttcatcgccgcgtcgagctcattaagatcgacacgcactagccggttgccgctgcgatagccggccaggcgcccgtccgcgatcatttggcggacagtgcgatcggtgacgcctaggtactcggctgcctgttgaagcgatgcccatctgcgcgcttggcgggccggagaaatagtggacgacgaaggcacgacgaaacaaaacctttcggagtgtttcggttgccgaagccgagtcccgatctagcgatccgggttccgcgcaccgcggggcttgaccggcagcctacacggaagtgccccgaaatatacggaacgtgcgccgctttgcgtgtgtggtcggaatcagttgaccgcgcatcgcggcaaccgtggtcgcgggatcgggtagtgcaacggtgccgtgatccgggcagacgatatagccgatccactcaagaggcattgcgaccgacgggtccgcatgccgtctcgagacgcgccgggtcttatcgaccgaacggatagtcagggagtccacttcacgctgccggcgctggatgtgctcggctagagttatcccgctcgcgtcatatagttctgttgccggcggcaggccgagcgctgcgagacgttcgtcgtctatgggctcgtagtgcggcacggtggtcttgccggacttgtggtgcatgagcgcgatagcgacaccgggatccgttttgtcggatttgacgatgccgacgcatattccgcaaccgccaatcccgcaccgcagcaccagtgttggcggcatcgcggcattcgtgagccaccactcgcgctgctcaggcaaaaggtagtcgaggttgtcatcggccatcaggccccccggttctcggcgatcttcgacagcagcgctgcaatctgtttgtcgcggccttgcgcggcgtgctggtagcgcatcgctgcctgtggcgtcgaatggcctagccgggccatgagttcggcgaggctggcgccggtggcggcggccaggactgcgccggagtgccgtaggtcgtgccaacgcaaatcgtcgcggccggctgcggcccgcgctttgtaccccaatgccggttgagggtagacggttgcagatgcctgccgcgctcgttcggaaatagcagtgaatcgcgcttcttgccaacatatttcgctaggtgtgcttcgatggccgatacgaggtgcggtgggattgcgacgtcgcggataccggcgtcagatttaggcgtggtgacttcgaatgtgccgccatgtgtgcgtaccgctgcgcggcgaatccgaatcacttcatcggccagatcgatatcgccgcgctgcaattcgatcgtctcgccgaatcggagtgcgcaccaactcgcgagtgcgaccatgagccggagacgctcgggcattgcttcggtaaggatcgggagttcctcgactgtcgcgggccggatcttgtggacgcgcttggcccgtccggcacccacgatgcggcacgggttggcgtcgatcagctcgtcgttgaccgcgctacccatgatggtgcgcaacaggctgtaggcgtggctgcgcatcgtgggtcggtttgtcagagtgcctgagtaccattcgcggacatctttcggggtgatcgaggtgagctgacgactcccaaacgctggcaagagatggtcatcgaggatggcttgatagtgctctcgcgtgcgggccttgatcggccggccggcgacctggcgccccgcgagccagcccgcggcgtacgcgccaaaggtgacgcgctcgggctgcttggcggaggcgacgtcccagagtcccctatcgatttcgcgacggcgatcggtcagccacgcttcggcgtcgatcttcgcggcgaacgtcttgggggccgtgatgtagctcccgtcaggtccggtatagcggacctgaaaccgccctgagggcaactttctgatgttcccgaatgcacgcttatcccgtttcgcgtcggcatcacgtgccagactgcgtgccaattcagaccgcctcaatcgggtcgaatgggatgaacccagtaccccattccgtgccaaatacgtgccacatgagcatacggcatgttccgcttgcttccgcttgactcacgcgatactgtgcgatgtgtgaccagctcacagccttcctgcgctggtcacgatatgaatcgccaaaccccgagatcgcctacttcaatcccagtatcgcgcaccagtatttttgcagttcagagcccttttcaagttctcggagtctgtagcgcgaactacttgtgaactacctctgcggcaacgcattgaggcggtctaggtaatgacagcacgaatctgaccgtgctgcggggtgtatcgccggaaccggctgatgtttgcgcgtctggctgggccgacgccatcgtcacggcgatcaccggcgagatcatccgcagcgtcttcgacgccggcaccgtcccgtacggtggacatcgtcgtcgacggtcacgggaaaccctggcagatgtcgccatccagaccgaggatgccgagcgactgcgcggactggccgcggttgccgctttctttgccgacgagttgcggcgtgcgaatgagagccctcggaactatccacaatcacatgctgaggggtgcttccttcgcagcgaagccgagcgactcgaagcgctgatgctctgatgcgacgaacttgccgaaaaagctgcggcaacgggggatcaccagttatacgaatatgcagtcgcgaccgcgcaaagcgcgattgatgcacttaccgcttcgttctttgtggaacgtcgcatgcgggaggttccgcgggcgccaactgaatcgggaggaagacgtgagtctgggattcgccatcgtctgcatgctgatcttcggtgcggtcgcggccgcggtcggccagaggaagcacctcccggttggccagtcgtttgcgctcggcgcacttcttggactcattggccttgttgtggtgatctgccaaaagcctggcctccctcaggcgccgcaagggatgcgcgcggtgaaatgccgtcgttgcaacgcggttcagaacgtgccagagaacgagcgcgtgtatgaatgctggcaatgcaaggcagctaacgaactgtggccagcacctccggtcagcggcggtaagccgcaagtggtgaacgctcctattcagaccgccaaggtgcggtgccacaaatgccagcatgtacagaccgtgccagtcgatcaggctacatttacgtgcgaggagtgccgtaccaagctcaagcggaagccgctgacgtccaacccaacgggcgaatgaaaagcgggagccttcgcaatgctcgcaccgccgggattgaacccttgttcgccatcggcttggcgcgcgcaacaggcccatctaaagtggcatcctcggattcaaagctccgagtggtcgcaacctgatcctggcccggtgaagcgaccgcccgccgcgagatgccacttcgccatcagtggcgaagggcattttctgttgtctgtctttgcaatccggcgatgagtcggaggccttcggcaatctcgggccgctccatatcgccgacccgccgtcgtgagcacccgcttctcaacccgtcaacggtgcgcgtgtggccgttcaccaaggctcggttgcgcgccagcgagtgcagcgatgcggccgccttatcgcacagaggcaggtaggtgtcgagtttgcgtatttcaaccgccgattcgtggttgtcaaacgaggcgaacgcggcataatgccggcatgcgtttcacctctgccgcggcggcggccggcatggccctcactgcgctcatcggcgcttcggcagcgcaggctgataccggcgtcaatggctacgtacagtgcgtcggtggcgatgccaagcccccgccaccggggcaacaggcagaattttggtttcccagcgttcatgtgatcgacgtcgacctcagttctggtgtgcctcccgaacaggtggtccagcggttagtggacatgggagtcaagccggaagacgccgccactcgggtgcgctgcttcatggccaacgcaccgcattagcccccaaaggctccgcgggcccgtcaccaagcgcgggctcgttgaaatatgccgcgcgacaggtcttttgaataagctctgagccccgaaagccggcccgccacctgcccaaccaggccgcccacgtcaaaaccgccccgccgtgtcagagccccgagttacgatctgcggcacgcagttacagattcgaggtggccatgcatcgcatccgacgtgtcgtcatcaccctcgttgcggcggccgcggcgatgttcccggttgccgcgttcgcctccgcgcccccggcatcggccgacccgatctgcgggacgccgggaacaccgccctgcgcgggtcccagtcccctgacaccggaacagcagtgcgccttgatcgcgtggcgctcgatgttgccgtgcaactggctaggcatgcaggtgcccgccggcaccccgggaagttgggacaacccgccggcgccaccgcccccggccgagcccccgcccccgccgccgccgtgagcctcgaccgcagacatgacggcggcgtcgcgacgtcgcaatgcgctatcttcagccggtgaccagacctgctcgcatgagcaccctcgcggcggcgctggcgctgacggcgtgcttgaccgcgcccggcgccaccgccgacccgacgccccaacagtcgcccttcccgaccggaaagtccggcaccaccatccacgtcacggagtacagcaccgcgacggccgacgtcacgctcaacagcgcgacctgggtctcgtccggctgtccgggcggcggcgggtgcaacgtcatcgaactcaccatcgccggcaaatccgacaagccgttcacctacagccaggcctcgatcaccgccgcgtccaccccgtggcgccaagacccctaccgcgacacccagggcggctcgtcgctggccgactaccagcagctcaacaagacgccgccgctgcgcgtgggcagcgtcaccaacggtcaaaccgcccacggcttcatcgcctacgacggcgccatccgccagggcgatgtctacatcgagttcaacgaccccgacgcgccggccgcccccaccccgctggccggctggaaagtccacacctgagccgcgttcagctctgcaccagatcgggcatgggctccgcgtcggtcagccagtgccgtccggtccggcgggccgcctcccacttgggaatgctcaccgcatcgtcttggcccaggtccgcgggaaccgggccgatgcgcgcggccagcggggccagcgcgcccaggtcgaagttgtacagctcggcggcggccaagcccagcatctggcgggtctcctcgacgggaatgtcccagaacgagcgccgcagccagtcgcgggtatgcggccaggttccttccgggtgcggaaagtcgttgccccacaagatgttcgacacgccgatctcgtagcgccgggccagctccctgcgctcggtggtggtggcgccgatgaaacagttccggtcgaagtacgccgagggcggcatggtcaggtcgccctccatcagatggctcatcttcttggccgaatgctcacgcagataccgggtgtccatcagccacagcagatcgttggcccagaacgcgccgcactccgtcaccccccagcgcaggcccgggaaacgctcgaacacgcccgaccacaacgcgaaccacagcggccgcgccccccaccaccgcacctcggtgacatagatgcccagatggcccccgtactcctcctgcggcgcgggaccggaatgggtgtgcaccggcatctgcaggtcttggcaggcggcccagaccttgtcgtagcgacggtcgtgatacggcgggtagccgacccagcgcgccgggatcaggatcccgccccgcaaccccgactcggccgcgcgggtgatctcggcgaccgccgcgtccacgtcggccaggatcggcaccaccgcgaccccggcccgccgctcgggactatggctgcacagctcggccagccagcggttgtgcgcccgcgccccggccatcgcccggcccgggtcgaggtcgcccgactggcccaggccggccccgaacggggcgccggccaccccggtcaccgcgtcggcgtcgggaaagatgacctcgccgaccaccccgtcgccgtcaagttccttgtcccgcaacgccacatcccacccgccggcgatgccctcgccgtgctcggagaaccactcctgcgcgaactcctcgtcgatgaacccgccggcctgcgccgcggccgtcttctccgccagatacgtctcgaagtcctcccggtattcggggtcgacgtattcgcggtagcgctcggtcggcagctcggcgtgggtgtccgcggagatgatgatgtaggggtccacgtcggtcattgagagtcctttcgcttaccaggtgcggatggggtcgggctcgaagacggtgctgctcgcgtcggcgggcacggccgccagcggctcggcgacctcggccacgctcgggccgatccggtccaccagcggcgccagcgcgtcgaggtcgaagccgtacaccctcgccgcgttcccgcccaccatggcggccacctcgtcgggcggaacgtcactaaaggtgtgccgcaacgcttctcgcgtgtagggggcggtcccctcgtagtgcgggtagtcgctgccccacatgaccttctcaacaccgattccgtgccgctcggcgcactcgaccgggcgcatgaaactcgcgccgacgtaacactggcgggcccagtactggctcggcttgagcgaaagcgaaccggcggtgggaccggcgaaccgggcgatcgccgagttcgctcgcgcgtagcgggccgcggccacgtccagcgaggccagcgtcgccggtatccacccggcgccctgctcggtgaacaccacggtgaggtcgggatgccggtccagtgcgccgctgaagatcaagtgccacaacgcccgatgcgcccaccagtgcgtctcgtacacccagacggcgaacgagctgccccacccgtcggtcgggctcggcccggcgttgccgccgtggtggttgaccaccaccccggcctccgcgcacgccgcccacagcggctcccagtgctcggcgtacagcggcgggatgccggtgccgggggcgatcccgggcagcaacactccgccgcgcaggccgagtttggcgatctgccccacctccgcaacggcttcgtccaagtcccccagcaggatctgccctactccggcgcgccgctcgggtgacagcgaacagaagtcggccagccagcggttgtgggcgcgcagcccggcccagcgcagctcgagctcccgcgcagtctccggcggcggggcggccaggctggcgtgcggaaagaacggcggcacggtgttggggtaaatcacctctcccgcaatgccttcggtgtccagctcacagttgcgccgcgcgctgttccagttgcgctcggcgtcgggctcgctcaggtcgccgaacgggttcacgtaagtctttgcccagccgtcgaattcgtcgcggtactgcggatccaggtagtcgcggtagtcgagcaggtccgcgccggcgtggcagtcggccgagatgacggtgtagcggtccatgcgctacgcccgcgccggttcgggccgcggggcggccagcagggccacgtcgtcgtagcgctggtggacgtagggcagcagccactcctgcggcacccgcgccgcgatccgcccgacctgcacagtgcgccgccggcaccaggtgatcgacgtgacctgacgaatcacgatgtcggccaccggatccagcggcgactcccccagctcgagggtgccgtcgatgttctccagcagctcgtagtgccggtggtattcaccgtagaccaggtgggggtcggtgatgccgctgccgtcgggggcgcgcaggaacttgaagtagaactcggtgttcatctggtcgggcggcaactccgcccggccactgacctgcccgctcagccggatcagccggtagcccagccggtccacgccggcggtgacgcggtcgccgtcgcgctccaccgtgatctgcgcgagtttctttggctcgccgaatgtttcgcggccgccggtgacggactgttcggtggactggggcatgaacagcggatagtcgccgtaccggtcaccgtgccgcgcggtcaccgagaacaccgccgacccgaacggcgccatcccctcgatgcggacccgctgcagctgaatacgcaccagcggttcgtcggccggctgcagcggcttgggcagcaccgccgcgacgatgtccggctccgtgaggtaaatgacggtcaccgcctcggtggcaatgggcgccttggtggcatcgatctcgtggtcgacctgggcctcgggcggacggggcccgtagcgaatgacgttgctgctcactggttttctccttggttttcggagttcccgccggcgctgcggccgagaatatcgaccaggtagtccggggcgccgcgggaaaggatcgatgccgccttgcggcgcacgacgtcgtcggacggcgcgggcgggcccatcatccagaaccggtccgccgcaatgccgtccaccaccaggtcggccaccgtctccagcggggtgaactcgacgcgggcgccggcggcctcgaaacgggccaccaccttgtccagcgtctgctcgggcgtgcggcgttgctgcgtcggggcgtagcgcggcggtcgatgccgccacgactcccagatgccggtgttcaaaaacccgcccgggaacagcacgtgcgcccgcacccgggtcccggtcatctccaggtgcgtgtacaggctctcggtcaggcacagcacggccgccttggtcatcgggtagaccgcggtggccggtccgcccatggcgccccgcgcgatcggcgcgaatccgccgttgcccgagcaggtgttgaccacgtgtccctcgccccgctcgagcaggatcggcacgaacgccttgaggccgtggatgacgcccagcacgttgacgtcgatcccccagcgccagtcggccaggtcgtgctcccacagatagccctcggacaccgcgccggtaccggcgttgttgcacaccacgtccaccgcgccgaagcggcgcaacgcctccttggccagcgcctcgaccgaggagtagtcggtgacgtcggtgaccacgccggccgcctcgatgccctcgtcggccagcgcccgcgtcgcctcctgcagcgggtcggcgagcacgtcggccagcaccaccttcatgccctcgtggccgagacgacggccgagggcccggccgatgcctccggcgccgccggtgatcaccgccaccttgccctgcaggtccgtcatggtgtggccatcgtcacacggtcgcacagagcaccacaagcgttcgcattatgcgaccattgccggcatggccgcgcgtccctcgccccaaaccgagcgggtggtgaacctgttcgagctgctggcggccgacggcagcgcggggatcaccctggccgaggtgtcccggcggttgcacgtgcacaaggccagttgccactcgatgctgtccgaactgctgcgggccggctggctcctgcgcgacccggtgcgcaagacctaccacctgggcccggccctggtgcggctcggccgcgaggccgccgcccgctacccggccccggtgctggcccgctcggtgatggacgagctggcggcggcgacgggcgcgcactgcgtggcgttctcggtgagcgaggactactccaccgtcgtcgatcaggtccgcagccgccgcggcggcgggcacccgatgccgatcggcacccagttcccgcaccgcccgccgtacggggcgtcgacggtcgcctgggcgggaaccgaggaccgggagcgctggctggccgccctgcccgacgaggtgcgcgaccgctaccgcgaggccatcgccgccgcccggcagcgcggctacgcggtgggcctgcacctgctgcccgacctgcggctgcaggaactggcgctgctggtgcgcagcgccgaggtgcgatccacccggctgagccagctggcgcaggcgctgaccgacgagctcatccaccaggaggagtggttcccgatcagcctggcccccgaccgcagctacgaggtgagccacatcgactccccgatcctggggccgggcccgagcatcgcgttgatgctcagcctggtgcccagcgccgagccgatgagcggcgcggcggtcacccggctgggtacccagctggccgccgcgacccgccggctgagcgaagcccttgccgacgagtccggttaaccgcgttgcggcgccagccgcttgagcgccagcccgccttcgaagggccggtagccgaacgcggccggggcgcgatagccggtgtccggcaccggggtgcgcacctcctcgaccgtgggcccgatcttggcggccaccggaatcagcttgtcgaggtcgaaacggtagagccgagcggcgttgccgcccaagatctttcggcaggcatcctcgggccggtcgtgcagcgcccagcggatggccaacttcgagtgcggcgcaaagccttcctcgtgcggatagtcactgccccacatgatgtgatcgggccccatgaagtcgatcatcgcgccgtcgtagggcatcagctcgctggccagatagcagttgcgctggacgtattcgctgggcgtcagggtcagcgcgtcgaccgacgagccgccgaacatcccgtaggtgcggttgtgcgcatcggatttcatggtgggcaccatggcgtcgaggacgccgagttgtgccggcacccacagggttccctgctcggtcggcacgaaccgcagcgtcggataccgttcgaacacaccggccaggatcaggtggccgagggtccgctgggcccacagtgccatctcggtgatcaacacggcattggacgccggctggtccatcggcatctccgggctgccggcccccgcgtgctgcaccacggtgaggtccagttcggcacacagggcccacagcggttcgtagtgggtgtggaaaagcggggccacctgcgaatcgccgggcgagaccggcggaatcagcacaccgccgaagcagtcctgccgcgcgccccaacggatttcctccatcgccaactcgacgtcgttggggaagatctggatcaacccgcggcgccggtcgggagccagcgaacagaaatcgacctgccaccggttgtgcgcctgcacaccggcccaacgcttttcgaactccgcgcgagtgcggggcaggctgatggtgatgttcggcgtggtcgggaagaacggcggaacggtgttgggcagcaacacctctgcggccaccccgtcggcgtccatctcgccgatccgcagctcgtggtcccagttccggttggcggtggcgacgatcaggtcgtcgaacgggctggcgtacgccttggcccaggcgtcgaactcgtcgtgcagccgcgccggcagatacggtttgtagccgtagagatccgccccggcgtgagtgtccgtcgagatgacgatgtaacggtccagcgtgtcccaggttgtagccatcgcgccctccatgaatcaggtcgagtatagggagaagccccggtgataccagcgtgttccgttccgctgggtgggagcaagatgttcgcgtgagttggacgcggtacgagacccgggccctggcggacaccagccttcgcggcgacgcgctgcacgccgccctcgaggactacatccgcgtgcagaatccacagctgaccgacgtccggctggagcgggcaaccgcgaccggggcctccggcggcccgccgggcagccgctggtatcaggtcacctacctggccgaagaccccgaccgcagcgcgtagccgccggccgattccgccgcgcgcgccccggcgtcggcgctagattgctgtcctggacacaaaggagcccagcgtgcggtcactcatcgccgtcgtcgtcgtcgcggtcggatgcccggccgcggcgctgtgggcgccccaaaccgcctgggccgacgacgacttcgtcgccctggcggtgtcggtgggcagcggacgcgccgccggctgggcgaccgcgaacagtcaggaccaggcgaaccaactcgcccttgcgcactgcaccgccgaagccggcgacgcctgcgaagtggtcgcgggcacccgcaacggctgcgtcggtggccttcgaccgcggctccgggcggttccggggcggctcgggccccgatgcggccagcgccgactccgacgccctggccaagctgggagcgccgaacgggcggatcaaagccacgcattgctcgtcgtgaccgcgagccggcgtgcgccgcggcgacgtcacccagaattcgtctatcgtttcaataagtcgtcttgattcggcccaccgcacccaggggaggccatgactcacaccaaggccggtcgtgccgcgtggccggccgcctgcgcggtcgtcctgtccgccgccgcgctgttgtgcgcggcagcggccgccgcggacgaagccgatgacgcgttcctcgccggcctggccaagggcgggatcaccatgttcgacgacgacgacgcgatcgccatgggccacagcgtgtgctcgagcatcgacgccaaccccaacgtgtcgatgctggcgctgcggctgaccaagcaaaccccgttgacgccgaagcaatccggctacttcatcggtctttcggtcgccagctactgcccgcagtacaaggacgacgtcgacccctcgctgggctggctgatcccgccgccgctgatgtgaggttgccggccggcatcggcgttctggtaggcctgggtgagccagtacaccgtgcgctcgatgccgggcacgatctcggtgacctcgatctcgccctgggcgaagcgggtcagaaacccgaacaccacaccggtgaggatgagctccagatcgttgacgaatcccggatcagcctgggccagaacgcttttcgcgacaggaacgacggcctcgacaccgcgccggatcaggcgtttaccgccgggcccggagcgcgcctgaaagtaggagcgcagcatcagcggatgccgctcccacggctcgaagatggtccgcattacgtgcatgaggtcggaatacatcgattcgccgggcagctcgtcgatcagcgacggcaaccgcgcataccggttggcgtccatccacccctccagggccgccacgatgagctcgtcgcgggtgcgatagcgcttgtagatggtggccatcgagacgcgggcccgccgggccacctcgcgcagctgcacggcctcgtagcccccggtgtcgagcatgtcgaccacgatgcccaggatcggatccccggaaacgatcggggcgccgggcccttttgccgtcacggtaaccatgttactgtgcgcgggtgagtaaccacgttactcacccctgaactgggccgccggacaagaaacgaggacgcccgccgtgggttcactagatggcaaagtcgccttcatcaccggggtggcgcgcggccagggccgcagccacgcggtacggctcgcgcgtgagggcgccaacatcatcggcatcgacatctgcgcggacatcgccgccaacggttatccgatggcctgccgcgcggagctcgaccagaccgtcgcgctggtcgaggaggccggcggcaagatgctcggcacggtggccgacgtgcgcgacttcggccaggtcaaggccgcgctggacgccggtgtggagcaattcgggcggctggacatcgtgctcgccaacgccggcatcgcgccgttggccttccggcagttgagcatcgaggaggaactggctcagtggcgggcggtcaccggcgtcaacctggacggcgcctatcacacggcgtgggcggccattccgcatctgctcgccggtaaccgcggcggggtgatcatcttcaccagttcgaccgccggcatcaagggcttcggcggcctgcagggcggcggcctgggctatgcggcctccaagcacggcatcgtggggctgatgcgcaccctggccgatgcgcttgcgccgctgaacattcgggtgaacacggtgcacccgaccgcggtcaacacgatgatggccaccaacgacgacatgatcgaattccttcagaagaatcccggcgccggcccgcacctgcagaacccgatgccggtcggcatgctcgagcccgaagacgtcagcgccgccatcgcctacctggtctccgacgaggcccgctacgtcaccggggtgacgttcccggtcgatgccggcttctgcaacaaggtctgacatggcaaccgacggcgcgacgggccgggtcgccggcaaacgggtcctcatcaccggcgccgcgcggggcatgggacgctcgcacgcggtgcggctggccgaacagggcgccgactgcatcctggtcgacatctgctgcaccccaacgggtttggactacccgctggccaccgaggaggacctgaacgagacggtgcgactggtggagaagcacggcagccgggccgtgcccaagatcgtcgatgtgcgcgacgaggccgccatgaaggcggcggtcgacgcggccgtcgacgagctcggcgggctcgacggcgcggtcgccaacgcgggtgtgctcaccgtgggcacctgggacaccaccaccgccgagcagtggcggctggtcctcgacgtcaacctgatcggggcctggaacacctgcgcggccgcgctcccgcacctgatcggcgggggcggcggcagcctggtcaacatcagctcgtcggccggcatcaagggaaccccgctgcatctgccctacacggcgtccaagcacggcatcgtggggatgacgctcgcgctggccaatgagcttgccgcacagaacattcgcgtcaacaccgtgcatcccaccggggtggccaccgggatggcgccgccgggcatgcacgcgttgatcgccgaacagcggcccgatctggtgcccatcttcctcaacgcgctgcccgcgccgctgatcgaggcgtccgacgtgagcaacgcggtgctctacctgatctccgacgaatcccgttacgtcacaggactcgagctgaaggtcgatgccggtgtcacgatcagatagcgcggcgcggcatcagcgcggggtgcgcaccttcgccgaggtgatgaccttcgacccgccggacgacgccagcccctgcgcctcggggctgatcgacttcgtcttcggcgaggtgtggtcgcggccggggctgagccggcgcgaccggcggttcgtgacgctggcctgcgtggcggccgccgacgcgcaggccccgctcgagcagcacgtctacgccgcgttgaacagcggcgacctcagcatcaccgaaatgcgggaagcggtgctgcatttcgccgtctacgcgggctggccgaaggcgtcacgcttcaacatcgtggtggaccagcagtgggccaggatcgccgcggaacgcggtgagccggcgcccgacccggagccgctgctgccgctggtcaccgccgccgatcccgagcagcggctgcggggcggcgaacgatcgttcaaggacatcaactgcctgccgttcgcgccgccgcgggacaacccctattcgggcgccggcattctcaacttcgtcttcggcgagatgtggctgcggcccgggctgggcatgaaggaacgccgcctcatcacggtcgcctgcgtggccttccaggacgccgaaatcccgatcatgtcgcatgtttacgcggcgctcaaaagcggtgacgtgtcgtttcgagagatggacgaggtggcgctgcagttcgccgcgtactacggctgcgccaaggccgaccacctcaaccaggcgatcgcggagcagaagcagcgggtgatcgccgaaaaccactccgacgccacaccggtcggctgacccatgacggctactgcgtcctcaccgccgcgtacgggtgcgttactcattggcacggaacggatcaccgcggcgtcgggcggaagccaccagcaccgctaccccggcaccggtgtgcccaacgcgaccattccgctggccggccacagcgaggtcgaccgcgccgtgcacagcgcccgggaggcgcagcgggaatggatctcctaccccgtcgatcgccgccgcgacctgctgttcgggctggccgacctgctgcgcgaccacttcgccgagctgaccgagctcaacgtgcacgactacggggtgccgatctcggtcgccggcaactcggtgctgaccgagcgattcgtgcgctactacgccggttacccggacaagctgaccggggcgagcacaccggtcagcggcgcgttcgacgtcaacatcgtcgaacgtgaaccctacggcgtggtcgccgtcatcgccccgtggaacggaccgttggtggtcgcgggcgccgccgtcgcacccgcactggcggctggaaacgccgtcatcttcaagccctccgagcttgcgtcgttggcgcccttgcgctttggcgaactctgcctggaggcggggttgccgccgggactggtcaacgtgctgccggccggcccggaaggcggcgaggcgctggttcggcaccccggagtcggcaaggtccacttcaccggcggccacgcgaccgcccagcaggtgctgcgggccgcgtcggacaacgtcacgcccgtgacggccgaattgggcggcaaatccgcctatctcgtgttcgccgacgccgacctggacacggcggccgtcatcgccgcccaccagggcccgctcacccaggcgggccagagctgcgcctgcgcctcgcggatcctggtcgaggcgtcggtgtatgtgagcttcgtggaaaagctcgtggcccaggtgcaggccgccacgatcggcgacccgctgcgccccgacgtcatgctggggccggtcatcaccgaggccgccgccgaccgcatcctcggcgtcatcgaccgggcggtcgccgagaaggccggcgacctggtcactggtgggcggcggctcgggggtgagctcgcgtccggctacttcatcgagccgacgatcttcagcaacgtggacaaccgctcgtcgctggcgcagaccgaaaccttcgggccggtggcctcggtcatgccgttcgccgacgaggcgcaggcggtcagcctcgccaacgattcccgctacggcctgaacgccttcgtcgcgaccgccaacctggaacgcgcacaccgggttgcgcgccgcttgcaggccggttcggtgtgggtgaacaggcacagcgacatcgaaccgcagggcccctacggcggatacaagcagagcggcttcggccgcaccggcggcgtcgagggcctgcacgagtttctgcaagtcaagaacatccgcatcggcatgagctgacggcgcgccggtgcgcatccggccgggaaattcacgtcgggtcggcgaaatgccgtgcagatcagatagttccgccggaagggtacagtcgcgatcatgaacttggtcgagtggctgcggaccccccgctacctgcggacgcgcttcatgatggaaacccgcccgctgaaccgcatggagatggagatcgttttcctcgaggtctccgcccgcgacgcgttgctgcggctgccggtggcgttcatggtggtgccgaaaacctcccgcccctggcgcgacgggccgtccgactccgagcgggacaagtaggggcacccggcggcggtggcggccttgcgccgggcccgaaacatgttggcgcgctggcgattccgcgtggcgccgtccggtagccgcggccgtgcccgccgatcgccatcacgtgtccgggaccgcggcacttgagcggcgctgccgagtggggcatgctggccgtatgcacgtgatcaacggggtccgcgacccggcggccagctttcccctcgacaccgcgaccgacgacgccggtgagcgccggcaagccaaccgggccgtcgccgtcagcgccgccggcctggcgctgaccgggctggtcgaactggtcatcgcggtggtgtcgggttcggtggcgctgctcggcgatgcgctgcacaacctgtccgacgtctcgaccagcgccctggtgttcgtcggcttccgcgcgtcgcgcaagctcccgaccgagcgctacccctacggctacgaacgcgccgaggacctggccggcatcggggtggccctggtgatctggggcagcgccgtggtcgccggcttcgagagcgtcaccaaactgctgcggcacggcggcaccggacacgtcggctggggcatcgccgccgcggtcgtcggggtcgtcggcaaccagctggtggcccgctacaaactggtggtaggcaggcgaattcggtcggcaaccatggtggccgacgccaagcattcgtggctggacgcactctcgtcggccggggcggtgctgggtctgatcggcgtggcgctcggctggggctgggccgacgcggtcgccgggatcgtcgtcaccgggttcatctgccacgtcggctgggaggtgaccgccgacatcgcgcatcgcctgctcgacggcgtcgaccccgacatcgtcaccaccgccgaggccgtcgccgtctcggtacccggtgtgacgcacgcgcacgcccgggcccggtggaccgggcggaccctgcgggtcgaggtggaggggttcctggatgccgccacgtccctgtcggactccgatcgcatcggccgcagcgtcgccgcgccctggccccgcggctgccgcagatgcagagcttcacctggacggcacgcgcggcctgaaaatcccagcaggccagccggtttcgaggtcagccccggccgaagcgctcgcgcagctgcgggtcgttctcccaccacaggcccgacgcggcggcgccgccggcatcgtgtgactcggcctcgtcgagttcggcgtcgaccgcgacggcgtgcgcccgctcgtcgcgggacatggcccgcatcagcagcagcacgaacggccacccgaccagatccccgaggatccacagcacaccggcgccgatggtttggtccagccgcgggtcggggccccagacccggtgcagcccagcgtaatacgacgcaccgatcagcgatccctgccagatgaccagccccagcagcccgtcgccgagcgcctccaccacggtgatcagcagcgagatcgactgcgggtagcggcgcggcaccgggtcctcctgcaggcgggcgtagaagtagccgaaacccagcgccaccaacaggattcgggtgggcgcgcccacccattcgttgtgcagggcggcggtgtaccagggcgtcagatacagcagccagggggtggccagcatccccagcgaggtggtcgccgggtgggcgagcacccgggcgatggggctggccagcaggcgatcgaggcggtcgcggccggacggccccagcgcgtcgcgcagcatcgtgaccggcgtggcctgtgcgaggaagaacggcacgacgtagagcagcagcaacacctgcagcgcgcgcacccagaacagcaggtaggcatacgtgccgacggcgctgcaggtggccgccacccacgccagcagcccggccgcaaagtaggcggcgggtgcgacgcgggccgacgccccggcccgccggtagcaccaggcgtatccggcggcgagcgccacgacgacgaccgcggagaccgggtcgagatgccaggtctgcaccgcggtgtcccaggtcagcggtccgggatcgacgcgcacggcaccagcctattgcgggccggccggctcagttgccgacggcaccctcgggcttgggaccgcggtcctccccggtgatgtacttcgggcagtagtgcgcggccgagaggtaggtgaacttggccgcgctggcgccctggaacgccgggttctggttgcgcagatcggtcacgatcttggcgtcggattggccgtcgtcgagcagctcgcacaccgacttgccgatggtgatggcgttgccggcgtcctggtaggtgatgccggcgtcgcgcaggtccttgaggaagtcctgatcgttgtcgatgtccgcgtgcgccggcgcggccagcccgatggtggcggcgagggcgcacaggcccaagaagagtcgcatagcgcaacgattgtcccaaacccggcggcgatcggcatctcgtcgggcacccgcccgcggaagggcctgcctcggaaattgacgccggcgacgcacagcaaacgattcacaccgttttcggcaattcccagcggggtgcatattagggccgcgatgttaaacgcaggtttcggccgcgctacatcgcaaacgcgcgccgtcaggaagtgctgggaggggtgtcggtcggggtggccggcgtgatgctggaggcctgatccgggcaataggcgttgacggcgatggccgcgaacgtgttggcatggtcgtcactgaggttggagttcttggactgcagggtgctgaccacgtccgacatctgcttgccgccctgcagcgtggtacacacccatttgcccgcgccggcggccttgtcggcgtcgccgtacttgatgccggctttatccagtgaggccacgaatgcgtcgtcggtgctgtcggcgcgcgcgggtacggccaacccaattaccgcggcaaatcccgccacaatcaaaaacaacttcatgaatcggtgattcttgcagagcacggagcaaaccgcatcctttccccggacggcccccgaaaccccggggcgtcaaccgcgggttgacaccaccgccagcgtcaacctaacgttgacggcatgtccgagcccatccgcatcgtccacccggtccgcctcgacgagctgatcgacgccatcaaaaccacccaccccgacgtgctggaccagctggccgacgccgtgctggcggccgagcacctgggcgaggtggccgaccacctgatcggccacttcgtggaccaggcccgccgctccggggcgtcgtggacggacatcggcaagagcatgggcgtcagcaaacaggccgcgcagaagcgcttcgtcccgcgcgaggccaccatcctggatcccgggcagggcttccagcggttcaccccgcgggcgcgcggcgcggtggtggcggcccagaacgccgcccaccaggccggcaaccgcgagatcaccccggatcacctgctgatcggtgtgctcagcgacccggccgcgctggcgacggtgctgctgcgcctgcagcacgtcgacaccgacgccctgcgcgacgccgcgaccgccgcgatcgccgcgctgcgcgccgacggtgacccgccggcgctgatcccgttcagcgggccggcccgcaaggtgctcgaactgaccgtgcgcgaggcgctgcggctcggccacaactacgtcggcaccgagcaccagttgctggcactgctggagctcgaggacggcgacgggccgctgcaccgcggcggcgtcgacaaggagcgggtcgaggtcgatctgatccgggcgctggaatcactgggcaacggcaagaacgtcggcgccggcgaagacggttgaccctcccttcggcgcgacggtgtgtgcgatcatgcgaggatgcgtcgttggctgagggtcgtgtccgccttcctcatcggcttcccggttgcggcggccggcgtcggggcggtcccgctcccccgcgcctgggccggggacgcgccgatcgggcacatcggtgacacgctgagggtggacaacggcaccttcatcgccgacgtcacggtgagcagcgtggcgccctgcgacccgcccccgggattcggctacacccgcgagggcacctacaagggcttccccggcagcaccgtcgaccgcgccgacgtgaccatccgggcgatccgggtgcccaacccctacatcctggcgaccgtgttcagtttcaacggcgtgacccccaacgccgacgcctacaagccgcgtgcctccgatgcgcccgacgcgctggacaacgtgctcgtcaacgcgccgaacggcgcgatcgtgcgcggcggggtgtactgggacgcctaccgcgaccccgtctccaacgtggtgctgctggacaagaagacgggctatcacctggcgcagtggaatctttgacgcccgcgccggccacccacgccgtccgcatcatcacgacggaatccgttgacgttcaacagcttgcggacctggccgcgcgcacgttcccgttggcgtgcccaacgtcggcggcgcgggaggacatcgcggcgttcatcgacgccaacctgtcggccgagtgtttcgcccggtacctggccgacccgcaccgcgcgatcctggccgccgagctcgacggccgaatcgtcggctacgccatgctcattcacgacctcgccggcgacgcggccgagctgtcgaagatctacgtcgcacccgaacagcacggcgccgggaccgcggccgcactgatgcgcctggcggtggacactgccggccgctggggcgtcagccgagtgtggctgggcgtaaaccagaaaaaccaacgcgcacaacgcttttacgccaagcacggcttcacggtcagcggcaccagaacctttcagctgggcgccggccgagaggacgactacctcatgagccgtacgcttcgttagcgccggcggtcagcgccaacagccgggacatggcccgcaggtacttcttgcggtatccaccggagagcatctccgcgctgaagatggtgtccagcttctcccccgaggccagcacgggcaccccggcgtcatagagccgatcggtcagcgacaccagccgcagcgcgacgttctggtcgtcgatgcggtgcacgccggtcaaaaacaccgcggtgacaccctcgatcagggtcagatagcgcgacgggtgcatggtggccagatgcgcgcacagcgcgtcgaaatcgtccagcgtcgcccccggcacgacggcggcccgcgcggccacctgtgcgtcggacagcggcggcggggccggcgccagatcgcggtgccggtagtccggcccctcgatccgcacggtggtgaaaatgcttgccagcgtgttgatctcgcgtaggaaatcctgcgcggcgaagcggccctcgccgagctgctcgggcagcgtgttggaggtggcggccaccgacacgccgcgctcgaccagcgacgagagcagccgcgcgaccagcgtggtgttgcccgggtcgtcgagctcgaactcgtcgatgcacaccgcggtgtaatcggccagcaggtccacgcattcggcgaagccgaacaccccggccagctgggtcagctcgccgaacgtcgcaaacgccttgggcgccgggccatccggtgagcgcaccgggccgtcaccgggcagctcgtagtaggccgacgccagcaggtgcgtcttgcccaccccgaacccgccgtccaggtagaggcccacgccgggcagaatctcgcgtcgtcccaacagttttcgccggccggcgcggcgctgcacggcttggcggcagaattcccggcaggccgcgaccgcggtggcctgcgtcggctcggccggatcgggctgatacgtcgcaaagctcacgtcggcgaaggtggggggcggtcgcagctgggcgatcagccgctgcggcgacaccgtgggatgccggtccaccaggtgcgccacaccggccgacgcggacgcggagccggacccgtgcatgcacgcactgtaaccgcgtgctgcaatcagacgcatggcccttccggagacgccgctgtcgctgctggggtcggtacgcgaggtcgacgacggcgaactccccggcctgtacgactatcccgacgggcacgccggaacctgggtgcgggccaacttcatcgccagcgtcgacggcggcgccaccgccgacggcagcagtggcgccatgggcgggccgggcgaccggttcgtcttcaacctgctgcgcgaactcgccgacgtcatcgtggtgggggcgggcaccgtgcgcatcgagggctactccggcgcgcagctcggcgtcgcccagcgtcagcagcgccaggcccgcggccagagcgaggtcccgccgctggggatcgtgaccaaatccggccacctgaaccgggacatggcggtgttcacccgcaccgaggtgccgccgctggtgctcacctgcgccgcggccgccgaccagacccgccggctgctcagcggcctgtgcgaggtgctggactgctcggccggcgacccggagcgggtcgacgaggccaccatgctggccctgctcggcaagcgcgggatgcggcgcatcctcaccgaaggcggtccgacgctgctgaattcgttgctcgaacgccaactgctggacgagctgtgcctgaccatcgcgccctacctcgtcggcggccacgcccggcgcatcgccaccgggccgggccagctgctcacccggatgcgctgcgcgcacgtgctgaccgacgacgccggctacctgtacacccgctacgtcaggtgctagctactgtggtcggcatgagtcggccccacccgtgcgccacgatcctggtggcggtgaccgcgttgctcgccggctgcgtcccgggcctggccgccgacccgcgcttcgccaccaattccggcgcgcggccccagggcgcggccacctccaagccggcgccgggcggcccgccgccgctcgccgccccgaaaaacgacctggcctggcacgactgcacgtcccgggtgttcgccgacgcggccgtcccgcccgcccccggcatccagctggattgcgcgaactacgacgccgacctggacccggtcaacggcgggggcggtgccctgagcatcggcgtggtgcgcgcccggtcgaatcagacaccccgcgacgcgggcccgctggtgttcaccaccggctcggacctgccgtcgtcggcgcagctgccggtgtggctgtcgcgggccggcgccgacgtgctggccgcgcacccgatcgtcgccgtcgaccgccgcggcatcggcatgtccagccccatcgactgccgggacaagttcgaccgccagcagatgcgtgatcagtcgcaattccaggccggtgacgacccggtggccaacctgtccgaggtcgccaacaccgccaccaccaattgcaccgacgcgatcgcgccgggggcgtcggcctacgacgacgcgcacgccgcctccgatatcgagcggttgcgcagcacctgggacgtgcccgcgctggcgctgatcgggatcggcaacggcgcccaggtggcgctggcctacgccgggtcgcgtccggacaaggtggcccggttgatcctcgactccccggtcgcgttgggcgtcaacgccgaagccgccgccgagcaacaggtcaagggacagcaggccgcgctggacgccttcgcggcccagtgcatcgcggtgaactgcgcgctgggccccgaccccaagggcgcggtcagcgcgctgctcgccgacgcccgcgccggcaagggacccggcggcgtgtcggtggcacaggtggccaacgcgatcaccgtcgcgctgggcttcccgtccggcgggcgcgtcaacgccaccaccgacctggccaacgcgctggccagcgcccgctccggcgacaccaacgcgctgaacaacctgatcaaccacgccaacgcgatgcaggactcggacggccagttcgtcaacgtctgcagcgacgcggtcaaccgcccgacgccggaccgggtgcgcgagctggtggtggcctggggcaagctctatccgcagttcgggaccgtcgccgcgctcaacatggtcaagtgcgtgcactggcccaccggctcgccgccgccgtcgccgaagagcctcaaggtcgacgtgctgctgctcggcgtgcagaacgacccgatcgtcggcaccgacggggtggcggcgaccgcggcggggatcatcaacgccaacgcggccagcaagcgggtgatgtggcagggcatcggacacggcgccagtatctattcgggctgcgcggttccgccgctgatcggctacctgggcagcggcaaattgcccaacaccgacacctactgcccggcctgacgctgctttcggatcgcccggcgcgccggtgtacggtgcgctggtgacggcagctgaatcgaccggcttgcgtgattggatccaggccgcctttcgtccccgcaccagcgcacccagcgtcgcgaccgtgctgcggtccgcgttgtggccgatcgccatcttctcggtgctgcaccgcagcatcgtggtcaccaccaacgggaacatcaccgacgacttcaaacccgtctaccgggcggtgctgaacttccggcgcggctgggacatctacaacgagcacttcgactacgtcgacccgcactacctgtatccgcccggcggcacgctgctgatggccccgttcggttatctgcccgagtatccctcgcggtacctgttcatcctcatcaacaccgtggcgatcctgatcgcctggtacctgctgctgcgactgttcggctacacgctgtcctcggtcgccgcgccggcgctgctgctggccatgttctgcaccgagaccgtgaccaacacgctggtgttcaccaacatcaacggctgcgtgctgctcgccgagatgctgtttttgcgttggctgctggacggccgggtcggccgccagtggtgggccggggtggccatcgggttgacgctcaccctcaagccggtgctggggccgctgctgctgctgccgctgctgaaccggcagtggcgggcgctggtgcccgcgttcgcgatcccgatcctcatcaacgcggcggcgtggccgttggtcagcgacccgatggacttcgtcacccgcaccctgccctacatcgggggcgtgcgggactacttcaacagctcgatcgagggtaacggcgtgtacttcggcctgcccacctggctgatcgtgttcatgcgaatcctgttcacgctgatcgcgatcggcgcgctgtggctgctgtaccgctactaccgcacccgcgatccgcggttctggtttaccaattccgccggcgtgctgctgctgtggtcgtggctggtgctgccgctggcccagggctactactcgatgatgctgttcccgttcttgatgacggtggtgctgcccaactcgctgatccgcaactggccggcgtggctggggatctacggcttcatgaccctggaccggtggctgctgttcaactggatgcgctacggccgcgcgctggaatacctcaagatcacctacgggtggtcgctgctgctgatcgtggtgttcagcgtgctgtgctaccggtatctggacgccaaggccgaggaccggctggatcgcggcatcgatccggcatggctgacggccgggcgcgagtagcggcgcggtgatcgcaagcgcggcgcagcgggtcaccgccattagcggcgcggcgatcgcaagcgcggcgcagccgggcgcagcgggtcaccgccattagcgctagcgtggaggcatgacgcgccggcgacgatgcagagcgcagcgatgaggaggagcgtcgcaatatgaccagtccgaaggtgcaattgaccgacgacgagtggcgccagcggctcaccccggaggagttccacgtgctgcgccaggccggcaccgagcgacccttcaccggtgaatacaccgacaccaagaccgagggcgtctaccagtgccgggcctgcggggccgaattgttccgcagcacagagaaattcgagtcgcactgcggctggccgtcgttctacgacccggcgaactccgatgcggtgatcctgcggccggaccactctttgggcacgacgcgcaccgaggtgctgtgcgcgaactgccacagccacctgggccacgtgttcaccggcgagggctacccgacgccgaccgatcagcgctactgcatcaactcgatctgcctgcggctggcgccgtcctgatttgcgaggcgcctgttgcccttgccctcgcgcgctgcgacgacacttaaaccacgcacgcgacacgccggaaacgggcgccctggtttaagtttcgcggatcccccggctccgccccggcgtcagttcatgcgtggacgacgcgtttgtgggtagcgacgccgtgcggcgcggaaccttgagccgccaccgattgcgagcgcaattccgcgccatatatcccgacatttatctgcccgcccacgccgcgcgctcgctgcgcacacgttcggtggcggcgtggttgtggtcgggccgccgcggcgtcctcgccgggttggccgccgcagcgctgcacgggtcgagctggatcgacgacgacgagcccatcgagctgatctggcgcaacccgcatccgccggccggcgtgatcacgcgcaaccagcggctcgagcccgacgagatcacccgggtcgccggtctgccggtcaccaccccggccaggaccgcgttcgacttggccaggcaacggccccgcggcgaggcggtggcgcgactcgacgcgttgatgcgggcgacaccgttctcgaccgcggaagtgctgatgctggccgagcggcgcccacgagcgcgggggctgcgaaagctgcgtgcggccctcccgctggtggaccccggagccgcgtcgccaaaggagacctggctacgcctcctgctgatcgatgccggaattccggtacccgccacgcaaataccggtccaacagaactggcggctcatcgccgtgctcgacatgggttgggaggattatctggtggccgccgagtacgacggcgatcaccaccgcaccaatcggcggcagtacgcgcgcgaccaggctcggctgcgcacgctgcaaaaactggggtggatcgtcgtccgggtgatcgccgaggacaagcctgacgacgtggtgcgacgcacacgtgatgcactaacccgtcgcggctaccgcgacacttaaaccacgcacgcgacacgccggaaaccggcgccatggtttaagtctcgcggccgaagaaaggagcagtcagtccacccgggtcgcgtgcacttcccagaacggggcgtgcacccggccgccctgcagccacggctccatcgcgcggaagcgctccagcaacttcgccgcctcgtcggccatgtcgggattgcgcgcggccatcatctgaatcgtctcggcgctgaggttgacctggtaggtggtcggccccaggtagctgatctcccagccggcggcggggagcacgtcgcgaaagtcgttctcggacaacgaccgcatcatcttgaagccgttgacgtcatgttcgccgaactcgaacatgtacagccgggcgcccggtttggtggctcgatgcagcgcccgcgcatacgagctgcgcagctcgggctcggtggcgaagacgtggtagaacgcgcagtcgaccaccgtgtcgaaccggccgtcgaagccgtccagcttcgtcgcgtcggccaactcgaaattcaccgacaccccggccttgcgggcgttggcccgggcccgctcgatggcggccgccgagccgtcgatcccggtcgccgaaaaaccttgggacgcatagtaaatcgcgtgatgacccgggccggttccggggtcgagcacctcacccttgaccgcgccgagcgcgacgagctggcggaccaccggctgcgggccgccgatgtcccacggcgtggcggcgggtaatccgtgcgacgtccgctggtcgcggtacatctcctcgaagcgggcggggtcggcgggatcgaacgatgcagtcacggcagcgaattcaccagctgctcgacgggcacccggggaccggtgaagaacggggtctccgcgcgggtgtgccggcgggcgtcggtggcgcgcagctcgcgcatcaggtcgacgatgcggtgcagttcgggcgcctcgaaggccaggatccactcgtagtcgccgagcgcgaacgccggcaccgtgttggcgcggacgtccttgtattcgcgggcggccatgccgtgttcggcgagcatgcggcggcgttcctcgtcgggcagcagataccactcgtaggaccggacaaagggatacacgcagatgtaggcgccgggctcctcgccggccaaaaacgccgggatgtggctcttgttgaactcggccggccggtgcagcgccacgctgctccacaccggcgagcacacccgccccagcgcggtggtgcgccggaaatcggcgtaggtcgcctgcagcgcctcgacggtttcggcgtgcgtccagatcatgaagtcggcgtcggcgcgcatgcccgccacgtcgtagagcccgcgcaccacgacgccgcgctcctcctgttgtttgaagaaccgcgacgcgtcgtcgacgacctcgtcccgctggtcccccaacgcgcccgggcgcacggcgaacaccgagaacatcaggtagcggatcgccgagttcagcgcgtcatagtcaagcttggccatgcgacctatggtgccacttccgcctgaagggcctcgaccgcgcgcccggccgcgcccacgcaggcgggcaccccgatgccgtccaggtagccgccggccaccgcgagcgtcggcggcaggcccgcgcgcagctcgccgaccagctcggcatggccgggcccgtactgcggcatggcgtcgagccagcgctgcacccgcacgtccaccgggcggacatccagcccgaacacggcggccaggtcggccagcgcccagccgcgcagctcctcgtcgggggtgcgggcggccacctggtcgccgaaccggccgaacgacaaccgcagcagctgcacgtccgcgcgcgtcccccatttcttggacgacagcgtgatggccttggcccgcaaccgctcgccggtggcgaccagcacgccggagcagtcgggaaacgcggtgtcgcccggcaccgcgagcgccagcaccaccgacgacgcggcgacgacgcggccggcggcggcggcgctgcgcggggcgatcccggccagcagccgcgcgacctcccgcgccggcacggccaggatcaccgcgtcggcgtgccggcgggcaccggcgtcgtcgaccacggcccatcccggcccggcgggttccagccgggccgccgcggcccggacccgccgcgggcgggcgcgcgcgaccagctcgtcgaccagcacccggtagccgccgtccagcgcaccgaacaccggcgccccggtggccggcggcagggcgcgccggaccgcgtcggtcaggctggcggcgccgcggtccagggccgccgccacggtgggggcggccgcgcgcagcccaatggtggccgccgagccggcgtacaccccgctcagcagcggatccaccgaccgcgacaccacctgctcgccgaaccgatcgcccaccaggtcggccaccgcgggatcgctgccggggcgccagtgcagcggccgccgcggttcggcgtcgatgcgggccagcgtcgcctcgtcgaccagtctggccatcgacgccgccgacgacgggatgcccaccaccgtgccggtgggcagcgggtgcagccgtccccggctgtagatcagcgggcgtgcgccggtcgaaacgcgttggcggccagtcagattcacttcactcagcagcgcgggcagctcggggcggcgtagcacgaacgcctcggcgcccaggtccatcggcacgccgccgaccggctcggtgcgcaggatgccgccgagctgcggcgccgggtcgagcagcgtgatcaccgcgtcgtcgccggccgccacccgcagccggtaggccgccgtcagccctgaaataccgccgcccacaacacaatacgagcgggccgtcatagcgagtggaccagtgacaccagctcggtcagcacaccgggatcggtttcgggcagcaccccgtggccgaggttgaacacgtgcccggccgcgccggcgtcgacggcgcgccgcccgtcgtccaccaccgcccgcgccgccgtctccaccaccggccacccggccagcagcaccaccggatcgaggttgccctgcagcgcggtgccgggcatcacccgggtcgccgcgtcggcgagcgcggtgcgccagtccacgcccaccaccgtcgcgggcgccggtttgagggcggccgacatcgcccccaacagttcggcggtgcccaccccgaagtgtgtcatcggcacgccgtaatcggccagcgccgcgaacacccgggcgctgtgcggctgcacgtagctgcggtagttggccagcgacagcgccccggcccacgagtcgaacacctggacggcgtccaccccggcgtccagttgcacccgcaggaagcccacggtgatgtcggtcagcttctccatcagggcgtgccagctgtccgggtcggccagcatcatcgccttggtgcgggcgtggtggcggctgggcccgccctcgatcagataggacgccagcgtgaacggcgcacccgcgaagccgatcagcggaacctcaacgagcgcggacaccagcagccgcaccgcatcggcgatcggctgaacccgttgccgctcaagcggtttcatcgcggccacgtccgcggcggtgcgcaccggcgacgcgatcaccggcccgacgcccgccacgatgtccaggtcgatgccggcgcccagcagcgggaccacgatgtcggagaacaggatcgccgcgtcgacgtcgtgccggcgcaccggctgcagcgtgatctcgcagaccagctcggcgtcgaaacaggccgacagcatgtcgtgctgagcccgcagcgcccggtattcgggcagcgaccggccggcctgccgcatgaaccacaccggaacccggtggggtttgcggccgttcaccgcggccagatacggcgactcgggaaggtcgcggcgggtacgcgcgctgctgttcatcgggctcaatgctgccatgacggcgtcgctgcgtagtatcgacgaccgtgccagtcagccacccgccggtcgattaccacgacttccccagcctgcgctgcgaactcggcgacgacggggtgctgacggtggtgctcgactcgccgggtctgaattcggtggggccgcagatgcaccgcgacctggccgacatctggccggtgatcgaccgcgacccggcggtgcgcgcggtgctggtccgcggtgagggcaaggccttctcctccggcggcagcttcgatttgatcgacgagaccatcggcgactaccagggccgggtccgcatcatgcgggaggcgcgcgacctggtgcacaacatgatcaactgcgacaccccggtggtgtcggcgatccgcgggccggccgtgggcgcgggcctggtggtggccctgctcgccgacatctcggtggccggccgcaccgccaagctgatcgacgggcacaccaagctgggcgtggccgccggcgaccacgccgccatctgctggccgctgctggtcggcatggccaaggccaagtactacctgctgacctgcgagacgctgctcggcgaggaggccgagcggatcggcctggtgtcgctgtgcgtcgacgacgacgacgtgctgtccaccgccgcgggcatcgccgggaaactggcgcagggcgcccagcacgccatccaatggaccaagcgcagcctcaaccactggtaccgcatgatgggccccaccttcgagacctcggtggggctggaattcctcagtttcagcgggcccgacgtgcaggaaggcctggccgcgcaccgggagaaacgcgccgcccgcttcaccggcggatctgccacctgagctggacatatagctttggtggaggcccggtaacggcttggtcgcggcgggtgtataacccggcgcgcctgtcgcggcgtgtcggccgatgggtctaccgtcgatccctgtgacccgcgctgtgacgatgcagaacggccgggatgaacaggagcggcgtcaagtgacctcatccgaaccggccccattccgcgaggcggtagcggcgatgaacgccgtcgtcatgcggccggagatcgagctgggtccgatccggccgccgcaacgcctggcgccccacagctacgccctgggcgccgaggtcaaacatcccgaccgcgaaatcattccggaacggtccgacggtgacgccttcggccggttgatcctgctgtacgaccccgaaggcgccgacgcctgggacggcaccatccgcatggtggcctacatccaggccgacctcgaccccagcgaggcggtggatccgctgcttcctgaagtagcgtggagctggctggtcgaggcactggagtcacgcatggaacacgtcgtcgcgctgggcggcaccgtcaccgccaccacgtcggtgcgctacggcgacatctccggaccgccgcgtgcccaccagctcgagctgcgggcgtcctggaccgcgacgtcgcccgcggtgggcgcgcacgtgcaggcgttctgcgaggtgctcgagcacgccgcggggctgccgcccgccggagtcaccgacctgagctcgcggtcacgcgcctagcatgggcgaaccgtcggccgaggggccgggtagcggcgtgcccgctcccatcccgctgccgcacccgtccgaaggcgtcccgccgatctcggccagcgtgcccgacatcgaggacgcggcgcggcggctggaccgcggccgcgggccgttcgcggtggacgccgagcgggcgtcgggattccgctactccaaccgggcctacctgatccagatccgcagggccggggccggcaccgtgctgatcgacccggtgagccacggcgccgacccggtgcgagcgctgcgaccggtggccgaggtgctcggcagcgacgagtggattctgcactccgcggatcaggacctgccctgtctggcggaggtgggcatgcggccgccggcgctgtatgacaccgagctggccggtcggctggccgggttcgagcgggtgaacctggcgaccatggtcgagcggctgctgggcttcgggctggccaagggccacggcgcggccgactggtccaagcgcccgctgcccgccgaatggctcaactacgccgccctggatgtggagctgctcatcgagctgcgcgccgcgatcgccgacgtgctggcggagcagggcaaaaccgattgggccgcacaggaattcgactatctgcgggaggcgggttccaaggagccgggccccgccgcgcggcgcgaccggtggcggcggacgtcgggaatccatcgggtgcgcgatcagcgcggcctggccgcggtgcgcgaactgtggttgacgcgcgaccgcatcgcgcagcgccgcgacatcgccccgcggcgcatcctgcccgactcggcgatcatcgaggccgccctggccaacccgacgaccatcgaggagctggtggcgctgccggtgttcggcgggcgcaatcaacggcgcagcgccgcgacctggttggcggcgctggatgcggcccggcagagcgagaatccgccggtggactccgaaccgccgaacggaccgccgccgccggcgcggtggagccggcgcaaaccggaggcggccgcgcggctggaggccgcgcgcgcggcgctggccgaggtgtccgaacgcgtgcacgtccccaccgagaacctggtcgcgccggacctagtgcgacggctgtgctgggactgggagcccacccccgacccgttcgcggcggtcgacgcgttcctgtgcgccgggcacgcccggccctggcagcgcgaattggtggatccggtcctggcccgggcgctgcagcagccgctgccggcggttgcggacgacgacggctgacgcgcaccggccgcgccgggccgggcgggcgctgagacccgtgactagtcgaggtgctcgcggatctcggcctcggccacgccgctgcccagcgcggcgacccagccggtgatgcggcgggcgatgtcctgatcggtcagcgccagatccgccagcagctccccgcgcgaggcgtgctcgtagaaccgctgcggcaatccgacgtcgcggcacgggacgtcgagctcggcgcggcgcagcgcggccgagaccgccgaccccaccccgccgttgacgccgttgtcctcacaggtgaccaccagcttgtgccgggccgccagctccaggatggaatccgagaccggcagcacccagcgcggatcgacgaccgtgacgccgatgccctgatccgccagccgcctggccaccgccagggccatcggcgcgaacgcgccgacgccgatcagcagcacgtcgtggttgcagccgctggccggcagggccagcacgtcgacgcccgacaggccggagccgcgccgctcgatcgccggaatgtcctcgcccacatcacctttggggaagcgcagcgccgtgggcccgtcgtcgacgtcgagcgcctcgccgagctcctcgcgcaaccgggcggcgtcgcggggtgcggccacccgcatgccgggcacgacgccgaggatggacaggtcccacatgccgttgtggctggcgccgtccgaaccggtgatgccggcccggtccagcaccatggtgaccggcagccggtgcagcgcgacgtccatcatgatctggtcgaaggcgcggttgaggaacgtcgagtagatggccaccaccgggtgcatgccgcccatggccaggccggccgccgaggtcatcgcgtgctgttcggcgatgccgacgtcgaacaggcggtcggggaactgctggccgaacggcgtcagcccggtgggcccgggcatggccgcggtgatggccacgatgtcgcggcgcttgcgggcgtagccgatcagcgcgtcggagaaggtcgccgtccagccgggcccggcgaccttggtggcctgcccggtgaccgggtcgatcacgccgcaggaatgcatctggtcggcctcgtcgtcctcggcgggcgcgtagcccatccccttgcgggtcaccacgtgcacgatcaccgggcgcccgaagccgcgggcatggcgcagcgcggcctccaccgcgcgttcgtcgtggccgtcgacggggccgacgtacttcagcccgaggtcggtgaacagcagctgcggcgacagcgagtccttgatgccggccttgacgctgtgcatcacccggtaggcgaacttgcccaccagcggcagcgcccgcagcgcgtcgcgaccccgctgaagcgcctgctcgtaggcgggttgcagccgcagcgtggccaggtggtcggccaccccgccgatcgtcggcgcgtagctgcggccgttgtcgttgaccacgatgatcaccgggcggccggacgcggcgatgttgttcagcgcctcccagcacatgccgccggtgagcgcgccgtcgccgaccaccgcgaccacgtgccggttgcggtgcccgctcagctcgaaggccttggccaggccgtcggcgtaggacagggcggcgctggcgtggctggactccacccagtcgtgttcgctttcgctgcgcgacggataccccgacaggccaccctttttgcgcaggctttcgaactcgtgcgcccgccccgtcagcatcttgtgcacgtaggcctgatggccggtgtcgaagatgatcgggtcgtgcggcgagtcgaacacccggtgcagcgcgagcgtcagctcgaccacgccgaggttgggccccagatgccccccggtggcagcgaccttgtggatcaggaactcgcgaatctcggcggccagttcgcggagctgatgcgtcgaaaggtgctgcagatcagcgggcccgcggatctgttccagcatcccgtcagtctacgcagcgcccggcggaacactactgatcaatgtggccggcgctcgtcgtattgtcctgggtatgcgcgcggcggaactggccgaggacttcccggtcgtctcggtcgactccgacgccctggacgccacccggctgctggccgagcaccggctgcccgggatcgtcgtcaccgacgcgtccggtaaaccgttcgcggtgctgcccgcctcacaggtcgtgcgcttcatcgtgccccgctacgtgcaggacgatccgtcgctggccggggtgctcaacgagtcggtggccgaccgctgcgcggaaaagctgcgcggcaagacggtgcgcgacgtgttgccggaccacctggtcgacgtgcccccggccgacgcggacgacaccatcatcgaggtggccgcgctgatggcgcggctgcgcagcccgctcgtcgcggtggtcaaggacggccggctgatcggggtgatcaccgcatcgcgggtgctcggggcggcgctgcggccttgaatcgggtgggacatagatgagcgtcatcgcgattgcggtgttcgtggtggcctacgccctgatcgccagcgatcgcgtcaacaagacgttcgtcgcgctggccggcgccgcggtggtcatcacgttgccgatgatccgttcggacgacgtcttctactcgcgcgagaccggaatcgattgggacgtaatctttttgctgctcggcatgatgatcatcgtcagcgtgctgcgccaaaccggtgtcttcgagtatgtcgcgatctggtcggccaagcgggcccggggttccccgctgcgcgtcatgatcctgctggtgctggtgaccgcgctcgcgtcggccctgctggacaacgtgaccacggtgttgctgatcgccccggtgaccctgctggtgtgcgatcgcctggcgatcaccgcggccccgttcctgatggccgaggtgttcgcgtcgaacgtcggcggcgcggcgacgttggtcggcgacccgcccaacatcatcatcgccagcaggggcgggctgagtttcaacgacttcctggttcatctggctcccatcgtggtcatcgtcgtcggcgtgctgattgcgttgctgcccaggctttttcccggagccttcaccgtcgatcccgagcgggtggccgacgtgatgtcgctggaggaaaaggaggccatccgcgatccccggttgctggtcacctgcggggtggtcttgctggcggtgttcgcggcgttcatcgcccacgggccgctgcacctggaaccctcgctggtggcactgttgggcgccggcatcctggtggtggcgtcgcggttgcagcccgccgactacctgtccggcgtggagtgggacacgctgctgtttttcgccggcctgttcgtcatggtcggcgccctggtgaagaccggcgtcgtcaaacaccttgcccgcctggcgatcaccgccaccggcggcaacaccctgaccgcgacgatggtcatcctcgtcgcgtcggtcgtcatcagcgggatcgtcgacaacgtcccgtacgccgcgacgatggcgccggtggtcgccgacctggtgccggccctgggcgatcacgccaaccccgcggtgttgtggtggtcgctggcgctgggcacggacttcggcggcaacctcaccgcgatcggcgccagcgccaacatcgtgctgctcgggatcgcccgccgggccgacaatccgatctccttctgggagttcacccgcaagggcgtggtggtcaccgcggtctcggtcgcgctgtccgcgctgtatctgtggctgcgctatttcgtgtggggctgattcggcgtcgagcgtggggcctgggtacgaacctcgttcgtttttcgtccataccccccacgctcggcgagtgcgaaactcaccgcgtcagcagcgcgacgcattcgctgtgatgggtgagcgggaacgcgtcgaacaccctgatcttctcgatggtgtagccgtgccccaggtagattcccatgtcgcgggcgaaagatgctacctcacaaccgatgtggacgatgcggggccggcggcggccagcgagtcgatgacctcgcgcccggcgccggcccgcggcggatccagcaccgccacgtctgcttgcaaggcgggggttcgttgcgccgccagggcgcggcgcaccgagtcggtgaccacctgcacctgcggcaggtcggccagcgccgcccgggcggcccgggtggacgcccgcgaggtgtcgacgctgagcacccgcccggacgcgcacacggcctcgcccagcgccgcggcgaaaacgcctgcgccgccgtagagatcccacgcggtcatgccggcgccgggctgcgcccagtcgagcaccagggcgcggtaggtcgccgctgcgtcgcggtgcgcctgccagaacgcggtcaccggcacccgccagctgcgcccgctcacccgctgcaccgcctcgtagcgtccctcgatgaccttggtcgcggtgcgccggccctgccgcagggtgcgcaccacgtggcgggcgccgtcgtcgtcgacggccacgtgcagctgggcggccgacggccactgggtctcggcgatgccgtccagcatgccgggcggcagctgcgcgcagcgcaggtcggtcaccaattcctcgctgtggtaccggtgaaagcccggccggcggtcggcgcccacgtccagccggacccgggtgcgccaccccgtcggcccggtattccccagcggttcggcctcgccggcccagcgatgcccgccgaggcgctccagctgattggccaccaccgcggccttgagcgcccgggccgcctcgggccgcacgaaagccaggtcgcagcacccggcgccgtccaccccggcgatcgggcacagcgactcgatgcggccgtccgccgcctcgatgacgtcgagaacctctgcgtgccaataggatccgcggtcggcggtgacccgaacccggacccgctcaccgggcagcgcgtaccggacgaacaccacccggccctcgtgatgcgccacgcagctgccgccgttggccgggctgccggtggtcagcgtcagctcgcccaccgggggcggccccgggcgggtcaatcgaagattccccgccgggcgtcgcccggggccatgtgcggctccagggtcttgcgccgctccgacgaactcagttgccagggaaccgaagtcaccatcacccccggcgtgaacagcagccgccccttgagccgcagcgcgctctggttgtgcagcacctgctcccaccagtggccgaccacgtactccggaatgaacaccgtgaccacggtgcgcggcgactcttccctggcccgcttgacgtattccagtaccgggcgggtgatttcgcggtagggcgaggcgatgaccttgagcgggacgctgatgtcggcctcctcccacttgtgcaccagatcgcgggtttcggcgtcgtcgacactgaccgtcaccgcctcgagcacgtcgggccgggtggcccgggcgtaggccagcgcacgcagcgtcggcaggtgcagcttcgacaccagcaccacggcgtggttgcggctgggcaacaccacgtcgtcctggtcggcggcctgctcggccaattcgcggttcaccgtgttgtagtgccggttgatcatcttcatgatcccgaacagcaagctcatcgcgaacagggcgatccacgccccggcggcgaacttggtgaccaggaccaccagcaaaaccgcgccggtggaaagcaatccgacggtgttgaccgcccgggagcgcatcatcttgcgccgcgcggccgggtcggtctcggtgcgcagcaacctggtccagtgccgcaccatgccgatctggctcagcgtgaacgaaatgaacacgccgacgatgtagagctggatcagcgcggtgacctcaccgcggaaggcgatgatcgccagcagcgccgccccggacaaaaacaggatgccgttggagaacgccaaccggtcgccgcgggtgtgcagttgccgcggcaggtagctgtgctgcgccaggatcgagccgagcaccgggaacccgttgaacgcggtgttggcggccagcaccaggatgagcgcggtcacggtggcgatcagcaggaacccgatgtggaagccgccgaacaccgcctgcgccagctgggtgaccagggtcttctggtagtagcccggcggcgtcccgctcagctgcgtcgccgggtcctcgacgagtttcaccccgatcttctcggccagcacgatgatgcccatcagcagcgtgacggcgatgccgcccagcatcagcagggtcgtggcggcgttgcgcgacttgggtttctggaatgccggcaccccgttgctgatcgcctcgacaccggtcagcgccgcgcacccggaggagaacgaccgcgccaccaggaacgccagcgcgaagccgacgatctggccgtgctgcgcatgcatttcgaatccggcggattccgcccgcagcgggttgcccagcacgaagatccggaacagcccccagccgatcatcgtgagcaccccgatgatgaacgcatacgtcgggatcgcgaaggccacccccgactcgcgcaccccgcgcaggttcaacgccatcaccaacaggatggcggccacacagaagaacaccttgtgttcggccacgatcgggaccgccgagccgatgttggccatcgccgaggccgtcgaaaccgcaacggtcagaacgtaatccaccatcagcgcgctggccaccaccaggccggcggtctcgccgagattggtggtgaccacctcgtagtccccgccgccggacgggtaggcgtgcacgttctgccggtagctggccaccaccaccagcatcaccgcggccaccgccaggccgatccagggcgtcagcgcgtacgcgctcaccccggccaccgacagcatcaaaaacacctcttcgggcgcatacgccaccgaggacaacgcgtcggaggcgaacaccggcaaggcgatccgcttgggcagcagggtgtgactcagccggtcgctacgaaacggccgaccgataagcaaccgacgagtggcggttgaaagtttggacacgagagccaagagtaagccccggcgagtatgccggtagcgttcgtaggcgagaatgttcgccgaccgaaacggcttgccgacgtgcgttgccggtgacggcgccagacgcggccgagaggatctggatgtgcgtgtagtggtgatgggctgcggccgggtcgggtcctcggtcgccgacgggctgtcgcgcatcggtcacgacgtcgcggtcatcgaccgcgacagcaccgccttcaaccggctcagccccgaatacgccggcgagcgggtgctgggccaggggttcgaccgggatgtgctgctaagggccggcatcgaggaggccgacgcgttcgccgcggtgtcctcgggcgacaactccaacatcatctcggcgcggctggcccgcgagacgttcggcgtcaagcgggtggtggcccgcatctacgacgccaagcgcgccgaggtctacgagcgcctcggcattcccaccatcgcgaccgtgccctggaccaccgaccggctgctcaacgcgctgctgcgggagacccagacggccaagtggcgcgacccgaccggcaccgtcgccgtgtccgaggtcgtgttgcacgaggactggatcgggcaccgggtcaccgatctcgagcaggccaccggcgcccgggtcgcgttcttgatccggttcgggtcgggcgtgctgcccgagcccaagtcggtgatccaggccggcgaccaggtgtacgtggcggcgatatcgggccgcgcggccgaggcggcggccatcgccgcgctaccgccgagcgaagacctgtgaaccacgaggagcggcgcacatgaagaccgccgacgacgaaggagccggcttgccccatgggcaagccgggtacgaggagcggcgcaaatgaaggtagctgtcgccggcgccggcgcggtcggccgctcggtcacccgggaacttctggccaatgggcacgacgtgaccctgatcgaacgcaaccccgatcacgtcgacgtcgacgccatcccggccgcgcactggcggctgggcgacgcctgcgagctgagcctgctggagtcggtgcagctgcaggagttcgacgtggtggtggccgccaccggcgacgacaaggccaacgtggtgctgagcctgctggccaaaaccgagttcgcggtgccgcgggtggtggcccgggtcaacgatcctcgcaacgaatggctgttcaccgacgcctggggggtggacgtggcggtgtcgacgccgcgcatgctggcctcgctcatcgaggaggccgtcgccgtcggtgatctggtgcggttgatggaattccgcaaggggcaggcgaacctggtcgagatcacgctgcccgacgacaccccgtggggcggcaagccggtgcgccggctgcagctgccccgcgacgccgcgctggtgaccatcctgcgcgggccgcgcgtgatcgtgcccgaggaggacgagccgctggaaggcggcgacgagctgctgttcgtcgccgtggccgaggccgaagaggaactgcagaaactgctgctcggctagcggccgccggattactcgccggcggcgccggaggccagctcgaccgcggcgatggcccgctgcgccgacttgatcgcggcgtaggtgggcagcgcggccagcacggtcagcggccagcccatcccgatccgcgccgccgccagccagccggtgcggtcggcgtcgtacagcagcccctgcaccacgaagcgggcggcgaacaccagcacccagcacagcgaggcgacgtcgaacgcgtacacggcccgcggcacgctgcgccagccgtcgccgcgcccgccggcccagctccacgcgtagccgaccaacgggcggcggatcagcaccgacgcggcgaccaccaccgcccacagcaacgacatccagatgcccagcaggaagtagcccttggactcccccaccacgtaggcgatcagcgcgcacagcgccacaccgaagaaccccgagatcgcgggctgcggcgagtcccggcgcaccaggcgccacagcagcaccagcgcggccacccccagcgcggccgcgatcgccgcgaccaggccggacacgctcgacgcgatgacgaacacgaccaccggcagcgacgagtagatgacaccactgactccgcctgcctgtgccagcagacgttcgggattgatgcggttagcggtcatttgttccgatgagcccggctccccgggggacgggattgcccccatgtcgtcggggacggtcaccgttgaatttcgtagtgcgggttgtagatcgccttggttccgttctccagcttgcccagccggccgcgcacccgcaaggtgcggcccgagtcgatgcccgggatgcggcgctggcccagccacaccagggtgacggtgtcgctgccgtcgaacagctcggcgcgcacgccgccggcgcaggcccggccgttacattccacgctgcgcagcgtgccgaccatggtgacctcctggccacgctcgcagtcgatcgcacgttgcgcgccggtgctggcgacctcgtcggacagttcctcggagtcgcgttgctccggatcctccgtcaaccgtcgggtgagccggcgcagatacccttgggcccccatggccactcctgacaatgctgataagcctcgacgcttccatttatgccaacggacaccgtagacctcttggttcccccgcgccaaccgactcaaacaccccggttggagccccggtgaacgccggggcactatcaaggggtggtggtcgatctgcgcggcgtcagggccgtgttgttgcccggcaccggctccgacgacgactacattcaccgggcattctcgggtccgctcgccggggtgggcgcggtgctggtggccccgccgccgcggcccgaccggttggtggcgggctatctggaggcgctgaacgacgcggcgcgccgagggccgatcgcggtcggcggcgtgtcgatcggcgcggccgtggcggccgcgtgggcgctggcccatcccgatcgggcggtcgcggtgctggccgcgctgccggcctgggccggggcccccgaggaggcgccggccgcgctggcggcacgctattcggccgcgcggttgcgcgccgacgggctggcggcgacgacgatccagatgcgcgcgtccagcccggcgtggctggccgacgagctgacccgctcgtggggcgcgcagtggccgcacctgcccgacgccatggaagaggcggccggctacgtggcgccgagccgcgacgagctggccgggttgaccgcgccgctggcggtggcggccgcgctcgacgacccgattcacccgctgcaggcgggccgggactgggtggccgccgcgccgcgggcggcgctgcgcacggtgacgctggatcagatcggcgccgaccccgccgccctgggcgcggcctgcctggccgcgctggccgagctgtagtcccgagcggccgagtcagccgccggtggtggtgcgcagctgttgcatggccgacccgtcggcgctgcgccgcgcggccggctcgttgcccggcgactgctgggactgggcttgctgcgcggcggcctgctgcgcggccgcggcctcccgcagctgctgggccatcggctcgggcagctgcaccggcagcggcgtgcgcaccggaaggggtgtgtcgccgcggcgaacgacggtgtccgccaacgccgctcgcgcttcctgctcgagtgcctccatcgtctcgtgggtgccgttgacgacgcagcggatcatccaccggtagccgtcgacgccgatgaagcgcaccacgccggcggcggtgccaaccacctcccgcccccagggcccgtcctggatgctgaccttggccgagtcgttgcgcagcgactcggccagctcggcggccacctcgcgccacagcccgccggtcttgggcgccgcgtaggccgcgatggtgaaacggccgttggccgtgacgacccaaaccgcgctcggcacaccggtttcggtcaactccacctgcagttggccggcctccggcatcgggatcagcaccgagcccaggtccagccgggccagctccgccacggcggggtcgtcgaaatcgtcgatgtcgaacggaccctcgagctcgtcggcggcctgctcgtccgcgtcgtcgtgcgccaccaccgggtcgggttcggggatctccgcgccgaccggggtgtcctcgtcgcccctgcgggcgcgcctaccgaatacagccatcagcgccgctcttccccgggtggggtgcccacctcatcgcgcctcatcgcgcctcctcgtgaaatcctcgccggcgcgcatcacagactcgcgtgtccgccggaggaaccgtggccgccgtcgccccgggacgtgccggccagcccggcctcgtcgaacgacgacacctcgaccagctccaccaactcgacgcgctgcaccagcagctgggcgatgcggtcgccgcggtgcaccacgatcggctcggccgggtccaggttgatcagcgccaccttgatctcgccgcggtagcccgcgtcgatggtacccgggctgttgacgatcgaaagtccaacgcgcgcagcaagtcccgaccgcggatgcaccaggcccaccatgccgaacgggatggcgaccgccaccccggtgcgcaccagggcgcgccggccgggttccagccggacgtcttcggcgctgtagaggtcgacgcccgcgtcgccttcgtgggcgcggctgggcagcggaagcccggggtcgagacggacgatggccagactggtcgacacggggccacagactacccttgaccgcgtgtccgatacccgcgtcgcaccgcacaacgtgcgatatcgcgaacgattgtgggtgccctggtggtggtggccgccggcgttcgcgctggccggcatcatcgcgttcgagttcaacatgggcgtcacccgccagtcctcgtggtggccgtacgcggcgctgttcgcggtggccgccgcggcgctgctgtggctgggccgcatcgaggtccgggtcaccgccgaccccgccgcgcccggcgaggtggaactgtgggccggcccggcgcacctgccggtcaccgcgatcgcccgctccgcgccggtggcgccgtcggcgaaatccgccgccctgggccgtcagctcgacccggccgcctacgtgctgcaccgggcgtgggtgggaccgatgatcctggtggtactcgacgacccggacgatccgacgccgtactggttggtgagctgccgtcacccggagcgggtgctgtcggcattacgcggctgaccgatcaggccgcgcagtcggtacagatcatcacgccgttcttctcgctggccagccgactgcggtgttgcaccaaaaagcagctcgagcaggtgaattcgtcagcctgcttcgggatgacgcgcaccgagagctcttcccccgagaggtcggcgccgggcagttcgaaagattcagcggattcagattcgtcgacgtcgacgacggacgaagccgcctcgttccgtcgcgctttgagctcctccagcgagtcctccgagacgtcatcggtctcggtacgccgtggagcgtcatagtcggtaggcattctttcccctcacatgccctcgttatccaagcatcgctttgtaccagcgtcgaacgcatccaccaaacgattcgtgcccggatcgcggccccttaaggtgtgatttacctcacacccctatttttacccttgcgctcgcttctgaacaggggtttggcgtgcgactagagtgcagctgtggtcacacaaatcaccgagggtaccgcttttgacaagcacggccggccattccgccggcgcaacccccggccggcgatcgtggtggtgagcctgctcgcggtcgccaccgccgtcatctggacggtggcgctgacgcggcccgccaaggtgcacgaggccgcggtgtgcaatcccccgcccaagtcgaccgggccggcggggtcgacggcttcggcgccggcccagctcggtgagcaggtgtcgcgcagcgccatgatggacgtgacgcccgccaagctcgccgacaccaaggtccgcgtgctcaacgccagcggccgcggcgggcaggccggcgacgtcgccggggcgatgaaagacctcggcttcgcccagcccaccgccgccaacgacccgctgtacgcgggcacccggctcacctgccagggccagatccggttcggcaccgccgggcaggccaccgccgcggcggtgtggctggtggcgccgtgcaccgaactgttcaacgacaaccgcgccgacgactccgtcgacctcgcgctgggcaccgacttcaccgcgctggcccacaacgacgacatcgacgcggtgctggccaccctgcggcccggggccaccgaaccctcggatcccacgctgctggccaagattcacgccagcagctgctgaggcgctcagtccaggatcgggtccaggccgtcgaagcgttccaggacggccagcagctcgtcggcgatcccgggcgcggcggccagcaccaacccggccccgtcgccgtcgggtgccggcagcaccacccgtgcgccggcctccgcggcgatcagcgcgcccgcggcgcggtcccacactttcaaaccgtgctcgtaataggcgtccagccggcccgcggcgaccatgcacagatccagcgccgccgagccgatccgccgcacgtcgcggaccaccggcagcatccgcgccaacagcgccgcctgcgccgcgcgccgttgccgcgcatagccaaaaccggtgcccagcaacgccatcgacacatcgtcgaccgccgcgcactgcagcggttgcctgcctgcgccgtcgctgacatgggcgccgagaccggcggccgccgagtacacccggtcgccgaccacgtcggcgaccgccccggccaccgactcgccgtcgacctgagcgccgaccgagaccgcataggcggggatgccgtaaacgaaattcaccgtgccgtcgatggggtcgagcacccaggtgaccgttccgtccccagggggcgacggctcggcgggccccccgccctcctcgccgagaatcggttcgccgggccgtaattgggccaaccggtcccgcagcagccgttccgtctcggtgtccaccacggtcaccgggtcggtcggcgtgctcttggatcgcaccgcgccgccgtcgggggcggacgccccgccgggctcggtgccgaacacctcggcgcgccggcgccggacaaacgcggccgcctcggcggccagggtctcggccaccgaacgcagccgcacgagctcgtcatcggagggcatcaccggtccatcgcatcacagtcgccgccgccgcgcagacgccgcggaccgcgcggtcgcggcgttaaggtgggcggacagcccagtgacgccgaggagattcgatgaccagcaccgactcgaccgcgcacacccccgccgccccggccgccggcccgccgccgcggcgcggcttcggcgtcgacgtcggcggcagcggcatcaagggcggcatcgtcgatatggacaccgggctgctgatcggcgagcgggtcaagctgctgaccccgcaaccggcgacaccgtcggccgtcgccaagaccatcgccgcggtggtcgacgccttcgaatggaccgggccgctgggcgtcacctatcccggggtggtcacccacggcgtcgtgcagaccgcggccaacgtggacaaggcgtggatcggcaccaacgcgcgcgacatcatcagcgccgaactgaacggccaggaggtcaccgtcctcaacgacgccgacgccgccgggctggccgaggagcactacggggcgggccgaaaccagtcggggctggtggtgttactgacgttcggcaccgggatcggctcggcggtcattcacaacggcaccctgatacccaacaccgagctcgggcacctggaggtgggcggcaaggaggccgagcagcgcgcagcgtcctcggtgaaggaacgccacggctggtcctatgagaagtgggccaaacaggtgacccgggtgctggtgagcatcgagaacgcgctgtggccggacctgttcatcgccggcggcgggatcagccgcaaggccgacaaatggctgccgctgctagaaaaccgcaccccggtggtggccgcggccctgctcaacaccgccgggatcgtcggcgcggccatggccgcgacctcggacgtcacccactgatttttggccggcacagccgtagtaccgcgcactgtcgttacaatggtgctcggcgaacgcccaaccgccagcgtgcgactggtcacgctgataccaacgccgacatcgacatagcagacactttcggttaaccatgcccactacccaccgaaagtgagcccaaacgaaggggtgtaagtggcagcgaccaaagcaagcccggcgacggatgggccggtgaaacgcaccgccacaaagtctccgtcgtcccccgccaagaggccggcggccaaggccgccaatggctccgcgcccgccaagcgggccaccaagaccgcatcgcggtccgccaagtccgaggccggcgcggcggccgaacccgccaagaagacccgctcgtcggccaagggtgccgacgccaaggcgccgtcggcgcgcgggacgaaggcggccaagggcggcccggccgatcccgacgccctcgacaccgacggcgccgtcgaggatctcgacaccgaacccgacctcgagggcgagcccggcgaggacctcgacatcgacaccgacctgaacctcgacgacctcgaggaggacgtggcggccgacgacgccgacatcgagcccggtgacgccgaggagggcgaggacgaggaagccgccgcccccaaggctgccggcgccacggtcgccgacgaggacgacgagatcgccgagccgtccgaaaaggacaaggcctccggcgatttcgtctgggacgaggacgaatccgaggcgttgcggcaggcccgcagggacgccgagctgaccgcgtcggccgactcggtgcgcgcctacctcaagcagatcggtaaggtcgcgctgctcaacgccgaggaagaggtcgagctggccaagcggatcgaggccggcctgtacgccacccagctgatgtcggagatggccgagcgcggcgagaagctgcccgccgcccagcgccgcgacatgatgtggatctgccgcgacggcgaccgcgcgaaaaaccatctgctggaagcgaatctgcggttggtggtgtcgctggccaagcgctacacaggccgcgggatggcgttcctcgatttgatccaggagggcaacctgggcctgatccgtgcggtcgagaagttcgactacaccaagggctacaagttctccacctacgcgacgtggtggatccgtcaggccatcacccgggccatggccgaccaggcccgcaccatccgcatcccggtgcacatggtcgaggtgatcaacaagctgggccgcattcagcgcgagctgctgcaggacccgggccgcgagcccacgcccgaggagctggccaaggaaatggacatcacgcccgaaaaggtgctcgagatccagcaatacgcgcgcgagccgatctcgctggaccagacgatcggcgacgagggcgattcccagctgggcgacttcatcgaggacagcgaggccgtggtggccgtcgacgcggtgtcgttcacgctgctgcaggaccagctgcagtcggtgctggagacgctgtcggagcgcgaggccggcgtggtgcggctgcggttcggcctgaccgacggccagccccgcaccctggacgagatcggccaggtctacggggtgacccgcgagcgcatccgccagatcgagtccaagacgatgtcaaagttgcgccaccccagccgttcccaggtgctgcgcgactacctggactgagcggtccgggcggaacgcaccggaagcgttgccgcccaaggcaattcagccaggtgtgaaaaatgcgtggccccggcggtgtcgccgacgtaccgtgaggcgcatgtcaaccagccgcaccgtggtccaatccgactcagccttcgaatccgacgtcggctacgcgcgggcggtgcgcgtcggcccgcacgtctgggtcgccgggacaaccggcgccgggcccgccggcgatatcgccgcccaagcgcgagatgctttgcgccgcatcgagattgcgctgcaccaggcgggcgcggcgctcgccgatgtggtgcgcaaccggatctacgtcaccgacatctcgcgctggcgcgaggtcggggcggtgcacgcggaggtgttcggcgcgatacggcccgcggccaccatggtcgaggtctcggcgctgatcgcgcccgagttgctggtggagatcgaagccgacgcctacgtggcgacgggcgggaagccgccgtcgggtcccggccggtagtcggtgaccgcgatcacagcggctcaccggcagcggcccgtacagatgcgggaacaacatcgatgcgggatcggttggcactcccggctcccaaagcagcggcgccgcaagccggtcggggtcgacgtgcaggagcaccaggtcgtcgcggccgcgatagagccggttggcgggcaggtgcacctgctgcggcgtggacaggtggatgaagtcggcgtcctgcggatcgatgcggccccggcgtcgggcgcgggcccactgtttcgccccacacaggtgcaccaggacgccgggactgacggtcacgaccgccaccctagagaccccgccgaaccaaacctgaccaggtcgtgagaaacgacacacccgataacgatcggggaacaaggcgaaaacgccatacgtctgagaaagtgaatgtacgagaacggagaagccatgaatgcaactctgacgagtcccgaactgaccagagccgaccgctgcgatcgctgcggtgccgcggctcgggtgcgcgccaagctgccttccggactggagcttctcttctgccagcaccacgccaacgagcacgaggccaagctgaccgagctggacgcggtgctggaggtcagcgaaagctagccctgccgaactcgcccgccgccaatgtgggaagtgggcgcgatttccggtaatgctggactggtatgagcgatcaggtcgcaaaaccgtcgcgccaccacatctggcgaatcaccctgaggactctttccaagagttgggacgactcgatcttctcggagtcggctcaggcgggtttttggtcggcgttgtccctgccgccgctgctgctcgggctgctggggacgctcgcctacgtggcgccgctgttcggtccggacatgctgcccagcatcctgcggcagctgatttcgacggcgcacagcgtgttctcccccagcgtcgtcaacgagatcatcgagccgaccgtccgtgacatcgccaacaacgcccgcggcgaagtggtgtcgttgggattcctgatctcgctgtgggcggggtcgtcggccatctcggcgttcgtcgactcggtggtcgaggcgcacgaccagacgccgctgcgccacccggtgcgccagcggttcttcgcgctgttcctctacgtggtgatgctggtgggcgtggtggcgacggcgccgctggtggtggtgggcccgcgcaaggtgggcgaacacatcccgctcggcctgtccaacgtgctgcgctacggctactaccccgccctgatcgtcggcctgacgatcgcggtgatgatcctgtaccgggtcgccctgcccgagccgctgccgtcgcaccggctgatcctgggcgccatgctggccacgacggtgttcgtcaccgccaccctgggcctgcgcttctacctgcgctggatcaccagcaccggctacacctacggcgcgctgtccaccccgatcgcgttcttgctgttcgcgttcttcggcggcttcgcgatcatgctgggcgccgagctcaacgccgccgtccaggaggagttcccggcgccgaagacccatgcgcaccggctgcgcacctggttgttctcccggtcgcccgccctggagcggacggtgcagacgctggccagccccatcgcgaacccggccacccagcggcgcgaggtggcgccggccgaaccgcggggctgatcagcccttcttgagccggtcgtagatctgcttgcactccgggcagacgggtgagcccggcttggccgcccgggtgaccggaaagacctcgccgcacagcgccacgacgtggttgcccagcaccgcgctctcggcgatcttgtccttcttgacgtagtggaagtacttgggcgtatcgctgcccgtcccgtcgtcgacgcgttcgtcggtctcggtgcgttcgatcgtctgggtctgcataccccatattgtgcaccgccggcggcaccggcggacgtgccgtcggacgggcggaaaccggccgagccggaaccgcccgggtgtgggacagtggaggaatgaagcacggctccgattcggggttcgatggcggattcgacgactttgaccgcaacaagagccggccagtgctcatcaccgccgccgcgccctcctacgaggagcagcaccgcgcgcgggtgcgtaaatacctgaccctgatggctttccggattccggcgctgatcctggcggcggtcgcctacggcgcctggcacaacgggctgatctcgctggcgatcgtggcggcgtcgatcccgctgccgtggatggccgtgctgatcgccaacgaccggccgccgcgcagtcccgacgagccccgccgattcgacaacgcccgccgccgcaccccgctgtttccccgcgccgagcaggcggcgctggagccgccgccagctgcgcaggcgcggtggcaaccgggcgggtgggacggaatcgatcgggaccgcccgccgtttcactgagcgtgccgccgcggcgcacttctcaggacattctcaggtcagcgacacatttctgcacgtcaacacgtgtgagatggggaaccgccgggaactcagaaggctggtctgtcgttgaacccgatgacagtacaagccgaacgggaggtcgctatggcgaacgccagcacgagcagatttgacggcgatctggatgctcaaagccccgcagcggacctggtgcgcgtgtatctgaacgggatcggtaagacggcgttgctgaatgcggctggcgaagtggaactcgcgaagcgcatcgaagcggggctctacgccgagcacctgctcgaaacgcgtaagcgcctcggggagaaccgcaaacgcgatctggaggccgtggtgcgcgacggccaggccgcgcgccgtcatctgctggaagcgaacctgcgcctggtggtgtcgctggccaagcggtacacgggtcgcggcatgccgttgctggacctgatccaggagggcaacctcgggctgatccgggcgatggaaaagttcgactacacaaagggattcaagttctcgacgtacgcgacgtggtggatccgtcaggccatcacccgcggcatggccgaccagagccgcaccatccggctgccggtgcacctggtcgagcaggtcaacaagctggcgcggatcaagcgggagatgcaccagaacctgggccgcgaggccaccgacgaggagctggccgccgagtcgggcatcccgatcgacaagatcaacgacctgctcgagcacagccgcgacccggtgagcctggacatgccggtgggctcggaggaggaagccccgctgggcgacttcatcgaggacgccgaggcgatgtccgccgagaacgcggtgatcgccgagctgctgcacaccgacatccgcagcgtgctggccaccctggacgagcgcgagcaccaggtgatccggctgcggttcggcctcgacgacggccagccgcgcacgctggaccagatcggcaagctgttcgggctgtcccgggagcgggtccgccagatcgagcgggacgtgatgtccaaactccgcaacggggagcgggccgaccggctacggtcgtacgcgagctgatagctcacccaagctaggtagcagacggtatgcccgccgcgtcagcggcgggcatactgcttgccgtcgacgcgttacacccattcacgcagctggccaagtagactcagcgtcgatggaaggtgctgaatgaacgacctggttgacaccaccgagatgtatctgcggaccatctacgacctcgaagaagagggcgtgacgccgctgcgtgcccggatcgccgaacgcctcgatcagagcgggccgaccgtcagccaaaccgtgtcccggatggagcgcgacgggctgctgcacgtcgccggcgaccgccacctcgagctcaccgacaagggccgggcgctggccgtggccgtgatgcgcaagcaccggctggccgagcggctgctggtcgacgtcatccggctgccctgggaggaagtgcacgccgaggcgtgccgctgggagcacgtgatgagcgaggacgtcgagcggcgcctggtcaaggtgctgaacaaccccaccacctcgccgttcggcaacccgattcccgggctgctggacctgggcgtggggcccgaatccggcgccgaggaggccaacctggtccggctcaccgagttgccgtccggcgccccggtggccgtggtggtgcgccagctcaccgagcacgtccagggtgacatcgacctgatctcgcggctcaaggacgccggtgtggtgcccaacgcccgggtgaccgtggagaccggccccgcgggggtgacgatcgtcatccccggccacgagaacgtcaccctgccgcacgagatggcccacgcggtcaaggtcgaaaaggtctgagccgcaccgcttctccccttcagccggccctgcagccgaacgtttcagccggccctgcggccgaatggccgccgcggcggcagccgcacgccgaactgtttggccagccggtagccggtgcgcgccaggtcccggatgtcctcgggccgcagacccgactgcaatgcggtgtccagcatgccggccatccgatgcccgggctcgcagcgcagcgcctcgaccagcgacaccccggccagcggaccgtcgccacgggcgtaggcgctgaacgcgaccagcaccagcgcctcgacccgccacggctcgggcagcgtgcgcgccagcaccgcccacagcgattcgacctcgtcggcgccctcgccgacggccagcgcgtagagcatgtcgcgcacctgagggtcactcagcgcgcagcccagcctcgccagctcggtgtcggacagcgcctcaccggatgacacccgggcggcggcggccatggccttttccacgtcgccgcgggtgcggcgcaccggattcgcccggagcgccgcggtccgccggccggcctgacgccggaccgcggccgtcaacgccgcgctgcgctcggggtcctcgacggcgatgaccgcctgcagatcggcgcgccgcgcgtagagccgcctgccgtccagcaccgccgcggcggccagcggcgacgccgacgggtcgtcgatgaggccgctggccccgcagccgtcgacgcagtgccaacggccgcccagcgcgacccggtccaccacatgcgcggcatacagctcaatgtcgttgcgcgccaacgcttctaacagcgcatcgcacagctgtcggtagtcctcgttgcagctcgggcagggcgccccggccgcgtcgacgatcaccgcgatcaccgcctcgggccgggccgcggcggtcacctcggccaggtggtcgacccggtgcgccaactcgtcggacaggtcgacgcgcagcaccgatccgagccgcccgtcctccaaagacaccagtaccaatgaactttcggggacgaagccgagaacggcgggcagcgcggcgatgagcgcgcccgggcgggaaagcgtgaagtcgggttgtcgatgcgtggtcatgagcacccacgctgacggccgccaccgtcaccgggtgcgcgcccgcgcggcagcacagctgtggatgaacccagcactgtgagttgagctgctctactgtttagcccatgagctcgccgcaagagtacgacatggtggtcatcgggtcggggcccggcgggcagaaggccgcgatcgcgtcggccaagctgggcaagtccgtcgcggtcgtcgaacgcggacagatgctcggcggcgtgtgcgtcaacaccggcaccatcccgtcgaaaacgttgcgcgaggcggtcctctacctcaccggcatgagccagcgcgaactctacggcgccagctaccgggtgaaggagaagatcacccccgccgacctgctggcccgcacccagcacgtgatcggcaaggagatcgacgtggtgcgcaaccagttgatgcgcaaccgcatcgacctgctgatcggacacggccgcttcgtcgacccgcacaccatcgaggtcgaggacccgtcccggcgcgaaaagatcaccatcagcggcaaatacgtcgtcatcgccaccggcacccggccggcgcggccctcaggcgtcgagttcgacgaggaccgggtgctcgactccgacgggatcctggacctcaagtcgctgcccacctcgatggtggtggtcggcgccggcgtgatcggcatcgagtacgcctcgatgttcgccgccctgggcaccaaggtgaccgtggtggagaagcgggacgacatgctcgacttctgcgaccccgaggtggtcgaggcgctcaagttccacctgcgcgacctggcggtgacgttccggttcggcgaggaggtgaccgcggtcgacgtcgggtcggcgggcaccgtcaccaccctggccagcggcaagcagattcccgccgagacggtgatgtactcggccggcaggcagggccagaccgaccatctggacctgcacaacgccgagctggaggccgacaaccggggccgcatcttcgtcgacgacaacttccagaccaaggtgccgcacatctacgccgtcggggacgtgatcggcttcccggcgctggccgccacgtcgatggagcagggccggctggccgcctaccacgcgttcggggaggcgtccgacggcatcaccgagctgcagccgatcggcatctactccatccccgaggtctcctacgtcggggccaccgaggtggagctcaccaaggacgcgatcccctacgaggtgggggtggcccggtaccgggagctggcccgcggccagatcgccggcgactcctacggcatgctcaagctgctggtgtccacccaggacctcaaggtgctcggcgtgcacatcttcggcaccagcgccaccgagatggtgcacatcgggcaggccgtgatgggctgcggcggcacggtggaatacctggtcgacgcggtgttcaactaccccactttttccgaggcctacaaggtggcggcgctggacgtgatgaacaaggtgcgcgcgctcaaccagttccgccgctgatctgctagcaggcgtcctgcaggtcgttggggatcgggtcgcccggtccgccggcctcggcgcgggccagcaactccgcggtctgcgcgtcgaacggcgccgagtacgacatgttggccgcgcagccgccccgctccaggccgccgatcaacccgaccacggtggtgccgctgacccagggcgccccgctggtgccgtccaccagcccctcgcaggccagcgccgggaatccggtgtcggtgaccgacgtggcggcctggcacccgatcggcgagccgcccacgccggccggatagcccagcacggtgacccggctgcccggcgggggtgtgacgcccagcgtcagcgccaaccccacccgggactcgacggcggcgccgctgtcgttgctgacccgggccaccgcgtaatcggcgtgcgggtccttgccgttggtccagcgcggatcgaggtacaccgcgtcggccttccacacatcggcgggcccgggcgcggcatcgccggcgaagccgggaacaaacgtgatcagcgacgccccggccaggcagtgcgcggcggtgatgatcaggttgccggccaccgaatgcagcaccgaaccggtgcaaacatgaagcggcccaccgtcgatgaagatcgccccgatgcgccggtccggttccaccgggcccgcgacggccttctgctcgggctggctgagccgctgcaccgggccgccgacccgcggtgcggacaccggggcacccgacacgtgctcgacgggccggtggcacgacgtcagcgacgccgccacccccaccaccgagcagagcatcaggatcggtacgcgcatcgccttcatcatgcctgaccctgccccgccgggccgacttccgcgcgtcgcggtgtggccacgggtttgctggcgcgccgcggtgcggaccccggatcggggcgccgcggattacgccggacaatggtgacgtttcagctgacagcgtgacttcgcgttcgctgttcgatgtcggtgccccgcgattcgggggacacttggtagggcaccctggagagacccccgaaaggaggcgatccccatgactcaccgtcaagacgcaggtgatcaataccagccggggcaggccggcatgtacgagctggagctgcccgccccgcagttgtcgacgtccgacgggcgcggcccggtcttggtgcacgccctggagggcttttccgacgccgggcacgccatccggctggcggccaagcatctgaaggcggcgctggattccgagctggtcgcgtcgttcgcgatcgacgaattgctggactaccgctcgcggcgcccgctgatgaccttcaagaccgaccacttcacccactacgacgaccccgagctgagcctgtacgcgctgcgcgacagcgtcggcaccccgtttttgctgctggccgggctggagccggacctgaagtgggagcgcttcatcaccgcggtgcggctgctggccgagcggctgggcgtgcgccagaccatcggcctgggcaccgtgccgatggcggtcccgcacacccggccgatcaccatgacggcgcactccaacaacccggagctgatcaagaacttccagccctggatcgccgagatccaggtccccggcagcgcgtccaacctgctggagtaccggatggcccagcacgggcacgaggtggtcggctacaccgtgcacgttccgcactacctcacccagaccgactaccccgccgccgcccaggcgctgctcgagcaggtcgccaagaccgcgtcgctggagctgccgctgaccgcgttgagcgaagccgccgaggtgatccgggccaagatcgacgagcaggtcgaggcgagcgcggaggtggctcaagtggtggccgcgctcgagcgccagtacgatgccttcatcgacgcccaggagaacaggtcgttactgactcgcgacggggacctgcccagcggcgacgagctgggcgccgagttcgagcgattcctggcccagcaggcggagaagaagttcgacgacgacgaccaggcctgacccgaccacccagccaccaccgccgccaccccggcccgacaacaaggttggcgatatgaccgagcggaagcgcaagaacacgctccgcccggtgcgggaagtgagcgcaccccgcctcgagttccgcaccattcacggttaccgccgcgcctaccgcatcgccgggtcggggccggcgatcctgttgatccacggcatcggcgacaactccaccacgtggaacaccgtgcaggccaagctcgcccagcggttcaccgtcatcgccccggacctgttggggcacgggcagtccgacaagccgcgcgccgactactcggtggcggcctacgccaacgggatgcgcgacctgctggcggtgctcgacatcgagcgggtgaccatcgtcggccattccctgggcggcggggtggccatgcaattcgcctaccagttcccgcatttggtggagcggctgatcctggtcggcgccggcggggtgaccaaggacgtgaacttcgtgctgcgctgggcgtcgctgccgctgggcagcgaagccatcgccctgctgcggctgccgctggtgctgccggcggtgcagctgatgggccgcgtcctgggcaccgcgctgggcagcaccggcctgggccgcgacctgcccaacgtgctgcggatcctcgacgacctgcccgagccgacggcgtcgacggcgttcagccggacgctgcgggcggtggtggactggcgcgggcagatcgtcaccatgctcgaccgctgctacctgaccgaggccatcccggtgcagatcgtttggggcaccaaggatgtggtggtcccggtccggcacgcctggatggcgcacgccgccatgcccggctcgcggctggagatcttcgagggctccggccactttccgttccacgacgacccggcccggttcatcgacgtcgtcgagcgcttcatcgactccaccgagcccgccgcatacgatcaggaggcgctgcgccggttgctgcgcagcggcggcggcgcgcaggccgtcaccggcccagcgcccacccgcgtcgcggtgctcagcgccatgggatccgacgaacgcagcgccacctgagtccgggccggccgcggccggggtcgtacagtcgggccatgggtatcgacgtgacggtgctgcgggtgttcaccgactcggacggcaacttcggcaatccgctcggcgtggtggacgccggccgggtcgaggtcgccgaccggcagcggctggccacccaattgggttacagcgaaacggttttcgttgaccttccggcacccggttcgtccaccgcgcacgccaccatctacacgccgcgcaccgagctgccgttcgccggtcatcccaccgtcggcgccgcgtggtggctgcgcgagcagggctcgccgatcaacacgctggcggtgccggccgggatcgtgcaggtcggctacgacgggccgcgcgcccgcatcagcgcccgctcggaatgggcgcccgaactggcgctgcacgaattcggttcggccgaggagcttctcgccgccgacccgacggagttctccgacgacaccgcgcactacctgtgggcctggaccgaccgggccgccggggcgctgcggtcccggatgttcgccgccaacctgggcgtgcccgaagacgaggcgaccggttcggcggcgatgcggatcaccgattacctgagccgggacctgcggatcacccagggcaagggttcggtgatcgaaaccagctggagcgccgaaggctgggtgggggtggccgggcgggtggtcaatgacggtgtgcggcacctggattgacgagccggcggcgatgactcctcagcgctgccggtgcagcaccgcggcgagatggtcctgcagcggctgcccgaccgcgcccatctgcaccgagtaggaaagctcgtcgccgtcgatacggaaccaacgcgcgagcgccgtcacctccttggcgctgggggtcagcccgatcgacgtggtggacatccgcatctcgatgaggccgccggtgaccgcgtagctgccgacctcgatctcggtgatgccgctggggtgggccagcaccagttcgagccgacccggttgcggcacccgcagatatccggtctcggcgtgcaacggcttgccgtcggccgccgcacgggtcttctgggcgtaggccagaaacggcttgccgacgtgggagaaggtgacctcttcgaggtagtcgaacggctggatggtggggtacttgccggagccccggccggtccaggtgcccagcagcggtgccagcgccgccaggtcgggatgcaagtcggtgggcatgaacgcgagcctaggccgacgcggtgtgcgcggcgtcgtcagcccggggtcgccacgccgcggtgctcgcgcagcgcctggatctcgcgctcgaaatcgtcggcggactcaaacgaccggtagaccgaggcgaagcgcaggtaggccacctcgtcgaggtcgcgcaacggccccaggatggccaggccgacctcgtggctgggcacctcgggcgagccggcggcgcgcacggtgtcctccacctgctgggccagcaggttgagcgcatcgtcgtccacctggcgcccctggcaggcccggcggacaccgctgatcaccttttcccggctgaacggctcggtgacgccgctgcgcttgaccaccgccagcaccgcggtttccacggtggtgaaacgccgtccgcactcggggcaggagcggcgccgccggatggcctggccttcgtcggtttcccgcgagtcgatcacccgggagtccggatgacggcagaacggacagtgcatgactgctccttcaccgtgccgacgaccgggtaccgcaggacttcgagcgtacctgcgccgacggcgccacggctaacggagccaccgggcctccgggcccgccaccggcaacagtggcatcgggtcccggaaacgttgtggcacaaggagttcagccgacgggagcgatcaacgtctggccggcaaccaatgtgggcgagttcaggtcgttgagctcgcggatgcggtcggcgacctgggcggccggcgcgtcgggtgccacccggtgggcgacgtcggacagcgactcccccgggtctacccgcaccacggcgagccggtccgggacgtgggcggccgagctcggcgcgtcgccgttgagcacctgaccgacgttggcgaccagacccagccacagcgtgatcgcccccgcggccaacgccagcccgaccgtcgtcacccaggtgaccgagcgccgccggtgcggagcaaccgacatggccaccccggtgccgtggtagcgggtcgccgccccggcgggccggacctgccccggccggcgtggacgggtcagtccgtcgcggccgtaccgaacgccctgaaccggtccgttgaccgggcgccgaagactgctcggacgcggcgcaagcgtatggatgactgtcatctgcgttcctccggtcaactagctctcgctcgtgtgttcgactctaatcgcttgtgtgttcgaaacccgaacatttgagcgaagcgtgtcgcacgagccaaacgctagatcacgccaccgacaacttcgtcggccttaccactgtcatgcagatcaggtacccggtctacgcaaaagttacacatgtgtgattccgcagttgtagggtctttaggccccaggcgggctccgcggccggcacggggtcgggcacgacacgccagtcgaacacatgtttgattctcgtcggcgacggggttacattcggtgccatggacgacagcaacgacagttcatcagccggaccggacggccggctgcacgccgtggatccctcgctgaccgaacggcagcgcaccatcctgaacgtcatccgctcctcggtgaccagccgcggctacccgccgagcatccgggagatcggcgacgccgtcggcctgacgtcgacctcctcggtggcccaccagctgcgcaccctggaacgcaagggctatctgcgccgcgaccccaaccggccgcgcgcggtcgatgtccgcggcgtggacgacgacgtggccgcgcccgccaccgaggtggccggctccgacgcgctgcccgaacccaccttcgtcccggtgctcgggcggatcgcggccggcgggcccatcctcgccgaggaggccgtcgaggacgtctttccgctgccgcgcgagttggtcggcgacggaacgcttttcctgctcaaggtggtcggtgactcgatggtcgaggcggcgatctgcgacggcgactgggtggtggtgcgccagcagcacgtcgccgacaacgccgacatcgtcgcggccatgatcgacggcgaggccaccgtcaagacgttcaaacgcgccggcggtcaggtctggctgatgccgcacaacccggcgttcgaccccattcccggtaacgacgcgaccgtgctgggcaaggtggtcacggtgatccgcaaggtgtgacgccggtcagtcggccttggtgaaaccgttggcctgcgcgacctcttcgctggacagccacagctcgggcagcgtgtcccggtacaggtcgctgcccggcgtgtagtacaggccgtagcgagcgctggccttgatcgggtaaccctccggcgcctggtaggggtcctccagcggcaggtggattgtcggccgcccgtccgggccggccagaccgttctccgaggcgtcctcctcgtccgcggcggcgtgccgcccggaccgcggtcgggtcccggcaacaccggcggcgacggcaccgccggcggcctccgccacctcctccggtccgggctgcggttccgggcgctcttcgggctgcgcttgcggcgcagccagctcggcgtattcgtcgtcggcctcggcggccgggatgccgccggtcacggcgtcggcgtcgggcggggtgtgcggcacggcgaggtcgggatactcgtcctcccggtagccgacatccgggtagtcgacctcggcgtagtcggcgtcggcgtaggcggcgtcgtcggcggtctcgggttcggcgacctccgggacggcgtcggtgtagtcggtgtagtcggcctcggcggcgggatagtcggcttcggcgagcatctcgtcggagaccaccgggatcgaatcggtgtcgaccgcgtcggggtcctcctcctcgaacccgtacccgccgtcggcgggggcctggcgctgccaactgacccgggcggcggccccggacccggccggcggctcaccggacggcggcgcgccgaagtgctcggtggccacgtcggcgtcgtcgtgtccccactgcccctcggccgcgtcgtagccgtggtcgacgccgtagccggtggcctcgggcccgggccggcggcggcgccagacgaacagcacccagatcagcagcaccagcaggaccgcgaccgggaccgcggccatcagccaccaccaatgccagctgaacttcttggggtgggccggcatggccgaactgctcggctggttctggcccgagatctgcaggccggacagcagcggcgccaggttcgacgggtcggtgctgaacgcgttcttggcccggttccaggagatcttgccgccggtgaactgctgggagatcacgtcgccgtccacggcctggtcgccgaccggcgcgcccagtttgccggccggagcgcggagtttgtcccaggcggcccgcatcgcgccgcgcaccacgaaggcgccgtggtcggccgtccagaagatcaccggcttgtcgggggccgagaaggtggcgatccggctggacggcccgatgccgccgtcggtctcgttggtggtggggaatcccaggtcgctgccggccggcccgcccagcgactcgtatttggccaggatgtcgctctccagcgcgttcgccccggtggccggggtgaagaacaccttgccgccggcgaagttctgcacgatcccgtcgccgccgaccggggtgggtccgccctgcttggcacccagcgggccgccgggcccgccggccgcgcgccaggccgtgttgatggcggcggtgggatcgatggcgacctgcaggcccttcaactggtcggccaaccccggcggttcggtgctgaactgcttggtctgccggttccaggacacctggccgccgctgaatttctgggtggacacctcgccgttgtaggtctcgtcaccgaccggcaccccgagcaccccgcccgagctgccgagcttgtcccaggccgagttgatggcgccgcgcaccacgtaggcgccgtgctcgggcgtccagaagatcaccggcttgtcgctggccgagaaggtgaccacccggctgtcgggaccggccaggcccggcacctcgttgatggccgggaagcccaggtcgctgccggccggcccacccagcgactcgtatttgtccaggatcggcccgtaggcgaatttcgcgccggtggccggggtgaagaacatcttgccgccgtcgaagtccagcgcgaacccgtccccgacgggatacacgtcgcccttgcgggcgcccagcggggaggtgtcgccgccggccttctcccaggccgccatgatcgccgcctcggcatcgccgatcgggctcgccgtcgcggcgggcgccaggagtaccgcggccagtgctgtggtcgtcaagctgaccagcgcgcttccgaccagcttgcgcatccgacctctgtgcaccttcaccaagccttccagccgacgggcatggctccctttgcggcgacgcccgtactgcgtctccggcgagcgggccgcgatggcgcggggaaaggacccactcacgatccgccttgtcgccgggctcgcattactttgctccagccaacaagaaatgcgaagtcaaattacgaattttacaaaaacggataccgcatcgatgtcgaaccgatgcggagccatgtccgaatcgcgacccggcgtgcccccggccgcgcgaaacgctagacgccgaggctgcggccgatgatttccttcatgatctcggtggtgccgccgtaaatggtctgcacccgggcatccagataggcacgggcgaccgggtattcgcgcatgtagccgtagccgccatgcaattgcaggcagcggtcgatcaggtgcacctgcttttcggtggagtaccacttggccatggcggcctgttcggcggtcagcttgtggtccaggtgcaggcggacgaactcgtcgaccatcatgcgcaccacggtggcctccgtcgccagctcggccagcacgaaccggctgttctggaagctgccgatggacttgccgaatgccttgcgctccttggtgtattccagcgtctgctccagcacctgctccatcgccgcggccgccatgacggcgatcgagatccgttcctgcggcaagttctgcatcaggtagatgaatcccatgccctcctggcccagcaggttctcggcgggcacgtgcacgtcggtgaaggacagctcggcggtgtcctgggcgtccagcccgatcttgtccaggtgccgtccccgctcgaagccctccatgccgcgctccaccacgagcagcgaaaagccctgcgcccccttgtccggatcggtctgggccaccacgatcaccagatcggagttgatccgttggtgatgaacgtctttgacccgttgagcacgtagtggtcgccctgcttgaccgcccgggtcttgatgccctgcaggtcgctgccggtgcccggctcggtcatcgcgatcgccgtaatcagttctcctgtgcagaatttcggcagccagcgctgcttctgctcctcggtggccagggccagcaggtagggcgcgacgatgtcgttgtgcaggccgaagccgatcccgctgtagcggccgcgggtggtctcctcggtgatgatggtgttgtaccggaaatcggggttgcccccgccgccgtactcctcgggcaccgccatgcccaggaagccctgcttgccggcctcgagccacaccccgcggtcgacgatcttcgccttctcccattcgtcgtgatacggcgcgacgtgacgatcgaggaaggcccggtaggactcgcggaacagttcgtgttctgactcgaaaagcgtgcgctggtatttgatggcgctgctcatggacgacctccgggcgactgggattgctgccgcccaacatataccaaccagacggttggtcggcagccgccggggtcagggggcggcgaactcgcgcagccgcccggccagggccagcggaacgcgcgccttgatccgggtgccctcggcgttgtgctcctcctgctgcacccgcccgtcggcgtgcagccgggccaccaggtcgccgcggtgatacgggatcaccacgtccacggcggcctcggccggaaccgccagctcggcgatccggcggcgcaggccgtcgatgccgtccccggtggccgcggacacgaacaccgcgccgggcagggcgtgccgcagcttggccagcgccacgtcgccggcggcgtcggtcttgttcaccgccagcagctcgggcggcggatcgccgtgatggtcggcgatgacctcggagatcacctggtgcacggcgtcgatctgggccagcgggttgacgtcggagccgtcgacgacgtgcaccagcaaatcggcgtcgacgacctcttccagggtggagcggaacgcctcgaccagctgggtgggcaggtgccggacgaagccgacggtgtcggtgagcacgaacgcccggccgtcgtcccattcggcgcgccgggtggtgggctccagggtggcgaacagggcgtcctgcaccagcacgcccgccccggtcagcgcgttgagcaggctggacttgccggcgttggtgtagccgacgatggcgatcgagggcacgtcgctgtgcagccggcggctgcgctgggtgtcgcggacctgcttcatgtccttgatctcgcggcgcagcttggccatccgctcgcggatgcggcgccgatcggtttcgatcttggtctcaccgggaccgcgcagccccacgcctcccccgctgccgccggcgcggccaccggcctgccgggacatcgactcgccccagccgcgcagccgcggcagcatgtactccatctgggccagcgacacctgcgccttgccctcccggctggtggcgtgctgggcgaagatgtcgaggatcagcgcggtgcggtcgatcaccttgaccttcaccgccttttccagcgcggtcagctgcgccggggacagttcgccgtcgcagatcacggtgtcggcgccggtggccagcaccacgtcgcgcagctcggccgccttgcccgagccgatgtaggtcgacgggtcgggcttgtcgcggcgctggatcagcccctcgagcacctgggagccggccgtctcggccagggcagccagctcggccatgctggcccggctgtcggcggcggtgccgtcggtccacacaccgaccagcaccacccgttccagccgcagctggcggtattcgacctcggagatgtcggtgagctcggtggacagcccggcgacgcggcgcagcgccgaccggtcttccagggcgagttcgccggtgctcggctccgtgatggccggagcgtcgtcgcggaattcgggatgtgtcataggcaataaaagatgatgcacgcaacctcggtggcgtgcacctgaattaacgctgcgcttgctgccaccattcctcgctgatttcgccgtgggccaccagcaccgacggcccgcgcaggtaactggtggcgtcggtgacggtgaccacgacgtcgccgcccggtacccgcacggtcagggtgccggtgtcggcgccggcggcggccagcgcggcgacgacggccgcgacggttccggtgccgcaggagcgcgtctcgcccacgccgcgctcgtgcacccgcatgtgcaccaccccggccgccggtgcggtgaggacctcgatgttgaccccgtccgggaactgggcggcatcgaagctcaccggcgcggcgacgtccagcgcggccagctcgtcgacgctcagctcggggtccaggcaggccaggtgggggttgcccacgtcgaccgccaggccggcgaaccgccggccccccactgtcgcctcgaaggcctcgcccccgccgcccagcgtgttggccttgcccatgtcgacgctgacgtcggcgccggtcgcgtcggcggcgtgcacggtgaccggccgggggccggccagcgacccgaccacgaattcgtcgcgggtctccagcccgctggcgcgcagatagtgcgcgaagacccgcacgccgttgccgcacatctgggccaccgagccgtccgcgttgcggtagtccatgtaccagtcgtcgccggccacgccgtcgggcagccggtccagcacgccggccgcggcggcggcggcggcggcggtgacccgcagcaccccgtcggcgcccagcccgcgccgccggtcgcacagcgcggccacgcccgccccggtcaggcgcagctcggccggggggtcgcacagcagcacgaagtcgttctcggtgccgtggcccttcgcgaatttcacctgctcaggatacgtggcgccaggcctccagggcggcgtcggcgaggcggggcgggctgcaggcgccggcgtcgagccagcgcacccggtggtcgcgccgaaaccaggaccgctgccggcgcacgtagcggcgggtgcccgcgtaggtctgctcgcgggcctgccgcagctgctcgtcgccgccgccggcgtcgagcgcggcgatcacctgcgcgtagcccagggcgcgcgcggcggtgaccccgtcgcgcagcccccgcccgagcagcccggtcacctccgccaccaggccctgctcgaacatcgcgtcggtgcgcctagccagccgctcgtcgagaagcgttgtgtcgcaatccaatccgatgatgacggtgtcccaccgcggcgcgccgatccgcggcgcggacgcggcgaacggccggccggtcagctcgatgacctccagcgcccgcaccgtgcgccgggcgtcggtgggcaggatcgccgcggcggccgcgggatcgcggcgggccagctcggcgtgcagctcgcccaccccgacctcgcccagccgccgctcccagcgcgcccgcacccgcggatcggtggccgggaacgaccagtcgtcgagcagcgactggatgtagagcatggagccgcccacgatgatcggcaccgcgccggcggccaggatggcctcgatgtcggccgcggcggcgcgctgatagcgggcgacggtcgcggtctgggtgacgtcgaggacgtcgagctggtggtgcgggatgccgcggcgggcgtcgacgggcagcttggcggtgccgatgtccatcccgcggtagagctgcatcgcgtcggcgttgacgatctcggcgccgagtggcccgagccgttcggcgacgtccagcgccagctgggacttgccggtgccggtggggccgatgatcggcagtggccgcacggccgccgtcacagctgccaggcgccggcgaagtagcccaccccgtagggcgccccccggtagagctccttggccgagcgcggccccggctcggccagcccggccagcaccccgaaggcgacccggcccaggatctggcccggcaggcggcgcagcgcggcgatgtcaccgccggccagcgcgtcgtccagggcctgctgcgcggcggcgtcgccggggtggtgaccgccgggggcggccggggtcagggtgttcgcgccgtcggccaccaccagcaccccgaccggttcgggcagtgcgtccagctcggcgcgcaactgccggccgcggcgcacggcggtgtcggcgtcgtggtcggcgcgatagatgcgggcccgcgcggcggcctgcggctggacctggccgcgcagccagccgcccagcagcgcgcacagcggggagtgcgggccggggccgtctcggcccggccgtcggccggcggggacagccggaccggcacgtccatccccgaatccggcgaaggtgcccaccgcgtcgtcacccagctcctggtcggcgggcgccggtcccgatgatcagccagcgatcgggcagcaacgcggccgccgcgagcgtcgcggcgctcagctcggccagctcgtcggcggcggttccggcgagctcggggacgagcaccggcgccgacgggacgatggcgatgacgctcagcacgccaccaaactaacgtggcccggcgcgcccgggctcaccaccgggagctgtcggccaccagcagtcggccgctgaacggaccggtgtcgtcgtcgtcagcggcgacgtcggcggtggcgtcacgggcttttcgcggggcgctgcccgggccgggctcgggccggttgatgctggcggcctcgccgcgggccagcgcgatggtcgcgacgatcaccaccgcgacggcgccgaccagcacgaacgccttgggaccgtgtgcgttgagcgtctcgtcgagcaccagtacgccgagcagcccggccaccaccggcttggccaccgtcatcgtcggcagcgaggcggtcagcgcgccggcgcgaaacgccgattgctggaagatcatcccggtcagcgccaccagcagccagggcacgaactccggcgaggtcagcacaccgaccaggctgtgctcggacatctcgaccacacccttggtcagcaccgcgaacagcgccagcgacgaacccgcgaccaccgccagcagcaccggcgcgaacgggctgccggcccacctgcgcgccgccaccacgcaggccaccagcaccggcaccatgaccagggccacgatcacccaaatgtgcagcggggcgcgctgcttgccggacgccgggtcgccgacgatgatcaccacggccagggcggcggccagaatcagcgcccacgcccactcccgcggtttgatccgctggtgggccagccgcgcgtagaggggcagggcgaacagcagcgccgtcacctgcagggcggtcaccagcaccaccgacccccaggccagcgcggcggcctgcaggctgtagttggtgatcgcggccagcccgcccagccaccagcgcgtgtcgcgcagcgacatgcggaacagttcgaggtggcccactggtttgtcggtgatctcgtgcgcggagcgctggcggatcacgtcgccgaccgcggaggccaacgccgcgcacagggcgatcaacgcagcgacatcaaccttcgacatgttccgacccctccgcctcgacccgtccggactagctttccccgaggcgcaagcaaatgcacgcacaattcgcgttcagttcaactacaaattcatgacgttccacacgttggcggaccgcgtcccaaggtgatcactcgattattacttcagcaatctatgtagccgcttggataactctaagagaacgtcacagggagccggcgggcgttcttcggtggaatgccaaggtggcggcgagcggcggggcaagctgcttgaatactgttaagcagctgctgggaaaacctggatcggtcatccgcggctgcaggagacggtgccgccacgcgcggcaggcgcgcgggacactgacccgcgcggacggtgcgaaaggtgtagtgacgagcgcatgacgggtgaccagcctcgcgacgattcggctcggcctgcgccgcgcccgggtccgcgacccggtccccggcccgtgagcgcggggcgcccggccgcccacccggtggtggtgccgccgccacccagcgacccgcaccggttcgggcgggtggacgacgacggcacggtgtggctgatcagcgcggccggcgagcgcgtcgtcggctcctggcaggccggcgaccgggaggccgcgttcgcccacttcggccggcggttcgacgacctggccaccgaggtcaccctgatggaggagcggctggcgtccgggaccggtgatgcgcgcaagatcaaggcgcacgcctccgagctggccgaggcgctgccgacggcgacggtgctgggcgacatcgatgcgctcgcggcccggctggccagcatcgccgaacaggccgaggcggccgtcgccgccgagcgctcgcggcgcgaggagcatcgggccgcccagaccgcccgtaaggaggcgctggccgccgaggccgaggagctggccgccaactcgacgcagtggaaggccgccggcgaccggctgcgcgcgatcctcgacgagtggaagaccatcaccggcctggaccgccgggtggacgacgcgctgtggaagcgctacagcgcggcccgggaggccttcaaccggcggcggggcgcccatttcgccgagttggaccgggaacgctcgagcatccgccaggccaaggagcggctctgcgagcgggccgaggagctgtccggatcgacggactggacggccaccagcgcggaattccgcaagctgctggccgaatggaaggcggccggccgcgcggcccgggaggtcgacgacgcgctgtggcggcggttcaagcaggcccaggacgtgttcttcaccgcgcgcaacgccgcgacggcggagaaggacgcggagttgcgcgccaacgccgccgccaaggaggcgctgctggccgaggcggagaaactggacaccggcaaccacgacgccgcccgggcggcgctgcgcgcgatcgccgagaagtgggatgcgatcggcaaggtgccgcgggagcgctccgccgagctggagcgccggctgcgcgcggtggagaagaaggtgcgcgaggccggcgacgcgggctggtccgacccgcaggcgcaggcccgggccgagcagttccaggcccgcgccgagcagtacgaacagcaggcccgcaaggccgccgcggcgggccgcaccaaggaggccgaggaggcgcgggccaacgccgagcagtggcggcagtgggcgcaggcggcggtcgaggcgctgtcccgtaagccctgaccgccggcgtcaagtcccggcggcgggatcctcgggcttgggcagatcgtcgagcagggtggtcgactgctgttgcgcggcgacccggcggcgctgctcctccgcggcgagctgcacgatggtgcgcgaccacaccacccgggcccactggtagatgagcaccagcacggtgatccaggcgacgatcaggccccaccccggcccgggatgcccggcgggcacggtctgccgcgaccagatcgccagcatccccgcggcgccggcaatcgcggtgcccgccaacgcaatccaggccagcgcccagcgccgggccaccagcgccagcgtcgagaagcccacgccgaacaccagcgccagccagccgaacacccgcgacggcagggccaccgcggccgcgcccgcgtcgtgggtgccgaacaacacgtcccagccgcgcacgccgccggtgtgcggcaggatgaacgagcccagcagcacgaacaccaggatcgacaccacgaagccgcgggcgccggggtcgatgccgccggccacccgccgttcggcggcctcgatctcggtgcgcagcgcgcccagctgggagtcgtcgtggttgcggtcgtcgttcatgaggcacatccaacgggttgggccgggccggccggcggcccgacggcgggcatgccgagaccgacgccgcgcgggcgccggccggccgcgtgcgcgtcaccggcccgggtgcggcgatggctgaggacgccggcgtcggcgatcaggtggtgcggtgcggccccggtgatgaccgtggtgaccaggtcgccggggcgcacccggtcgtcggcggcgaagtgcaccagccggccgtcgcgggcgcgtccgctcatccgggcggtggcgctgtccttgcgcccctcccccgtggcgaccagcagctcgacggtctggccgaccagggcctggttgccctgcaacgagatcgactcctgcagctcgacgaggcgctcatagcgttcctgcacaacggctttcgggatctgcccgtcgagctcggcggccggggtgccgggccgcttggagtactggaaggtgaaggcggccgcgaaccgggcccggcgcaccacgtccagggtggccgcgaagtcctcttcggtctcgccggggaacccgacgatcaggtcggtggtgatggcggcgtgcggcatggcggcccggacccggtcgatgatgccgaggaaacgctcggcgcggtacgagcgccgcatcgcgcgcagcacccggtcggagccggactgcagcggcatgtgcagggcggggcacacgttcggggtctgcgccatggcctcgatgacgtcgtcggtgaactcggccggatgcggcgaggtgaaccgcacccgttccagcccgtcgatctcgccgcaggcccgcaacagtcgggcgaacgcgccgcggtcgcggggcagcgccgggtcggcgaaggacaccccgtaggcgttgacgttctgacccagcagcgtgacctcgaggacgccgtcggccaccagggacctgacctcggccaggatgtcgtcgggactgcggtcgacctccttgccgcgcagcgacgggacgatgcagaacgtgcagctgttgttgcagccgaccgagatggaaacccaagcggcataagcggattcgcgcgcactgggcagcgacgaggggaactgctgcagcgcctcggcgatctccacctgggcggccttgttgtgccgggcccgctccagcagggtgggcagcgacccgatgttgtgggtgccgaacacgacgtcgacccagggcgcccggcgcagcacggcctcgcggtccttctgggccaggcagccaccgaccgcgatctgcatctccgggttgccccgcttgcgcggcgccaggtggctgaggttgccgtacagcttgttgtcggcgttctcccggaccgcgcaggtgttgaacaccaccacgtcggcgacctcagccccctcggcggcccgccggtagccggccgcctccagcagacccgccagccgctcggagtcgtgcacgttcatctggcagccgtaggtgcgcacctgataggtgcgcacccccgaaacatcccgggccaccgtcgaagtcacggggccatggtacggcgagcggtccgcacgggagaaaccgcacgtcatcggctagacgcggcggcgctcccgttcggcggccagctcggccagcaccacctcgcacgccaggttctggctgtagccgcgccgggccagcatccccaccagccggcgggtcacccgcgcgtcgtcctccgccagcgtctcgcggcgcagcttggaccggaccagttgctcggcccggtcccgctcggcgccggcgtcgatcccggccagcacgctggtgatcacgtcgttgtccacccccttggtatgcaactcggcggccagggcgcgcttgctcttgccggcatgcgcccgccgggactgcacccactgctgggcgaagtcggcgtcgtcgatcaggccgacggcggccagccggtcgagcaccgcggtgctgacgtcgtcgggatagccccgtttggccagccggccgtgtagctcggcgcgggtgcgcgctcgcgcggtgagcaggcgcaggcacagggcccgcgcctgctcctcgcgggagggctcagaagtcgacgggggcgggcaggacgccgtcatcggacaagtcatcggtcacgaccgcgccaatgccgagcttttccttgatcttcttctcgatctcgttggcgacctcgtcgttctccatcaagaaggtgcgggcgttctccttgccctggccgagctgctcgccctcataggtgaaccaggaaccggacttgcggatgaagccctgatccacacccatgtcgatcagcgagccctcccggctgatcccgcggccgtagaggatgtcgaactcggcctgcttgaacggcggcgacaccttgttcttgacgatcttgacccgggtgcggttgccgaccgcgttggtgccgtccttgagcgtctcgatccggcgcacgtccatgcgcaccgaggcgtagaacttcaacgccttgccacccgtcgtggtctccgggctgccgaacatcaccccgatcttctcccgcagctggttgatgaagatcgcggtggtgcccgaattgttcagcgcgccagtcattttccgcagcgcctggctcatcagccgggcctgcagcccgacgtggctgtcccccatctcgccctccagctcggcgcgcggcaccagcgcggccaccgagtcgatgaccaggatgtccagcgcgccggagcggatcagcatgtcggcgatctcgagcgcctgctcccccgtgtccggctggctgaccagcagcgaatcggtgtccacgccgagcttcttggcgtactcggggtccagcgcgtgctcggcgtcgatgaacgccgcgacaccgccggcggcctgggcgttggccaccgcgtgcagggcgacggtggtcttacccgaggattccgggccgtagatctccacgacccggccgcggggcaggccgccgatgcccagggcgacgtccagggcgatggatccggtcgggatgaccgagatcggttgacgcatctcgtcgccgagacgcatcaccgagcctttcccgtagctcttttcgatctgggccatcgccagttcgagagccttctcgcggtcgggggcttgcgtcatggtgcctctcctatagtcggtgtgtcttctgaccggtatcggtcggttggcggtgacactagagaaggccaccgacaagttgacgctgcgaacgtcccccacagtagccgaacaggtgttcgattcaagttcgacacgccgcgggcgtcgcagcagccgcgaaaggccggccgacatcctggatatctccccgcaactgtcggaagtgtcgtcctacggcggcttcttcgcgttgaccgtgggcggcgacccggccggctggcgcccggtcaccgagtgctacgccgacggcagcgccgacctgatcgcggccaccgcccgccgctaccgcacccgtgacctgcggatcggcgcctcgctggtgcacctggcccacgccagccggctgtggtcgccggtgctgggctgcgcgatcggccacggcgtcgtccccgacctcggcgacctgcaccgcgccgcgaccggcgcgcagctgcggctgcccgagcccgtcgggcggcgcgtcaccgcgccgcaccccgagctgctgtatcgcctcgtggtggacgagcacctgggtccgctggccgcgggcctgcgcgtcgggctggcgcccgccctgctcgccggcaacgtggcctcggcgctggtcggggcggcgcgggcgctgttgtcggcgcggccggacctgcgctccgcgatcgtcgagaccaccctggcgctgctggacaccggcatcatgtccggcgccggcaccgtcaccggcccgccgctggacttccggcgggccagctgctgcctgttctaccggctgcccgggggctcggtgtgcggcgactgcgtgctggatcgatagcacccgcttgcggactcaccattgctcccgcggcacgtcgaagtcgacgcacaacgcccgccagacgtcgcgcgggtccacaccgtcctcgatcgcctgcgccgccgtccgcccgcccaaaccggtcagtacgtgatccaccaacaccgatgagccgtaggtggtgccgaagcgcaacaccacccgctcgtggaactccgtgagccgcatcccagccaacatacccagacgcgtcctcagcgccagctggccggcaggtcgatcaggtggttggggcaatacgtctgcaccgccagggacatggtgtcgcgagcgcgttgcgcggacatggtggcgcgcaattgcatgaaggcgtactcggccggcgccagtccctgctcggcggcggccgggtcgtccatcaactggcaggcctgctgctgatcggcgctgtcggcgtgagccgggccggcccacaacggcgagccgaacagcgccccggccagcacggcgcccgcggcgaacgtggtgatgatcctcatgggtgcctcccgccgagatgggtgcctcccgccgaagcataaggtcatccggccagcgcctcgcggcacacccggaccggatcggcgacgtcggcgatgccggcggcggcgcgctgcgcggccgcccggtagcccggtgacgacagcacctcgttcaccgcgaccaccagcgcgtcggcgctcagcggccggatcagccgggcgctgccctggcggaccacccggttggcgatctcccactggtcgccgccgccgggcaccgccaccagcggcactcctgccagcagcgtcttggccaccatcccgtgcccgccgccgcagaccaccacgtcggcgtgccgcagcaactcggcctgactgcccagcccgaccaccgcccacggcggcgccgccagcgccggcccggccagccgggacaccgccaaccgcgccccggccggcagcgtctcccccggcgtcaggcaggacagcgccacctcggccagaccccgggcgccggtcagcgcggtcgacggcgcgaccaccaccaccggcccggaaccggccgggatgtccagcacccggtcggtcggctcgaagtgcagcggccccaccagcacggcctcgtccggccagtcgggccggggcacctcgagggcgggcagggtggcgatcagccggcgcagcggccccgggtcgcgggccggcaagccgatctcggcccgcgccgcggcgcgctgccgcagcccggcccgccaggagcgcgcggtcagcgcgcgcatggtggcgtcgcgcagccggccccgcaggccggtacccggggccagcccgctgccgatcggcggcaaccccttggacggcaggtagagcggatgcgggctgagctcgatccacgggatgccgagcagctcggcggccatcccgccgccggcggtgatgacgtcggacaccaccaggtcgggcgccatgtcgcgcagggcgggcacgttgagcaccgccatccgggcggcgcggcggtggatgcgggccccggcgtcgacgtcctcgtcggtggccgccagtccgtccagttcgacggcgtcgacgccggcgccgcgggcggtgtccagccactcggcgccggtgaacagcgtgggggtatcgccggcgtcggcgaagcggcggcacagcgcgatcgccgggaacgaatgcccgggatccggcccggcgaccacggcgacgcgcatcggattcaccctgccacagcgttcggccgccacgctcgcctacgctggcgatatgaccgagctgactgggaccaccgttgcgaacacccgtacggtcgaaggattcctcaacgcgctgcaggacgcggattacgacgccgccgaggccgcactggccgacgacctcgtctacgagaacgtcgggctgcccaccatccacggccgggcccgggccatgaagctgtttcgccggatggaggaccgcgccgccttcgaggtgaagatccaccgcatcgcggccgacggcggcgcggtgctcaccgaacgcaccgatgcgctgatcttcggcccgctgcggctgcagttctgggtgtgcggcgtgttcgaggtgcagaacgggcgaatcacgttgtggcgggactacttcgacttcttcgacatgctcaaggccacggcgcgcggggtggccgcgctgctgctgccgtcgctgaaagccacgttctgagcgcgccatgagccaggacaggggccgcacccggcccaatttcgttcagttcgtccgctattgctgcggcgggcggctgccggactcgatgcgcgactgggtgcgcaacgacctggccggcaagggcgcgacggcccggatgatgcggcgggtggcggtgccggcggtgctggtgctggccccgttctggttgatcccgacgacgctcgacgttcacctgagcatgacgctgccgattctcattccgttcgtgtacttttcgcacgcgctcaacaaggtgtggcgccggcacatgctggccgtgcacgatctggaccccgagctggtcgacgaggtctcccggcagcgcgacgcccacatccaccgctcctacatcgatcgctacggcccgcgcccggaagactaaccggcgccgcgtaacccgccgagttcgtcgaaggcctgcgcccacccgttcagccggtcggtggccccgaccagctcggcccggtagtgctgcgacgcggttgacccgtcaccgttggccgcggacaccaatctcgctgcggcggtgaccatttcgttgtactggcgcaccccggcgctcagctgcgcggtgaacgcgttgatggtgggcgcgagatacgaccgggattcttcgccggcctgcgccgcccgttccatcgacaccacctgcgcggcggtggacgccatggccgcggaggtgcggccggcggccgcggtcaggtcgcagatttcggcggccggcaacatcgcgccccgctccagcacggccagcaacgaggcgaagccgcgttcggaggcgcccagcgcgtacatcgccgggcgggccgccgaacccggcggcggcagccggcgcacgttcgtcgtccggggcgccggcagtggttcggcgcgcagccagcggtagcgcagcagcagcaacgtcgccggaatggccatcacgaccgcgacggcgccggtgatctccagcagcagggcgaaccatccccaggcggccagcacgatcgtcagcaccgcccagaacgcgcacccggcggtgaagatcaggccccagcgcagcgcgcggcggcggcggcgcagcaggcgcgcccgcgggtccgtggccgcgctgatcttgcgggccaccaggtcggaaaggtcggcggcggcggccactccgcgctgcagcaacgcccgccacggcccgggctgcgttgcgttcacggccatgagctactgaccaagtggtttctcgctgaccgcgtcgccggcgccctggccgggcgcgggggcggcctgggtgccgccggcggccggtgtgcctccggtcggcaacgcctcgtcccgcatcgaggcgcggatctgctcgagccgggaatgcccggccatctgcacgccggcctgctcgacctcgagcatcctgccctgcacggagccctgtgccagttcggcggccccgatcgcgttggcgtagcgccgctcgatcttgtcgcgcacctcgtccaggctgggcacgttgccgggggcggccagctcgctcatcgactgcagtgaggcgctgacctgttcctgcatcttggcctgttcgagctggctgagcagcttggtgcgctcggcgatcttctgctgcagcaccatcgcgttctgctcgaccgccttcttggcctgcgcggcggcgttgagcgcctggtcgtgcagcgtcttgaggtcttcgacgctttgctcggcggtgaccagctgggcggcgaacgcctcggcggcgttgttgtactcggtggccttggcggtgtcgccggcggcggtggcctggtcggccagcgtcagcgcctgacgcacgttgacctgcagcttctccacgtcggcgagctggcggttgagccgcatctcgagttggcgctggttgccgatgacctgagcggcctgctgggtcagcgcctggtgggtgcgctgggcttcctcgatggcctgttggatctgcaccttggggtcggcgcgctcgtcgatcgtggcgttgaacttcgccatcaggtacttccacgccttgacgaacggattggccatcagtcagctccaccttcgcttctcgaggggccgcggcggccctgaaaaggctccacgcctgtcgctcaatttagtgggtcggcgccgatcgccgtaccccttgcggggatcccgccgctcaggccagcgccaggctggccaccggcgggatgacgaccttggtgctggcgtcgatgctggggccggccggtgcggcgacggccgcgcgttcctcgctggccatccgctcgccggcgtcggtgagcaccgacgacaacgggacgtccagcgcgtcgcagatcgcgttgagcagctcgctggacggctccttgcggccgcgttccacctcggacaggtagccgaggctcacccgcgccgtatcggacacctcgcgcagtgtccggccttgcgtcgtgcgggcctcgcgcagtacgtcgccgatgacctcgcgcaccaatggcggcatcccgccctccttcgtccagtcggccctgcgcggcacgcctcttcactcgcctccggcaggtgctcaattaggtgaacgccggcggggccgcggtggttcccgttcggggatgccgaatcaccccgaatcaggcagcggtccggcgcacttcgcgcaccgtcgagaccacgtagtcgatcccggtgatcaccgtgagcacgatggccgcgcccatcaccacggccgcgcccacccggaacggcccgggcgtgcccgcccacggcagcacgaacaaaccgatggcgaacacctgcaccaccgtcttgagcttgccgccccagctggccgggatcacgccccggcggatgaccgccaaccgcagcacggtgaccccgaattcgcgggccaggatcagcacggtgatccaccacggcagctcgccgagcatggacagcccgatcagcgccgacccgaccagcgtcttgtccgcgatcgggtcgacgaacgcgccgaattcggtggccatcccgtagttgcgggccagcagcccgtccaaccgatcggtgatgcaggcgaacgcgaagatcaggaaagccaggatgcggaagccggtctcgtggccgtcaccggcgaacagggcgagcagaaagaccggcaccaacaccagccgcagcagggtcaacgtgttggccaggttggcgatgtttgcccgccctaccatcggacccgtctgcggctgccccggcaccgcaacagaataacggttgaccagcgcagccgtccgtgatgccgatactgttagccgtgaccgaaagtccgcagcgctaccggccgctggttcgacgcgcgcgaacgtccgatgttcccgccatcaaagaactcgtcgacacctacgcgggaaagatcctgctggaaaagaacctggtgacgctgtatgaggcggtccaggaattctgggtggccgagctccccgattcgccgggccgggtggtcgggtgcggggcgctgcacgtgctgtggtcggacctcggcgaaatccgcaccgtcgcggtcaacccggcgatgaccggccacggcatcggccacgcaatcgtggaccggctgctgcaggtcgcccgcgagctcgagctcaagcggctgttcgtgttgacgttcgagaccgagttcttcggcaagcacggcttcaccgagatcgagggcacgccggtgaccgccgaggtgttcgaggagatgtgccgctcctacgacatcggggtggccgagtttttggacctgagctacgtcaagccgaacatcctcggcaactcgcggatgctgctggtgctgtaacgctcgcgctcgcgccgcgcgacagtcacgctggcgtgacgctggcgccggaacgtcacgctggcgtgacgttcggcgctaaaccgcgctagtcgggatcgccgccgtcggcgtcggccgatccggccccggagccgcggatcagcgccagcgtgccggccagctcatcgggcttgaccagcacctcgcgcgccttggatccctcggagggcccgacgatgccgcgggtctccatcaggtccatcagccggccggccttggcgaacccgacccgcagcttgcgctgcagcatcgaggtggagccgaactggctggacaccaccagctcgacggcctgcaggaacacgtccatgtcgtcgccgatgtcggggtcgacgtcggcgcgttcgctgctggttttgacggcggtgacgccctcggtgtactcgggttcggcctggtccttgcaggcggcgacgacggcctggatctcctcgtcggtgatgaaggcgccctgcaaccggatcggcttggacgcgcccatcggcaggaacaggccgtcgcccatgccgatcagcttctccgcgccggcctggtccaggatcacccgggagtcggtgagcgacgacgtcgcgaacgccagccgggacggcacgttggtcttgatcaggccggtgacgacgtcgacggacgggcgctgggtggccagcaccaggtgaatgcccgcggcgcgggccttctgggtgatccgcacgatggcgtcctcgacgtcgcgcggcgcggtcatcatcaggtcggccagctcgtcgacgatcgcgacgacgtacgggtagggccggtattcgcgctggctgcccagcggcgcggtgatctcaccggagcgcaccttggcgttgaagtcgtcgatgtggcgcacccgggaggcctgcatgtcctggtagcgctgctccatctcctcgaccagccaggccagcgcagcggcggccttcttgggctgggtgatgatcggggtgatcagatgcggaatgccttcgtagggcgtcagttccaccatcttcgggtcgatcaggatcatcctgacctcttccggggtggcccgggccagcagcgagatcagcatcgagttgacgaagctggacttgccggagccggtggagccggccaccagcaggtgcggcatcttggccaggttcgccgaaatgaagtcgccctcgatgtccttgcccaggccgatcaccagcgggtggtggtcgcgacgggtggacggggcggtcagcacgtcggccagccgcaccatctcgcggtcggtgttgggcacctcgatgccgacggccgacttgccggggatgggcgccagcatccgcacgctctcggtggccaccgcgtacgcgatgttcttctgcagggcggtgatcttctccaccttcaccccgggccccagctccacctcgtagcgggtcacggtcggcccgcgggtgcagccggtgacggcggcgtccaccttgaactggttgagcacctcggtgatggcgtcggccatgacgttgttcgcggcgctgcgcttcttcggcgggtccccggccaccagcaggctcagcgacggcagcacgtagggtccctcgaccacccggtccagctcgatggtgtcggagttgtcggccgcgcgtccccgcttgcggccgcgcccggttttgacggcgggctcgggcacggtggggatgtcgtcctgcagcgcggcctgggcgtcgtcgtcgggcgcccacgccgccggttccggctccggttgcgcggccgcgtcgtcgaattcgccggcgtagtcgtagggctcgtcgccgtagtccccgtcggtgtagtcctcgtcggtgtagtcctcgtcggtgtagtcctcgacgaaccgggtgtggaacaggttgcgcatcaccacgggcagctcgcggatggtggtgccggtcaacagcagcagcccgaacatgaagccgatgaacagcagcggcgccgcgatccagggcgtcagcccgtcggagagcgggccgccgatggcgaagccgatgaatccggccgcgcggcggcgcgcgtcggggtcgcccggcgatcccgaccacaggtggcgcaggcccagcaccgacagggcgatcagcccggcgcccaggatcagcctgggccgcacgtcgggatcgggctcggtgcgcatcagcgtcaccgccaccgcggccgtgacgaccggcagcgccagcacgcccgcgccgatgaacgtccgcagcgcggtgtccacccaggccccgaccggcccggcggcgtggaaccacgagctggcggcgaccaccaccgagaagcccagcagcagcagcgcgatgccgtcgcggcggtgcccggggtcgatgtcgcgggcccgcccgatcgaccgggccgcgccgccggtgccccgggcggccagcatccagccggcgcgcagggcgcggccgcaggtcaggcccgcggcgactagcggcgggtgctgccgccgccgggtgggcctgccgggcttgcggcggggcgccgccggtcgcgcgccgcgcgacccgttggaccgcgaagtggcctttgacctgctcgttcggtttccggagcgggcggcggtcttactgggcatgacggcaagggtagtcgcaacggcatcatctacaccacccgccacactggtaacgaccaggctttgcggcagctgcgggatgggccccgaattcgcgtgagtagggtgacatccggtgcgagaagtcgtgctcgtcaccccacccccggagcgcccaggaggccacaagcatgcccgtcgtcgtcgtcgccaccatgaccgtcaaaccggaatcggtcgacaccgtccgcgacatcctgactcgtgcggtcgaagaggtgcacgacgaacccggttgtcagctgtattcgctgcaccagtcgggcgagacattcgtgttcgtcgagcagtgggccgacgaggaggcgctcaaggcgcacagcaccgcgcccgcgatcggcaagatgttcagcgcggccggcgagcacctcgacggcgccccggacatcaagatgttgcagccggttccggccggcgacccgggcaagggacagttgcgtccctgatgccccgctcgtcggaagggcccctgacgggaaaggtcgccttcatcaccggcgcggcgcgcggtcaggggcgcgcgcacgcggtgcggctggccgccgacggcgccgacatcatcgccgtcgacctgtgtgaccagatcgccagcgtgccctacccgctggccacccccgaggagctggcggccacggtgaagctggtggaggacatcggctcgcgcatcgtggccaggcaggccgacgtgcgtgaccgggaatccctgtcggcggcgctgcaggcgggtctcgacgagttgggccgcctggacatcgtggtggccaacgccggcatcgcgcccatgtccgccggtgacgacggctggcacgacgtgatcgacgtcaacctcaccggcgtctaccacaccatcaaggtcgcgatcccgaccctggtcaaacagggcaccggcgggtcgatcgtgctgatcagttcgagcgccggactggccggcgtcggcagcgcggacccgggttcggtcggctacgtcgccgccaagcacggggtggtggggttgatgcgggtatacgcgaatctgcttgccgggcagatgatccgggtgaactcgattcatccctccggggtggagacgccgatgatcaacaacgagttcacccgggagtggctggccaagatggccgccgcgaccgacacgccgggggcgatgggcaatgccatgccggtggaggtgctcgcccccgaagacgtcgccaacgcggtggcgtggttggtgtccgaccaggcccgctacatcaccggcgtcaccctgccggtggacgcgggctttttgaacaagtagcggccatggcacgaaatccggtagcgcagacggcatttgggccgatggtgttggcggcggtcgagcagaatgagccgcccggccgccgtttggtggacgacgacttcgccgagctgttcctgcccgccccgctgcgctggctggtcggcgccacccggttcgccccggttcgtcacctgatgatccgcggctcggagttcaccggtcccgggctgtgggcgaatctggcctgccgcaagcgtttcatcgccgacaagctcaaggagtcgctcgacgacatcaacgccgtcgtcatcctgggtgcggggctcgacacccgggcctacctgctgacccggcgggtgcgcatcccggtgttcgaggtcgacctgccggtcaacgtcgcccgcaaattcaagacggtccgccgggtgctcggcgagctgccgctgtcggttcggttggtcgcgttggacctcgagcacgacgacctgctcaccgcgctcgccgagcacggctaccgcaccgactaccgggtgttcttcatctgcgaaggcgtcacccagtacctcagcgaggccaccgtgcgccggacgctggacgggctgcgcgcggccgccccgggcagccggctggtgttcacttatgtgcgaagcgatttcatcgacggcaccaaccggtacggcacccgcacgctgtaccgcaacgtgcgccagcggcgccagctgtggcatttcggtttgcagcccggcgaggtcgccgacttcctcgccgagtacggctggcggctggtggagcatgccggacccgacgaactcatgcagcggtatgtcgtgcccaccggccgcaaactcaaagcctcccagctggaatggtccgcctacgcggagaagacctagccaccgcgggcgttcgcgacacttaaaccttggcgacgacacgccgaaaaacgcgtgcctgctttaagtttcgcggagcaagggaaccgggggcggagcgagtcggggctagacctcgatgacggtggggacgatcatcggctgtcggcggtaggtttcgcccacccatttgccgacggtgcgccgcaccccctgggcgatgcggctggggtcggtgatgttctcggccaccagcgcctcgagctcctcctcgacccggcgcaccgcgggctcgagcgccttggggtcctcggagaagccgcgcgaatgcagatgcggtggcgccaccggacgcccggtgccgcgctgcaccaccaccgtcaccgccacgaaacccgacgacagaatcagccgctcccccaacgtgatgtcgccgacgtcgccgtcgaccaggccgtcgacgaacatcttgccgaccggcaccgccccggagatcgaggccctgcccgcgaccaggtcgacgctcaccccgttctcggccagcaggatcgactcctccggcacgccggtgcgggctgccagcttggagttggcccgcagcatccgccacgtcccgtgcaccggcatcacgtggcgcggccggacgccgttgtacaggaacaacagctcaccggcgtaggcgtggcccgaaacatgaacgcgcgcttgggcgttggtgaccacccgggcgccgatcttggcgagctcgtcgatcacgccgtagaccgcctcctcgttgcccgggatcagcgacgaggccagcaccacaaggtcgcccgcggtcaacgtgatgctgcggtgctcgccgcgcgacatccgcgacagcgccgacatcggctcgccctgggtgccggtggtgatcagcaccacccgctccggcggcatcagctcggcggcgcctatgtcgatcacgtcggcgtcggccacccgcaaaaatccgagttcgcgggcgatgcccatgttgcgcaccatcgaccggccgacgaacgacacccgccggcccaatgccactgcggcatcgatgatctgttgaacccggtccacgttggaggcgaagcaggccacgatgacgcggccctcggcgccgcggatcagccggtgcagggtcgggccgacttcactttccgaggggccgacgccgggcagctcggcgttggtcgaatcgcacaggaacaggtcgaccccggcgtcaccgagccgcgacatgccgggcagatcggtgggccggccgtccagcggaagctggtcgagcttgatgtcgccggtgtgcaaaaccgttccggcgccggtgtgtacggcgatcgccagcgcgtcggggatggagtggttgacggcgaagtattcgcattcgaacacgccgtgggtgctcttgtgtccctcggacacctcgacgaacaccggcttgagccggtgttcgcggcacttggcggcgaccagggccagggtgaatttcgaaccgacgaccgggatgtcgggccgcagcttgagcaggtagggaatgccgccgatgtggtcctcgtgcgcgtgagtgagcaccagcgcctcgatgtcgtcgagccggtcttcgatgtgccgcaggtccggcaggatcagatcgacgccgggctcgtcgtgggtgggaaacatcaccccgcagtcgatgatcaacagccggcccaggtgctcgaaaaccgtcatgttgcggccgatttcgctgatgccgcccagcgcggtgacccgcaaccccccggcggccagcgggccaggcggggcgaggtctacatccactgctcggacgctccccgggtcacctgagcaccgaggccgcacgcatgtcggcggtcaacgcctcgatctgctcgggcgtcgccggcacctgcggcagtcgcgggtcgccgacgtcgatgccctgcagccgcagccccgccttcgacatcgtcaccccgcccaggcgggccatcgcgtcgcacagcggcgtgacggtcgcgttgatcttgcgggcggtggcgatgtccccggaagtgaaggcggacaacaactcccgtagctgattggcggcgacgtgcgagatcacgctgatgaaaccggtggcccccatggccagccacggcaggttcagcgcgtcgtctccggagtagtaggccagtccggtctcggcgatgatctggccgccggcgtgcaggtcggccttggcgtccttgacgccgacgatgttggggtgcgacgccagcgcgcggatggtgctcgactcgatgggcaccaccgagcgtccgggaatgtcgtagagcagcaccggcagttcggtcgcgtcggcgacggcggtgaaatgcgcgatcagcccgcgctgcgggggcttcgagtagtagggcgtgaccaccagcagaccgtgcgcgccctcagccgcgcaggccttggccagccggacgctgtgcgcggtgtcgtaggtgccggcgccggcgatgacgcgggcccggtcgccgaccgcttccagcaccacccgcagcagctcgcgcttctcgtcgtcggtggtggtcggcgattcgccggtggttccggacaccaccagcccgtcacagccggagtcgacgagatgattggccagccgcgcggcggcggcggtgtccagcgagccgtcggccgcgaacggcgtgaccatcgcggtcagcacggttcccaaccgcgctggggcgtcgaatccgaccgtgctcacgctgttcaggttacctggcgggggcaaggggtttcgtgaccgctcaggcctcggtggccagcgggctggtggcgacctcggtgccgtcggccagcgtggcgatctcgaagtcggcgaacaccgcgggcgcgacgtccgccagccggcgcaggcactcgatggccagccgccggatctccacgtcggcgtgctcgctggcccgcatggcgatgaagtggcgccaggcgcggtagttgccggtgacgacgatgcgggtttcggtcgcgttgggcagcaccgcgcgggcggcctggcgcgcctgtttgcgccgcagtacggcgctgggttggtcggcgaacttggcctccagcctggccagcagctcggtgtaggtggcccggctggcgtcggcggccgcggccaggatctgctgcagctcgggatcgtcgtccaggcccggcggcacgacgacgcgggagtcgttttcggggacgtagcgctgggagagctgggaataggagaagtgccggtgccggatcagctcgtgggtgcaggaccgggagatgccggtgatgtagaacgacacgctcgcgtgttcgagcaccgagaagtggccgacgtcgatgatgtgcttgatgtagccggcgttggtcgcggttttggggttgggtttcgaccagctctggtagcaggcccgcccggcgaactcgaccagcgcggggccgccgtcggcgtcggtgctccatggcacgtccgggggcgccaggaagtcggtcttggcgatcagttgcacgcgcagcggcgcgatctcggccacgggcaatcaccttagcccggcgacgatgcgcgccgccgcgcggcgcgaggaggagccgggcaatctgaccccgcccggcgacgatgcgcgccgtgcggccgcgtcaggcgaccgcacgcagcgccagagccagatccccgcggtcggcgacgctgagcccgcccagccccagccaggacgccatggaccacaactcaccggccagcaccgcggcgacccggggccgcggcgcctgcggctcggcgaaggcgccgaggacgcgcagcgtgccctcggcccggtcggccttcaggtcgacgcgggccgccagccgcccgtccatcagcagcggccacacgtagtagccgtaccggcgcttggcggccggcgtgtaaatctcgatgcggtaatggaattcgaagagccgctcgacgcggggccggaagaagatcagcgggtcgaatgggcacagcagcgcggtgccgcggtccgtgcgcggcacggcgcggccggcccgcaggtaggccggcgccggccagccggccacctcgacccgttccaggtcgccggcggccaccagctcggcgatcgccggcttgacctgcgcggcggacagccggaagtagtcgcgaatgtcggcctcggtgcccacccccagcgcaccggcggcccgcagcgtcagctcccggatcgcctcgtcgtcgtcgacccggcgggccagcacgtcggccggcagcacccgttccaccaggtcgtagtggcgggcgaagccgacccgggtggcggtggtgagcactccggcggcgaacagcgcctcggcgacccacttggtgtcgctgcggttccaccaggcgcccttcctgcggcgcggctcggccgccagatgcgcctcgatctggccggccgtgctgggcccgagctcggcgacggcggccacgaccgcgtcggcgagccgcggattggcctgcacgatgtgggttccccaccggccgtgccggtactgacgcatccgccagcgcagcaacggccaatcctcgacggccatcagcgcggcctcatgcgcccagtactcgaccagcagccgcgacgagcgcgggccccacgcggcgcggtcgagcacctcgcggtcatacgggccgagccggctgaacaccggagcgtagtgggcacgcaccgtcaccgacaccgaatccaattgcagcacttggattttggatatcagccggttcaggtgcgcgcgggtgacggcacccgcgggccggggctcggtaaagccttgcgccgcaacggcaatccggcgggcctgggcgacggacagcctgcgggtcgacaccgcgccgacgataccgccgcccggcgacactcagcccgcgcggaccttgccgtccatcgccgccagcacgccgtcgtcggccgagccctgctgctcgtcgtaggcggcctgcagcgcggccgggacgtcctcgagctcgcggtacacgctcatcagctgctcgaggatcttgatccgctgcgcgctggcctcctccaccgcacgccgggccgtgtcgcggtagtggtcggcgccctgcttggcgtcgccgagcagctgctcgcactcccgttcggcggcgcggcgcgcctcgtcgatggccgcctgcgcctcggcgcgcatgtcggccagctcggcgtccagcttctccttggtctcccggtattcggcctccagcgcctcctgctgcgcggccatgtcggcgagcacctcgtcgcgcttgcgctcggcggcctgcgcctcggcttccgccgcggcgatcagcgcgtcggcctcggcccgcgcctcggcctgcatctcggccacctcgtcgaccgcgcgggccagcatcttggccatccgctgctgcaccgcgtgcggcgccggcgaggtgtcggtgagcgcggcgacctccttgcgcagcgcggccgtttgctcgttggactcctgcagccttgcccgcaggctctccacgtcgtcgatcagcagctgctgcttggcggtcagcatctcgatgtgcgcgtcgaccgcagtggtgtcgtagcccatgaacttgcgcgaaaacgtcttgacgggttcggtgatcactgccaattcccccttttcccgaacagcggctggtagacggtgtgtgaccgacccccgcgtccgagtatgtcagctcgggcgtgagggcgaacagccgcgaacggaagagcgcgggtcccgacggtagctgtggaaccggtaccgcagcccggagcggctggccagccactcgcccgtctcgcccacccagctgtcgtccagcgccggcgccagcgcgtcgtcgtcgtcgcggcgcaggtcgatctcgatctcggtgacctcgcagcgggtggcatgcggcagcgccagcagatagatctgcgcgccgccgatcacccacggcgccgggtcgctcccggcgtgcgcgagggccgcctccagcgacccggccacccgcgccccctcggcgacgaagtcgggccggcgcgacaccaccacgttgcgccggccgggcagcggccgcaccttggccggcaacgactcccaggtccgccggcccatgatcaccgtgtgccccatggtcacctctttgaaccgggtgaggtcttcgggcacgctccacgggatgtcaccgccgcggccgatgacgccagacgtcgactgggcccacaccaggcccacctcggcacgggtcataccgcgacgggggccttgatggccgggtgcggatcgtagttgtgcaccacgacgtcgtcgtaggtgtagtcgaagatcgaatccctatgcgccagaatgagttccgggtagggccggggctcgcggctcagctgcagccggacctgctcgacgtggttgtcgtagatgtggcagtcgccaccggtccacacgaattcgccgaccgacagcccggcctgggcggccatcatgtgggtgagcagggcgtagctggcgatgttgaacggcacgcccagaaacaggtcggcgctgcgctggtagagctggcagctcagccgcccgtcggccacgtagaactggaagaacgcgtgacacggcggcagcgccatccgcgggatctcgccgacgttccacgccgacacgatgatgcgccgcgagtcggggtcggtgcgcaacagatccagcgcggcgctgatctggtcgatgtgctcacccgacggcgtcggccaggaccgccactgcacgccgtagatcggtccgagatcgcctgtgtcgcttgcccattcgtcccaaatggtgacgccgtgccggtgcagccagtcgacgttggagtcgccgcgcaagaaccacagcaactcatagaccaccgatttcagatgcaccttcttggtggtgatcagcgggaagccggccgacaggtcatagcgcagctgctggccgaacaggctgcgcgtcccggtgccggttcggtcggatttggccgttccccgatcgagcaccagacgcagaaggtcctcgtagggcgtcgggatgggcacgcggcgatcttacgtcggacggccaggagtagaacgggtgccatgccgaagatcaccgacagcatcagcaccgccgacggcacctgcccggtgcgcctgtttttccccgacgggtccgggccgtggcccggcgtggtcatgtatcccgacgccggcggggtgcgcgacacattcgaccagatggccgccgagctggccggattcggctacgcggtgctgctgcccgacgtctactaccgcagcggcgaatgggccccgttcgacatggcgaccgtcttcgccgaccagcaggagcgcaaccgcctgttcgccatgatcggcagcgtcaccccggaccggatggccaccgacgccgcggcgttcttcgactacctggccgcccgcccggaggtgtccggcgaccggttcggggtgtgcggctactgcatgggcgggcggacatcgctcatcgtggcaggccggctgcccgaccgggtggccgcggcggcgtcgttccacggcggcggcctggtgaccgacagcgacgacagcccgcacctgctggccgaccggatgagcgccacggtgcatgtcggcggcgcccaggacgacgcgtcgttcaccaccgatcacgccgagcagctggacaaggcgctgaccgcggccggtgtccggcacaccatcgaatggtattcggccgcacacggtttcgcggtccccgacaatgcgccctatgacccggccgcggccgaacggcactgggacgcgatgcgcgatgtgttcgccgcggcgttaccccgctagccgcgccaccagcagccgcgcggcccgcgccgcgccgtcggtgcggatcgtcgcggccaccgccccggcgcgggcgcgggtccgctcggtcagggcggtcccgagcgcggcggacagcgattcgacggtgggggccggaccgtcgtgggcggcgccgatgcccagctcggccacccgggccgcccagtacggctggtcggcgccctggggcaccaccacctggggcgcgccggccagcgcggccgccgtcagggtgcccaccccgccgtggtgcacgacggccgcgacccgcccgaacagcgcctggtggttgacctcacccacgaccaggcagtcctcgccgtcgtcgatcggccccagcccggcccagccgcgggagacgacggcgcggcgccgctgcgcgcgcaccgcctcgatggccacccgggcgacgtcccgacaggcccgcatcggcatgctgccgaagcccacgtacaccggcggggcgccggcatccaggaaggcctccagctccgcgggcaaccggcgatcgtcggccagcagccaggcgccggtctgcaccacgtcgaggtcgccgggcggccgccacggatccagggtcgggtcggtggccagccacgggcgctcggtgagcgcgtagccgcggaggtcgtccagcggcggcaggccgatcgccgcccggcgcgcgttgagcgtctcgccgaacagcgcctgcatgtaccggccgtcgagctgccacagcagccggttgtcgatcaggcccgccgcggacggcgcgtcggcgtacccgggcggcgggtagtgcggcgacggcaggatggtgggctgatagctgacgtaaacgtagtgggcgccctgcttttcggcggccgagcgggcggcggccgcggccggcgggaagccggccaccaccagggcgtcgcattcccgggcggcggccgccgcgtcgaactgggcggcgatgagcccgtccagctggcggcgcagctgctcctccgacggcgtcgtcgccgcggttttcatcgcccgcagcgagtcgccgaacgccaccagcggcaccccggcgcgggccagcagctcagcgaattccgcgtccggcggggcgctcacccgcgcgtcgacgccgagtgcccgcagctgcaccgcgagcgcggccagcggctgcaccccgccgcgcgagtcgtacgccgacagcagcacacgcatccgctggttcccgccttcaaggtgtggtcgggaaactctagcgtcgccgcggcccggtcaggacggcgtcggcgccggccggaatccctgcgcggcgccgagcacggtgccgccgtcgatgaccagtgtctcgccggtgatccagctggcggcgtcggacaccaggaaggcgacggcggcggccacgtcgatcggctcgccgatgcggcccagcgcgatcgaggacgacagcgggtcctcgtggtccttccacagcgcctcggcgagccgggtgcgcaccaccccgggggcgatcgcgttgacccggacgcgcggcgaaagttccagcgccagttgcttggtgacgtggatcagcgccgccttggtggcgttgtacatgcccattgccggcgactggtgcaggccgccgatggaggccgtgttgacgatcgagccgccgtgttcgcccatccacgacttgaccgccagcgaggtccacagcagcggcgcccacaggttgacgtcgaagatcttggcaaaccgggcgtggtcctgctcgatcagcggcccgtacgccggattcgtcccggcgttgttgaccaggatgtcgacgctgccgaagcgctccagcgtgagctgcacgcactggcgggccgcgtcctcgtcgaccgcgtgggcaccgaccccgagggcctgcggccccacctgggcggcggcctcgtcggcggcctcctgcttgcgggcggtgagcaccacgttggcgcccgccgcggccagctgctgggcgatggccagcccgataccgcgcgacgcgccggtgatgatggcggtgcgtccggtcagatcctgtgaggtcatggtgtgccttctgtcgcggtggtgggccggtcgttcgtttgctgccgaaattttattcgcgatgttttggacaggtgttgaggtggtatgccagccgcatgcgatcgaaattgacactcatgaaaccgctggtcgttgccgcagcggctgccgcggccatcgccgccgcgcccgcggccgccgctgacgtcatcgtcgcagggccagccgggccggccgcgcccacgcacatcaccttcaaggacgacccgggtggtggcggctgcgacgccaacggcaactgcggctccggtgggcaggaccagggtccgggcggcggcccgggcggacagggctgtgtgcccggcgtgggctgcggctccggtggccagttcgccggccccggcggcgtgcccggcggccagggctgcctgcccggcgtcggttgcggctccggccacgcgtaaccgctcaaccagtcagcctcccgagagcctggtgatccaggcccgggaggctgctgggtctatgacgtcgtccagctcgaaggtggtcgccgcccgcagcgccttgccgtgctggtaggcggccgccaccaggcggtcgaagaggttttgccgttcggccggatcggtgacggcggccagctccttgcggtagccgagccgcaccgcgctctccaggcccatgccgccgatctcgcccgtcggccaggcgacggtgaattgcggtgcgcggaacgaaccgccggccatggccatcgcgccgagcccgtatcccttgcgcaggatgatcattcccagcggcaccgtcagccgcgcgcccagcacgaacatccggccgaaccggcgcaccgcggcctgggtctcggcgtcgggccccaccatgaagccgggggtgtcgcacagcgagatcaccggcagcccaaaggattcgcacaacgccaggaagtcgccggccttgtcggcggcctcggcgtcgatggcgccgccgaggtgatgggtgctgttggcgatcagcccgtagggcacgccctcgacgcgcaccagcgcggtgacgatgcccaccccgtagtcggggcgcagctccagcaccgacccgacatcgacgatcgcctcgatggcgcggtgcacatcgtaggcgcgtaatcggttctgcggcaccacatgtcgggccacccgcgggtcgggcgcctgccaccggtccaggcggccctgaaagtaggagaggtattgcttggccagcgacaccgcgtgcgcctcgtcgcgggcgaccaggccgaccaccccgttgcggcgctgcacggcgatcggcccgatcgcctcgggcgggtagacgcccagcccgccaccttcgatcatcgccggcccgcccatcccgatgttggcgtccggggtcgcgatgatgacgtcgcacaccccggccagcgcggcgttgccggcgaagcaccggcccgagacgaccgacaccagcggcacccgcccgcgcagcccggccagcatccggaaggtcggcacgtccagccccgcggcgccgccgacgtcggtgtcgccgggccgtccgccgccgccctcggcgaaaagcaccaccggcagccgtttccgggcggccaggtcgaagacgcggtcggtcttggcgtggttgcgcatgccctgggtgcccgccagcacggtgtagtcgtaggaggccacgacggcctgcgcggcggccgggccgaaccggtcggcgccgacggtggccaggccggcgaccagaccgtcggccggggtgttggcgatcaggtcctcctcggagcgccggctgcgctgcgcggcgatggccagggcgccgtattcgacgaagctgccggggtcgacgaggtcgtcgatgttctcccgggcggtgcgcctgccctgccggtgccgtttggcgacggcgtccgggcgcccctcgtccagggtccgggcgtgccgctcaatcacctcgtccaggtcggcgcgggttaggtcgagatcggttgccgccgtttcggattcaccgtcgtcaccgcccgtggtgcgggtgaagaccagcagcggatcgccggtcccgacgacctggccgggggtcaccagcacccggacggtgcgcagcgcgtccggcgcggcgaggacgtgctgcatcttcatcgcttccaggacgaccagctgggcgcccgcggggtagtccgcgccctcgggcgccacctcgaccacggtgccggccagctgcgcccgcagcgcgtcctcgccgggatacagctcgacggcgcccggctgcgggccgggctgatgggtcagcgcggcggcggccaactcgggaagcttctcgtccacgaaatcggtgttcacccagccggtttcgagtcgctgttcggccagcagccggcgcaggaacccgatgttggtggccacgccctcgacgccgaattcggacagggcggtgtcggccttgcgcatcgccgcccgccacgaggatccgtgcaccgcgacgatcaccttggccagcagcgagtcgtactgcgggctcaccaccagtccgggccggccgtaggtgtcgacccgcactcccggtccgctgggcgggcagaacgcggtgagcgtgccggcggacggcagcacggagaagtcggcgccgaacgtctccgcgttgacccgcagctggatcgcgatgccccgctgggcggccggctcgccgatgacttcggtgccgtccgaggcgattccggccggcaggcccagccggtagtaggactcgccgccggcgatcgccagctgcacggcgaccaggtcgagcccggtggtctgttcggtgacggtgtgctccacctggattcgcgggttgacctccaggaagacgaaacgctcgccgctgaccaggaactccacggtggccagcccgcgcagcccgacgcgggcgcacaaccgcacggccgcctggtgcagcgcgcggcgcagctcctccgaaagcccttgggcgggcgcgatttcgatcagcttctggtagcgccgctgcatgctgcagtcgcggtcgcccaccgccagggcgtgcgtttggtgcccggccggcgcggcgaccacctgcacctcgatgtggcgggcgtcgccgagcagcgcctcggcgaacagcgccgggtcgccgaaccccagccgcgcctccgcggcgcagcgttggtaggcgccggcgatttgagcggcgttgtgcaccttgcgcattccccgcccgccgccgccggccagcgccttgatcatgatgccgccggggtgcgcggcgaagaacgcctcgatgtcctcgacgccgctcgggccgtcggtggcggccagcgtcggcaccccggcggcgatcgcggcgcggcgggccgccgtcttgttgcccagcagctcgagcacgcgcccgtcggggcccacgaaggtgtgactggcggcggcgcaggccttggcgaattcggcgttctcggaaaggaatccgtagcccggatgaatcagcgttgcgccggtgttctcggccacggccagcagggcagcctggttcaggtaggcgggcgggccgctgccgggcagcggcatcgcctcgtcggcggcgtgcacgtgcgggctgtgcgcgtcgtccgcggcgtacacggcgacggttcgcatacccagttctgttgcggtgcggatgattcgaagtgcgatctcgccgcggttggcgaccagcaggctcgcggtcatcgcagcgggtcaccccagtgcacctggtcgcgcagtctggccttgagcagcttgccgccggcattgcgcggcagtgggccgtcgacgaccgtaacgtactgcggcaccttgaagtcggccagccggccacggcagtgctcgagcaccgccggcacgtcgatgtcgtcgtcgccgaacagcaccgcccccactttctcgcccatcacgtcgtcgggcacccccagcacgcacgcatccgcgacgccgggcgcacccagcagcaccgcctcgacctcgacgctggagacgttctcgccgccgcggttgatgatgtccttgagccggtcgatgatgtgcacccggccggcgtcgtcgacgcgcaccacgtcgccggtgtgcagccagcccccggcgaaggtgctcgcggtggcctgcggccgattccagtagccggcggtcacgttggcgccgcgggtgaccaactccccgacgccgggttcgttgtcgccgaacgggatcagccccaggtccaccgacgggaccgcatacccgaccgaatcggcatgctcgaccgcttcgcggtcgggcagcaccgtcatcagcgacgccgtctcggtcatgccatagccgttgaacaccgtggcgtgcgggaaagcgtctttcaccgtgcgcaccagcgacggcgcgatgggcgccccgccgtaaccgacccagcgcacgcgggatacgtcggttccggcaaaatccttgtggcgcaacaacaatgcatagatcgccgggacggtgaccatcaccgagacacgttcggcgaccaccgcgttgagcagcgcatccaggtcgagcgcgggcaggatcaccgacgctcccccgagccgggccgcggccaaaagctgtgagttgcaaccggtcacatggaacagcggcaccgagatcagcgtgcgcatgtcctcgcccaggtcccgcggctgctgcaagcagcggatcgcgttctcggtgttggtcaggaatgcctcgtgtgtggtcggcacgcccttggggtagccggtggtgcccgacgtgtagaacagggcggcggtgtcggccgcgccgagttgctcggtgacgtagggttttccgtccggcagcgggtcacccggcgccagctgtagccgtgcaccggagtcggacagcacgaaatcgacctccggttgcgcggagcgcgtattgaccgccaccgcaacgccgccggccagcaccgtgccccagaaggccagcacccagtcgatcccggcgggatagcgcaccgcgacgcggtccccccgccgcagaccgtcggcgcgcagcccgccggccacccgcgccgcccggtcccacagctgccggtacgtcagccggccaccgccgagctcgaccacggcctcgctgtccgggcgggcgtcgacctggtcggcgagcatgtccaccagcgtggcgggcagctcgtcgtagcgcggaatgccgtcgcggccgcgggacacgccggtggtcgggaacgggttgtgctcccgcgcgatttcgatcactggcggcatgccggtcctacctatcctgctgcctatcctgcctgctgccctatcgtgatagcggtgacgatcgaggatcccgccatcatgcccgaggcgtttttcactgtagacggcgactcctatgttccgggcacgatgacccggggcccgtggggcgcggccatgggcgggcagatcgtcggcggcctgttgggttggggcatagagcaatccggcgtcgaccccgacctgcagcccgcccggttcaccgtcgacctgttgcgccccgccttgctggcgccggtgcagatccgcacctcggtgcagcgggagggccggcggatcaaactggtcgacgccggcctggtgcagaacggcgtcgtcgtcgcgcgggccagcgcgctgttcctgcgtcgcggcgatcatcccgacggtcaggtgtggtcgcctccggtgcagatgccgccgttgccgacgtcgtccgagggcttcccggcggacatgccctttctcatctgggggtacggggccacccgggcaggcagccccggtatcgccgccggcgagtgggagcaggcgcattcgcagaagttcgcctgggcccggctgtttcgcccgatggtgcacggccatccgctcacaccgttcacccggctggcgttcgtcggcgacatcaccagttcgctgacccattggggcaccggcggattgcgttacatcaacgccgactacaccgtcagcgcgagccggttgcccgacggcgagttcctcgggctggcggcccaaagccattacggcacggccggggtcgccgccggcgccgcgacgctgttcgaccggcacggcccgctcggcaccagctgggcgctggcattggcgcagccggcggacgccttccagccggcgtacacctagtccatcaattgggctagtccatcaactggctagtccatcaattgggcggcgaccgtcgcacccagctcccagcacgcctgcaggtcgtccttgctgggcttgcccgaaaccaccaccgtctcagcggctttcgtccagcccaggccggtcgtgatggtgtcgacggcgcgctgggcgccctcggtgccctcgttgccgtgcaggtacaggccgaagggccgcccgcgggtggagtcgagcagctggtaatagctgcagtcgaaggcatgtttgagcgcacccgagatgtaacccaggttggccggggtgcccagcagatatccgtcggccgccagcatctcggccggcgagaccgtcagcgccgcccggcggacgacctcgacgccttcgatctcggggtcggtggcgccggagaccaccgcctcgaacatctcgtgcgtgtgcggcgacggcgtgtggtgcacgatcagcagcgtcttgctcggtgtgtcggtcactggtggccctgcaggtcgacggcggtcttcatggcttcccgggcgcggcggcggtccccggcgtagtcgtaggcgcgggccagccgataccagcgccgccagtcgtcggggtggttttccacctcggtgcgcacggtggcgaacagcgcgtcggccgcgtcgcgccggatgcggcccgacggccggcgcggcagcgcgctggtgtccagctccatgccgtcggcggcgatcagccgggccagcctctggtgggcgaatccggcgcgcagggtggcgatcatggcccacagcccgagggcgggcatgatcagcaccgccacgcccaggccgacggcggcggcccggcccgaggcgatcatcgcgatggccacccgcccgagcagcgcgaagtacaccaccagcgccacacacaggaaggcgacgagcagttggatgcgcagcgctttgttcatagccgtttgctcatagccggtttgctcagcccaggtcgagcagcggttcgaggcccacggtcaggcccgggtgttccctgatgcgccgcaccgccagcagcacaccgggcacgaacgaggtccggtccaggctgtcgtggcggatgctcagcgtctcgccctcggtgccgaacaggatctcctgatgggcgaccagcccggccagccgcaccgcgtgcacggggatgccgtccacgtcggcgccgcgcgctcccggcaggctggtgctggtggcatcggggttggggggcaagccttttcgcgcttcggcgatcagtttggcggtgcgggtcgcggtgcccgacggggcgtcggccttgtgcggatgatgcagttcgatcacctccgccgagtcgaagaagcgcgccgcctgcttggcgaagtgcatcgacagcacggccccgatggcgaagttcggcgcgacgagcaccgacgtgccggggctgtcggccagccactcccggacctgcgccagccgttcggcggtgaagccggtggtgccgacgacggcgtgaattccgttgcgcaccaagaactccaggttgcccatcacgacgtcgggatgggtgaagtcgatcaccgcctcggtgccgccgtcggtcagcagactcagcggatcgccggcgtccacctcggcggacagcgtcaggtcctcggcggcctgcaccgccgccaccatcgtcgacccgacttttcccttggctcccagcactcctacccgcatggctgaagcctagaccgggtcacattccgcgccgcgcggtgccgcgggttcaggtgtgcacgatccagcccgcttcggtgtacggagcgggttgctcgggatcgttgatcgtgaggtacaggtcaccgcccgccggcatcgcgaagccgacgaatccatgtgcggtctgcccgtcgtgaaggccgcccgtctgcagcgggggcatcttgccgagcctctggtagtcgacggccatcgtggccggctggggcgcatcgtcgggatgggtccacggctgattgccgccgccgtatcccgcgaacatatagcgctgattcacctggaagaaccggtgcgacgtcgcggtgatcgtcagttccaccacgttgcacgcggagccagccgtcggagtcgcgaaatgcgaggtgcagcccggcggcagccacgtcgcgctgttgacggtgatgtcggcggtcgccccgctggcggctcgtgcatgcacgggcacgcccagctggccgatcgggaacggtggactgtccggcgtcgagtcggccgaaccggtgggacacgggcatgcggcgacgaccacggtgatcgcggctgccgcattcgcccatccggcgcgcacgacgcgtggttaccctccgcgccaccacgacaaacgcgagcgcatcccgccctcacagctggaccgccgggggcgggcttcgagccggggttgtccacagttcgcggttcatccacagctgcggcactgtccatttccccgcgcccggatccgccataagattcgaacatgcattcgatcgaagtaccggccgaggtgcgcgcggccctggacgcgctggacgccgccgacgcggcgatccgcgcgctggacttcgacgccctgcatcccgtcgtccggcttcgcgcgctcgaacggatggaggcctcgcggcggcggcagatcgcggtcagtcacggtgtgatcgccggtttggccggcgagggcccgggcaacgtgggcggcccggtgcataaggtcatcgccgaccgcctgcggatcagttacgccgaggcgtgccggcggcttcgggaagccaagcagctgtcgccgcgcctgacgctgaccggccaggaattgccacccgaattgccggccaccgccggggtgtggcgcgagggcatgctcgacgggcagcacctgcgggtgatcgagaagttcgttcgcgaccttcccgagacgacgcccgtccgcgcgctggaagaagcggagcggtttctggcccaccaggccacactgttgcggcccgaccagctggaaaaggtcgcgcaccagtgcgcgttgcgcatcaaccccgacgggaagttctccgacgccgaccgtgcccgccagcgcggcttcacctggtgcggccagcgggccgacgggatgagcttcggaaagctttgggcctcaccggaattgcgcgccaatctggacgcgtggctggcccggttcgcggcccccggcatgtgcaacccggacgacgaggccccctgcgtcgccggcgaacccgacgaggagtccgccaccaaggactcgcgcactcccgcccagcgccagcacgacgcactcaacgccctgttgcgcggccggttgggtgatccgaagctcggtctgcacaacggcttaccggtcacggtcgtcgtgtcgaccacgctgcgagagctgacgacgggcgccggccgggcggtgacgggcggcgggacgctgctgccgatgcgcgacgtgatccgcatggcgcgtcacgcgtatcactacctggcggtgttcgacgagcactcgagccggccgctgtatctcggccggagccgccgcgtcgcctcgccggaccagcgcgtggtgctctacgcgaaagaccgcggctgcacccaccccggctgcgacgcacccggctattggtgcgaggtgcatcatctcaacgagtgggccacgggcggcttgaccgatgtcgacaacctcaccttcgcctgcgggccgcatcacaaactgatcgaaaatggttggcggacaaagaaactcgcagacggacgcacggcgtggatcccgccaccgcagtgggaccgcggcgcgcgcaccaacgactttcaccatccggagcgcgatttcgacggcgaggacccgtgaggtccctacttcttgaaccgcccggcgaaaccgcgcagcggcagatcggcgctggtgagcagcccgggcggcgcggccaccaccgacctgatcgcggcgagcgcgggcatgccggtcacggtcatgccgatggacgcgaagttgtccgggttggacaggtccacgccgggcttggggaagatcatgtgcttgttgtagatgcacgggtcgcccttgatctgggtgatgtagcagcccttgacattccagctcgggtcggtgtgcggggtcatctgccattccaggtgcgtctccacccgcggcacgccgtcgaccatgccctggtacttgatgtagttgccgcccaacgaccccttgggcagcgtgtaccagcccaggtcgacgtccttggtgcacgcacccaactcgtagctgaacgtgacctcgtcgagggtcaggtcgaagcagtcggccatcatgtacacgctgtcggcgaagacgcgggtgtacttctccagcttggccgggatctccggatcgtccaccggttggccgtatcccacctcgatccaggtgtccttggagtggtggcaggacacgtcgaccgattcgatggtggtgacgttctcgatctcggcgacgtcggccgagcacaccacacccaggatctggttcagccccgggttcatgccggtgccgtagaacgtcgcgccgcccttcgcggcggcctcggccagcagctgggtcaccggcttgcccgacgggtgcgggtggtttttgtcgcggcgccagccggtgatccagtccgcggtggtgacgatgtcgatgcccgcctcgaggaccttgacgtagaggtcctcgtcgggaaacacgccgtggaaggtcagcacgtccggcttggcggcgatgatctcctcgacagtcccggtgaacttcaccccgttgggcgccaggccggcgaactgtccggtgtccttgccgatcttctcgggcgaataacagtgcacgccaatcagttccagatccggctgggtcgcgatccgcctgatcatctcggagccgacgttgccgcttccgacctggaagacgcgaatcggtgctgtgcccatttgcctaagcctcctgcgctgcgaactcgggatagaactgcttggcccactggcgaattgccatgaagccctgatactcgtcggcggccagcgccggcggatccgaataccgctggtgctgccagatttcgatgtcctgggtgaactgccggatcacctcgtccccgaattcggccgccttgcgctgtgcgcgggccgcatccttggccggcgtccgcccgatgtagaccatgaaccggacgtcggaggtgcgctcgtcgaccggggtgatcgccgagatggtgcggttgtcgatcatgccccagctcttggtcaccgcgatcccgagcccgccgttgatggcctgcacaccgctgttgacgtcctcgatcttttggccgtcgtcgccctcgaacgtgatggtgaagtcgacgtaggacaccggctcggcgaagtcgtgccgggtgaacaccggcacgatcggggtgttgtgcacgaatttgaagtgcgcgaagtccaccccgttctccagtacgtactgcggatgcatctccagcgcctgccggtacagccgctgctgcgggtagtagtcgtcggcgctgctgccgtcgccgaaggcggcgaacacgtcgggcgggtcgaagtagggctcgcgacgctgtaggtcatgccagatgtacacggaggcgttgcgttccaccaccggataggtgcgcatccgccggccgcggttgggccgatcctggtacgggatgcacacgttgcggccctcggcgctccactgccacccgtggaacgggcactgcagcacctcgccgacgaccttgccgccgtagcccaggtgcgcgcccaggtgttcgcagtaggcgttcatcaccgtgagctgaccggattcggcgcgccaggcgaccatctcctggtcgaagtacttcatcttgtgcacgtcgccgacgccgatctcgtcggaccaggcgacctggaaccagccggtcggcttcatcgacaacggcggcttagccatcgtgccctcccatctgagctgccctccctcgggtacgaatattaggccgccccgccgccaaatcaaagtaccctctatgaaactctgcgggcggataagtgccggcggataagatcgacgaatgacccggcagaccagcggggccggggtcgccggccggcgccccaaccggcggggccacgcgactcgcgaaagcatgctggaggccgcgctgcgctcgctggcctccggcgaaccgggttcggtgtcggccaatcgcatcgccaaggacatcggcgccacctggggcgcggtgcagtaccagttcggcgacaccgacggcttctgggcggccgtgctgcaccgcaccgccgagcggcgcgccgcgacgttctcgtcgctgtcctcgccggtctcgccggaggcgccgctgcgcgaacgggtcggcgccatcatcgagacgctctaccgcggcctggcggcaccggattcccgcgcgatcgaaaacctgcgggcggcgctgccgcgcgaccccgacgagctggagcggctgtacccgcgcaccgccgccgagctgttctcctggggcaagagctggctcgagacctgccagcaggccttcgccgggctggccgtcgaccccgaccgcgtccgtgaggtggccgccctgatccccggcgcgatgcgcggcctggtgtcggaacgccagctgggctcctacgccgacctcgacatggcgcgccggggcctgaccaacgccctggccgcctacctggagcagtcccgaccgtgacgacgcactcaggcgtcgatgaccagccgcccgccgtcggcccgcgagacgcagaccagcatgccgtcctggcccggatcggtgcggccacggtgatccacctgtccggcaagcactttcacccggcaggtgccgcagaatccttgccggcacgaatacggtgtcgtcgggtcgcggtcgagcatgacgtccagcgccgtccggttcgccggcacggcgagcacctgccgtgatcgcgccaactccagctcgaacgggacaccgtcgacgaccggcgccgggctgaaccgctcgtaatgcagtggcgcgccggcatgttcgttccgggcgatccggacggcctcgagcatggcgctcgggccgcacacgtagacggccgtcgccgggccggccgccgccagcagctccgccgcggtgggaaaccggccgtgctcgtcgtcggcccacaccgtcacccgctgcgggtccaccgaaaccacctcgtcgagtagcggcatgtactcgcggctgcggccggtatagattgcgcgccaatcgattccgcgctgcgcggccacccggatcatcggcaggatgggcgtcaccccgatgccgccgatgacgaacaacacgtcgtgttcggcggtgcccaggtagaacgcgttgcgtgggccctcgaactccacggtgtcgcccacgccgaacgcctcgtgcatctcgatcgatccgccgccgccgtcggcgatgcggcgcaccgcgatgcggtactcgccgcggtgcccgggcgggccacacagcgagtactgccggcgccggcccgagggcaacagcacgtcgatgtgcgcgcccggtgtccaggacggcagcaacccgccgtcggggtcggccagggtcaacgcgacgacgtcgggggcggcgaactcgcgtttggtcaccaccgcggtcagcttgcgctgcacgggtttcacccgcgccgggtgccaccgcgacaccgaggcgaagccctcgaacaccgcccgcacgccccacagcaccgcggtgaagcgatcgtggtcgcgccggccgtacaggtcggcgggtctgctggcccagatgctcggcgggcgcgacgcggcccagcggatgctcatgtctgtcgaatgtcccagcgcgccaacagccggatcgcgccggggctgatccggcgcagcgcgtagccgatccgcgactcggcggcgatcggcaccaccgccgggccggtcttgatcgccttgacgatcgccttggcggtggcctcgggcgtgaagttgcggcgccggtaggcggtgtcggccctgtcccgcgcccactcctgctgctgggcgctcatgccggcgtagatggtgctcttggcgatgttggtgttgacgaatccggggcacaccgcggtgacggtgatgccctcgtcggcgaagtcggcccgcagtgattcgctgagcgccagcaccgccgccttcgtggtgccgtaggccaccatcgacttcgacggcaggtaggccgccgccgaggccacgttgatgatcgttccgccctggccgcgctcgaccatctgcgtcccgaacgccctgctgccccagatgacgccgcggacgttgacgcccatgatggcgtcccaattcgccgggctggtctccaggaaacgccccgccatgccgatgccggcgttgttcaccaggatgtcgaccaccccgtgctcgttacgcacttgggccgcaaggtcgttcatcgcggcctcgtcgctgacgtcgacctggtagaccgcggccccggcgcccgcggcgcgcaccgcgtcggcggtctggtcggcggcggcccgatcgcggtcgacggtcacgaccttgcgggcgccctgacgggccagttccaccgcggtggccctgccgatccctgcgccggccccggtgaccagcgcgagccggccgcggacctcgcggcgctcgccgggcagctcacggcgctcgccggtcagctggggtgcgaccgcgccggcggactgcaaatcgacccattcggtggtgagccgggcgatgacgtccgggcgcgaggtcaccacccagtggccaccctcgatctcgatcaccctggcgcgctggggaatcgcgccggtgaaccgttgcagcgcgggcgtgacgaagacgtcccggcgcggaaccagggtctgcaccgggaccgtcgtctcgggcagccgcggtccgggcgccagcatcggcgcgggcatgttctgccggtacagctgcagcccgttgaggtagtcccgcagcgaccgccgcgtgtcccggcgttggctccgggtgctggtgtgcccgatacgctcaagggccgcaatgactttcacgccgatcccggcgcgaaacgacagttccgccgcgcccgggcacaggaagaacccgatgtagcccgaggcgatcagctgccggaccacccgggccaccgcccgcggggtgcgggccgagtgcaggaacgtccccgcgtagttcaggtgcggacccgaaatcgaggtgaacgacgccaccttgtccatgaccgactcgcccgtgaccgctttgtcggtgacggcggcccaggcctggatggaaccccagtcgtgggccagcaggtgcacccgcccgacgcccaggctgtcgatcaccgcacccatgtcgcggaccaactgggcgaacccgtacccggaacgtgttgccggacacgatgattcaccggcgccgcgcacgtcgtaggcaacgaagttgtacggcgcgccggtcagctcgtcggccaccccgtcccagacgtgatggttgtcgggaaatccgtggattgccaagatggttgggcgcgccgggtcgatgtcggtgtagcggtgcaccgccagggtgacaccgtcgtcggcggtgatggtcgacgtgacggtcatcggtcagtgcgaggcccgggcggcgggcgagacggccaggtagtcgacggcccgctgcagcccgccgagctgcgaggggtgaaagcccggccggtagtagttggcgaccgcccgcacgaaccgcagcggcccgggcaccagtccgcgccgcgcggcccggaagtagtcccgccagcgcggtttggtgtgcggcggcagatagggatcccgcgaatacatgaaccgcacgccgcggatccacaacagcagcatggccggcgtcaccaccagctgggtgcgcacctgccgccagtagccggcccgcaggtgcttcatggtgtcgaaggccaccgccttgtgttcgacctcttcggcgccgtgccagcgcagcatgtccagcatcaccggatcggtgccgatccggtcgtgggccggcgagtcgagaatccactcgccgaggatggcggtgtagtgctcgatggccgacaccagggagatctgctcgagcagccagctctgccggcggcgcgggctccaattggggcggggccccagcagcgtgccgaacagccactcgatctgaccggtgtaggggcgcaggtcgatgccccgggcggcgaagtgggccagcacattggcgtgcgcccgagagtgcacgccctcctgcccgatgaatccctggacgtccagccgcagctgatcgtcccggatcagcggcaacgcctgcttgaacacctcgacgaagaactgctcgccggcgggcagctgcaggtgcagcacgttgagcacatgggtggcgaacggctcgccgggcacgtagtggaacggcagctgcgcccagtcgaagtccacgtcgcgggcctcgagaaccagccgctcgtggtccaccgacgcgtcgtgcggacccgccgcctggttgtcgatggtcaccatgatggccccctacctcggcattacctcggcattacctcagcgttgcgccgtcgtcggcagccggcgaccccgtcgcgccgcgggcgtcgcccggcacaagcagcgtcgcaagtataggtccgcgaacccggtatgcgaaaccgccggtaccgggttctttggtgtcgatgagggcgccggcgactactcggcctcggcgcgctgcttgagccgctgcagggtgagccggatgtgctcggcgttggcgcccgcccgatcggtgactccggtggccctgccggcgaccttggcaaaccacccaggcctgcggtcccaggtgctttcggtgacgtcgcagccgccgtcggtgccgacgatgtcgtactgccagcgcgccaccggaaagacggtgtggcgcacgtcgaatgcgaagcggcgaccgggttcggcgtcggtgacggtgcacttggtgctccagcgccggccgccgttttggttgtgtccggtgaacaccgcgcccgggcgcgccgcgtcgcctttgcgccactgcatcgccaccgcctcctcggccagcgacgccagggtgggcaggtcggtgatgagccggtacaccacctcgggccgggcgtcgatgtgcacggacgcagaaacgctgggggcactcatcgtcggatcatatccacccgctctgtccagcgggtatccgttttcggtccgattgcgggccctccgaagtttctccacacttgaaagggaatccgcggacaaggggcgatcatgcgagtcggcgtaccgaccgagaccaagaccaacgaatttcgcgtggccctcacccccgccggcgtcgccgagttgacccgccgcggccacgaggtgctggtgcaaagcggcgccggcgaggggtcgtcgatccccgactccgagttcaaggcggccggcgcccaactggccgacaccgccgaacaggtctgggccgacgcggagctgctgctcaaggtgaaggaaccggtgccggccgagtatgacctgttgcggcgcaaccagattctgttcacctttctgcatctggccgcctcgcgtgcctgcaccgaggcgctgttgacctccggcacgacgtcgatcgcctacgagacggtgcaaaccgcggacggcaccctgccgttgctggccccgatgagcgaggtggccggccggctgtccgctcaggtgggcgcctaccacctgatgcgcacccacggcggacgcggcgtgctgatgggcggggtgccgggggtcaagcccgccgacgtcgtggtggtcggggcgggcacggccggctacaacgcggcccgggtcgccggcgggatgggagccatggtcacggttctcgacgtcaacatcaacaagcttcggctgctcgacgccgagttcggcggtcaggtccgcacccggtattcgtcggcctacgacctggagggcaccgtcaagcgcgccgacctggtcatcggcgcggtgctgctgcccggcgccaaggcccccaacctgatctcgaattcgcttgtcgcgcagatgaagtcgggcgcggtgctggtggacatctccatcgaccagggcggctgcttcgaggactcccggccgaccacgcacgacgacccgaccttcgccgtgcacgacacggtgttctactgcgtggcgaacatgcccagcgcggtgcccaagacgtcgacggtggcgctgaccaacgccaccatgccctacgtgctggccctggccgaccgcggctggcgtgcggcgtgccgctcgaatcatgctctggccaaagggctttcgacacatgacggtgcgctgctgtcgcagcaggtggccgccgacctcggtctgccgtgcaccgacccggccggcgtgctgcagcaggactaaccggtggcggccaggccggcgacgatatcggccgcggggccggcgctggcgtgcttgaacgccgcccccgcccacagcggtatcccgttggggtcctcgatggcggcggctgcctcgacgatgggtgtggtcatctggttcacctcgggatagccgagcggcgccacgtggtcgagcatgcgggtgaagtcgttctccagccctcgtgcgtagcggcccgaaaacgcccgggtgacaacggtggtggcgaacagcgggttcttcagggcggtgcggtgcgccgcattggtgccggcctcgtcggcgagcagcagcgcggtgccgacctgggcggccaccgcgccccggcgcagcgccgcgccgacctcgtcggcggtgccgagcccgccggcggcgatgatcgggatgtcgtgggcgtgccggatgcggtcgatgagctggtgcagcgactcgttggccggctccatgtccggagcgaaggtgccgcgatgcccgccggccgcgggaccctggaccaccaggctgtccgcgccggcggcgacggccactccggcctcgtaggccgacgtcaccgtgaccatcaccagcaggcccagcgcgcccagccgccggatcacgtcgggcggcgggacgccgaaggtgaacgacaccagctcgggccggacgtcggcgaccacctcgagcttctgctcccacccgtcgtcgtcgccgtagcgggggtggccgacctccacctggtagtgctcggcgatctcctccagttccgccgcgtagtagtccagtgccacccagtcggcgacgctgggctggggcacgaacaggttcaccccgagcgggccggtggtggccttgcgcgccgcggcgatgtcgtcggcgaattgttcggcgctgacgtagccggcggggacgaagccgagcccgccggcgttggacaccgccgcggccaacgcgggggtgccgggcccgccggccatcggcgcgccgacgatgggcaccgtgatgtcccagaagcccagcaccattgggctactccggcgacggcgagcgccggcacggcgcgagtaaggaggcggacattggcttaccgtaccatcgcccgaagttgttggggcagtgaccgtttggtgccatacgggcccaggaccgcggcaccgtagtgctgcgtgagcagccggcgggcgatcgcgttgacctcgtcgacgctcacccggtcgatttgcgccagggtgtgctcgatgctgcggtgccggccgtagttgagttcgttgcggcccagccggctcatccgcgagccggaatcctccagacccagcaccaggccgccgcgcagcgagcccttggcgatccggcattccgactcggtgatgccgtcgcgggccaccgattcgagcacgccgctggtcaccgccatcacctcggcgaagcgttccggttggcaggcggcgtacaccgacagcgcgccgctgtcggcgaagatgtccaccgtcgagtagaccgagtaggccagcccgcgcagctcccggatctcttggaacagccgcgaactcaggcccccgcccagcgcggtgtgcagtaccgacagcgcccagcgatgctgccagccgcgcccgggcgtgcgcacccccagcgacacgtgcgtctgctcggcgtcccgggtgcccagcagcagcccgggccggccgttcacccgtccggcgcccttgcgcggcgcgatcggttgccgcccgcggaccaggtgcggcccgaagtgctcgcgcaccatcgccaccacctcgtcgtggtcgacgttgccggccaccgccaccaccatccgttcgggtgtgtagcggcggacgtgaaacgagtgcagctgcgtccgcgtcatcgacgcgaccgaccgcgcggtgccgatgaccggccggcccaccgggtggtcgccgaacagcgcgcccaggaacatgtcccccagcgcgtcctcggggtcgtcgtcgcgcatcgcgatctcttccagcaccacgtcgcgctcgagttcgacgtcctcggcggcgcagcggccgttgagcaccacgtcggcgaccaggtcgacggccagttccaggtcggcgtccagcacgtgcgcgtagtagcaggtgtgttccttggcggtgaacgcgttcagttctcccccgacggcgtccatcgcctgcgcgatgtccaccgcggtgcgggtgggcgtggacttgaacagcaggtgctcgaggaagtgcgcggcgccggccacggtggcaccctcgtcgcgggagccgacgccgacccacaccccgaccgaggcggaccgcaccgcgggcaggtactcagtgaccacccgcaggccgccgggcagcgtgctgcgccgcagggcggcgtgcgggtgcggttgcgcctcgacgaccttgccggcgcgcagggcgccggtcgatgagtcagctgctcgccttctgctgtcagctggtggcatcggcaggggcggccgccggggtgtcggcgggtgccgagttgtcttcctccaccaggaccagcgagatcttgccgcgcttgtcgatgtcggcgatctccacgcgcagcttgtcgccgacgttcaccacgtcctcgaccttggcgatgcgcttgcccttgccgagtttggagatgtgcaccaggccgtcacgcccgggcagcagcgacacgaacgcgccgaaatccgttgtcttgaccacggttccgaggaaccgctcaccgacggtgggcagctgcgggttggcgatggcgttgatccggtcgatcgcggcctgcgccgacgggccgtcggtggccccgacgaacacggtgccgtcgtcctcgatggagatctgggcgccggtctcctcggtgatggcgttgatgatcttgcccttggggccgatcacctcgccgatcttgtccaccgggacccggatggtggtgacccgcggcgcgtacgggctcatctcgtcgggctcgtcgatggcctcggccatcacctcgaggatggtcaggcgggcatccttggcctggctcagcgccccggccagcacctgcgacgggatgccgtcgagcttggtgtccagctgcagcgcggtgacgaagtccttggtgccggccaccttgaagtccatgtcgccgaacgcgtcctcggcgcccaggatgtcggtcagggtgacgaagcggcgctcaagcgattttgtgccgtctcccgcctcaacttctatgtcgtcggacaccaggcccatcgcgatgcctgccaccggcgccttgagcggcaccccggcgttgagcagcgccagcgtggacgcgcagaccgagcccatcgacgtcgagccgttggagcccagcgcctcggacacctgccggatggcatacgggaagtcctcgaggctcggcagcaccggcaccagggcgcgctcggccagcgcgccgtggccgatctcgcggcgcttgggcgagcccacccggccggtctcgccagtggagaacggcgggaaattgtagtggtgcatatagcgtttcgtggtctcgggccccagcgagtcgatctgctgggccatcttgaccatgtccagcgtggtcacccccaggatctgggtttcaccgcgctggaacagcgcgctgccgtgtgcccgcggaaccacggcgacctcggcggacagcgcgcggatgtcggtgatgccgcggccgtcgatgcggaagtggtcggtcaggatgcgctggcgcaccagctttttggtcagcgagcggaacgcggcgctgacctctttctcgcggccctcataggtttcggccagtcgggccagcacctcggccttgagctcgtcggtgcgcgcgtcgcgttcggccttgccgccgatggtcagcgccttggacagctcgtcggtggccaccgacgccaccgagtagtagacgtcgtcgccgtagtcggggaaggtcgggtagtcgctggtgggcctggcggccttgtcggcgagctcctgctgcgcggtgcacagcacctcgatgaacggcttggcggcctcaaggccttgggccacaacggtttccgtgggcgcctgggcgccgccgtcgatgagttcgatgacgttggaggtggcctcggcctcgaccatcatgatggcgacgtcgggcccgtcggcgccgtcgaccttgcgcccggccaccaccatgtcgaacaccgcgcgctcgagctgctcgaccgtcgggaacgccacccaggtgccgtcgatcagcgccacccgcaccccgccgatggggccggagaacggcagaccgcccagctgggtggaggccgacgcggcgttgatcgccagcacgtcgtacaggtcgttggggtccaggctcaaaatcgtgacgacgacctggatttcgttgcgcaggccgtcgacgaacgacggccgcagcgggcggtcgatgagccggcaggtcaggatggcgtcggtggaggggcggccctcgcggcggaagaacgagccggggatgcggcccgcggcgtacatccgctcctcgacgtcgacggtaagcgggaagaagtcgaagtgctccttggggctcttgctggcggtggtcgccgacaacagcatgttctcgtcgtcgaggtaggcgacgacggcgccggcggcctgctgggccaaccggccggtctcgaagcggatggtgcgggtgccgaagctcccgttgtcgatggtggcggtcgcctcgaacacgccttcttcaatttcagcgacagacatagacgtccgtacggcctctcttattcggctgtttcgcgtcatcacgcgcaactggagagggtttgcaggatcactcaccgacccgaatgggcctgcgagccacccgcggagcttttcgaggagccagtctgtatgcggctacggccatcgatcgaagcggccgacctgctccagatccggagagcccggcagccactaccgaagaccgcccgatgcagaccgggctgctccctcgaaggtgccccctcgaaaggtgcgtagtgacacgctggaacggcacacgcggatctgcgtgaccgcaccggttgctcgggccgaatcggcccagaacgtcctcactctacacgggcgaggcgcacccgccagcatcgccggcggaatcggttgttcgtgcgcggccgctaccgggtcagcggcgcaggcccagccgctcgaccagcgagcggtaccgctcgacgtcgatctgggcgacgtacttgagcagccgccggcgccgcccgaccagcagcagcagtccgcgccgcgagtggtggtcgtgcttgtgcaccttcaggtgctcggtcaggtcggcgatccgcttggtcagcagcgcgacctgcgcctccggggagcccgtgtcggtgtcatgcaggccgtaggtgcccaggatttctttcttctgctcggctgtcagcgccacgaaattgtctccatcgatcggtccgcgataatcacgagttcgggcgcggccaccgcgaaccgcagcacgcgccgatgtcgtcgggcagtctagcagcgccgggaccggcgggcataaacgctggtctgcgaacctcagcccgcggacagcagctgacgcgcccgctcggtgtcctggcccatcgcgacgacgaggtcgtcgaccgagtcgaacttgtgctggccgcggatgcgggcgacgaaatccagcgcgacgtgctgcccgtacaggtcggcctgggtgtccaggacgaacgcctcgacggtgcgggtgcgcccggaaaaggtcgggttggtgcccaccgataccgccgcctggtagcgctcacccgggatgacggtgccggtcaccggcccgtggcccagcacggtgaaccaggcggcgtagaccccgtcggcggggatcgccgaatacatcggcggggccacgttggcggtcgggaagcccagttggatcccccgcccctcgccgcggacgacgacgccctccacccggtgcggacggcccagcgcctccatggccgccaccacgtcgccggcgtccacgcaggaccggatgtaggtcgaggagaacgtcacggtctggttgctgtggtgctcggacagcagcgacatcgcctccacggcgaacccgaaccgctcgccggcccgccgcagcgtctccacattgccggtcgccttcttgccgaaggtgaagttctcccccaccaccacctcgaccacgtgcaggttctccaccagcagctcgtgcacgtagcggtccggggtgagtttcatgaagtcggtggtgaacggcatcaccaggaaaacgtcgatgcccagctcctcgaccagctcggcgcgccgggtcagcgtcgtcaactgggcgggatggctgcccgggtagaccacttccatcgggtgcgggtcgaacgtcatcaacaccgtcggcacgttgcgagcccgccccgccttgaccgcgtgcgcgatcagctcggcatggccgcggtgcacaccgtcgaacacgccgatggtcagcacacacctgccccagtccgtgggtatctcgtcttggccgcgccaccgctgcacgcccgccagcctacggcgcgcggccgcccgccgggaggtccgcggcgcgcaacgccgggcgaggtggcggggaacacgccggatcgaggttgggttgcctaaactttctccttgtgagggctgacgaagagcgtggcggtctcaccgcggtcggccaggactacctcaaggccatctggaatgcccaggagtggtcgcccgagggtgcgccgcagaaggtcagcaccaagatgctggccgagaagatcggggtgtcggccagcaccgcctccgagtcgatccgcaaactcgccgaacaggggctggtcgaccacgagaagtacggcgcggtgaccctgaccgaggcgggccggcgcggcgcttgagatggtgcgccggcaccggctgctggagaccttcctggtcaacgagctgggctacgcctgggacgaggtgcacgacgaggcggaggtgctcgagcacgcggtgtcggaccgcctggtggcgcgcatcgacgccaaactcggcttcccgcagcgcgacccgcacggtgacccgataccggccaccgacggccaggtgcccaccccgccggcccgtcagctgtgggcgtgcggcgacggcgacaccgggacggtggcccgcatctccgacgccgactcggagatgctgcgctatttcaccgacgtcggcatcaacctcgactcgcggctgcgggtgctgacccgccgcgagttcgccggcatgatctcggtggcgatcgagtccggcgacggcgccgagacaacggtggacctgggcagccccgccgcccgggcgatctgggtgacggcataactcgcctgttgagccctcgcgctttcgcgcctcgcgccccgcgcctcgcgccgcgcctctccccccgccgagcgtgcactggttgcgattccgccgccgttttttcgcgcgccgcgcacgttcggcgaccaggtcggcgcgaccgactcagctcgacagcagacccttcgcgatgtgggtgacctggacctcgttgctgccggcgtagatcatcagcgatttggcgtcgcgggccagctgctccacccggtactcggccatgtagccgttgccgccgaacagctgcacggcctccatcgccacctcggtggccgcctccgacgagtacagcttgattgccgaggcctcggccagcgtcagcggtttacccgcccgctggcgttcgatggtgtgaaagaccatgttctgcacgttcattcgggcgatctccatcttggccagcttgagctggatcagctggaactgcccaatgttcttgccccacaatgtcctgctattggcgtaatcgacgcacagtcggtggcattcgtcgatgatgcccagcgccatcatcgcgatcccgatccgctcggcggcgaaattggcccgggcgctgtcgcggccgtcgccttcggtgtgctgttcgctctcgccgagcagacgatccggggtcagccgcacgttgtcgaagaacagctcgcccgtcggcgaggacatcatgcccatcttcttgaacggcttgccctgggttaggcccggcatgcccgcatcgagcacgaagaccagcaccgggcggttgcgcttgtccaccgacgggtcgccctcgtcgagtttggcgtagaccaccagcacgtcggcgtagggcccgttggtgatgaaggtcttctgcccgttgaggatgtaggccccatctccgtcgccggagcgccggactgaggtcttcatgccgccgaacgcatccgagcccgagtccggctccgtgatcgcccacgccgcaatcttttccagcgtcatcagctcgggcagccagcgctctttttgggccagcgtcccgcggctggcgatggtggccgcgcccaggcccaggctgaccgacgcggtggacagcaatccgatgctgacccgagcgatctcggagaccagcaccgcgatcatcgagccttgcgcgccgccgccgctgaattcatttgcggcgcctgagctgtcgccattttcgtcgactccgctacgctcgcggtccagcaccttcttgaccgcctcggcggccatggtgtcgaggccgaactggctgaacagcttgcgcgcgatcggatagggcgacatcgcgccgctttccaattcgtccaggtgcggccggatctccttgtccacgaattgccggacggcgtcgcggaccatcaggtcggtgtcggaccattcgatcatggcgcgcttagcgttcggcgcgctggtaggcggtgacgacggccgcgccgcccagcccgatgttgtgttgcagtgcggcgctgacgttttcgacctgacgtttgtccgcggtgccgcgcagctgccaggtcagctcggcgcattgcgccagcccggtggcgcccagcgggtgccccttggagatcaggccgccggacgggttgaccacccagcgcccgccgtaggtggtgtcgccgttgtcgatcagcttgggcgcctcgcccgggccgcacaagccgagggcttcatagagcagaagttcgttggccgagaagcagtcgtgcagctcgatcacctggaaatcctgcggccccaacccgcattggttgtaaacctgttgcgccgcttgcacattcatgtcgtagccgatgaggttcttcgcgctgccgtcgaacgtcgaggcgaagtccgtcgtcatggcctggccgacgatctccaccgcctggccggccagcccgtgcttgtcgacgaacgcctcgctggccaggatcgccgcgcccgagccgtccgaggtgggcgagcactgcagcttggtcagcgggtcggagatcatccgcgcggccaggatgtcctcgagcgtgtaggactcctggaactgggcgaacgggttgttcaccgaatgcttgtggttcttatagccgatcttggcgaaatgctctgcggtgctgccgtattggcgcatgtgctcgcggccggcggcgccgaacatccagggcgcgacgggcatggcgaactcgtcgatctcggccatcgccttgacgtgcctgcccatcggcgattcgcggtcctgggcgccgccgcccagcgagcccggttgcatcttctcgaaacccagcgcgatcgcgcagtcgacgagcccgccgcggatggcctgggcggccaggaagagcgcggtcgaaccggtggagcagttgttgttgacgttgacgatcgggatgccggtcatgcccagctcgtagagtgcgcgctggccggacgtcgagtcgccggcgacgtagccgacgtagccttgctgcacctcgcggtagtcgatgccggcgtcggccagcgcgttggtccccgactcgcgcgccatgtccggatagtcccagccctcgcggcgaccgggcttctcgaatttcgtcatgccgacgccgacgacgtaaaccttgttggacatctttgtccccttcccaacggctcaggctctcagtgtgcaacgtggcccgaccaaccgttgggccggggcagctaaagcgtgggcccggcggctaaagcgtcgccgggcgcaaaaccaccacggacttggtccgcgcgccctcgtcgcgcagcagcgcgatcacccggccgtcgggggcgcaggcggcatacactccgtcgatcccggccgccgccagggcccggccgttgccggcggcctcggcctcgtcggcggacaaatcgcggcgcccgaagatgagcaggcaggcctcgtccaggctgtagctcagccgggggcactcggccagctcgtcgagcccatacgcctgctcgagcccgaagcgcccgacccgggtgcgccgcagcgccgtcagatgcccgcccacccccagcgccgcgcccaggtcgcgggccagcgcccgaacgtaggttcccgacgagcagtccacctcgacgtcgacgtccacgcacgcaccggcggcgcgcaggccgcgcacctcgaaccggtcgatgcgcaccgggcgggccggcagctcgacggcctggccctcgcggaccagcttgtaggcccgcttgccggccaccttgatcgcgctgacggtcgagggcacctggtggatgtcgccgcgcagcccgcccaccgccgcctcgatcgcctggctcgtcaggtgccgcgcgtcgacgctgcgcgccacgtcgccctcggcgtcgtcggtggaggtggcctggcccagccggatggtggccgagtacgacttggcggccgcggtcagcaggccgaggatcttggtggcgcgctcgacgccgagcaccagcacgccggtggccatcgggtcgagcgtcccggcgtgccccacccgtcgggtcgcgaagatccggcgacaccggcccaccacgtcgtgactggtcattcccgccggcttgtcgacgacgaccaggcccggagggctcataacacgatggcggtcagcaccagcccgcgcgccaccgaccaccggcccgacagcgcggtcagcggcggaccgcacagcgccgccggatcgatcaggatccgcgagacgaaaccgcccgtcgtcgcgcccgggtggtcggcctcgaaggtgatgcgggcgtcctcgaagcccagccagcgccgcgtcagcgggaaccaggccttgtacgttgcctccttggcgcagaacaggattcgatcccaatgcagatccccgggcagggcagacgggatctcggaacgttcggcgggcaggctgatcgcgttcagcaccccgtcgggcagcacgtcgtgcggttcggcgtcgatgcccaccgagcgcaccgcgccggtgcggcccaccaccgccccgcgatagcccgtgcaatgggtgagactgcccaccacgccgtcgggccagcggggttctcccttctcgcccttgaggatcggcgccgggggcaggccgagctcgcccagcgcgatgcgcgcgcagtgccgcacggtgatgaactcgttgcgccgcttggccaccgaccgggcgatcaacggctcctcctcgggcagcggggccaaccccggcggatcggagtacacctccgagtaggccagggcgtccgatgcgggcagcaccgaggagaccagcgtgcccgtcatcgtgactgccgctgccgcaaccgttcccggaactgcgtggcctgccggcgcatctcgggagtgatctcgaagtgaccgccgaagtcgttgaggtagcccggcgcgtactggggatccggcagcacctggcgcagccagccgtagggcttgcggcgccgccactcccgcggatagcccaccgacacctcctcgaaccgcacgtcgtcataccaggtggtgcgcgggatgtgcaggtggccgtagaccgagcacaccgcgttgtagcgggtgtgccagtcggcggtcttggtggtgccgcaccacagcgagaactccgggtagaacaacgcgtcgcacggctcgcgtaccagcgggaagtggttgaccagcacggtcggcgtcatccaatccagcgcctccagccgggcgcgggtgatctccagccgttcccggcaccacgcctcccgggtcggatagggctccggggagagcaggaactcgtcggtggccaccacgttgcggtcccgcgcgatcatcaggccctcggccttgcttgcggcaccgtccggcaagaagctgtagtcgtagagcaggaacatcggcacgatggtggccgggccgccgcgctcggtccacaccgggaacggatgctcgggcgtgatgacgcccatctcgtcgcacatgttgaccagatagtcgtagcgggccttgccgaagatctgtaccgggtcgcgggtcgtggtccacagctcgtggttgcccggcacccagatcaccttggcgaaccgccgtcgcagcaggtcaagggcccagcggatgtcgtcggtgcgttcggcgacgtcgccggcgacgatcagccagtcctccggcgacgacgggtgcagcgactccgtgaccggcttgttgcccagatgcccggtgtgcaggtcggacaccgcccacagcgtcggttgtcccgcgttgctcgattcctggcctgccacgactccccaccctaacgactccaccgcgccatccccgctccgattggaacaagttcttgtcgggctgtgacgccgcgcacccgacttgtacactcccggcaaggaaccgctgaggcgtcagggggtgtcgtgttcgccaatgttcggctgttgggggcgctgggtgcgctgctcgcagcggccatcgcgggcaccgcgggggtgctgagcgccccacccgcgccggacggcggcgccgccgggcccgtcgagctgcgatcgaccgcccagccgctggagaccaccatgaagagccccatcgtggcgaccaccgacccgcgcccgttcgacccgtgcgaggacatcccgttcgacgccgtccaggggctggggctggccttcacgccacccgaacacgaggacgggctgcgctgccacttcgacgccgggaactaccaggtggccgtcgagccgatcatctggcgcacctacgagcagtcgttgcccgccgacgcggtcgagacgacgatcgccggccaccgcgccgcgcagtattgggtgctcaagcccacctaccacaacagctactggttctactcctgcatggtggcgttcaagaccagctacggcagtgctgcagcaggcgttgtactactcgaccgtttactccaatcccgaggtcgactgcatgcaaaccaatctgcagcgcgccaacgacctggccccctactacaagttctaggccgtgagtctgacttcacttcgcccggcgcagccggcgctgcacacgctgcgacacctcggcggcagggccgccggccggctgctgggcctgcctccggccaccaccgactacaccgtgcggcgggtcgcggtgccgatgcgcgacggcgtcgagctggtggccgaccactacgcgcccgccacctccgcgccggccggcaccctgctggtgcgcgccccctacggacgcgggtttccgttcgcgctggtgttcggcgggttgtacgccgcgcgcggctatcacgttgtgctgcaaagcgtgcgcggaacgttcggctcgggcggggtgttcgagccgatggcccacgaggtcgccgacggcgccgacaccgtggcatggctgcgcgaacagccctggttcaccggccgcttcgccaccatcggaatgtcctatctggggttcacccagtgggcgctgctgcaggacccgccgccggacatggccaccgccgtcatcatggtcggtccgcacgacttcaacgaatcaacttggggcaccgggtcgttcgccgtgaacgacttcctcggctggagcgacatggtgtcgcaccaggaggacccggtgcgcgcccgggccgcgctgcaccagctgcgggcccgccgcaaggtggccgaagcggcggccggggtgccgctcggcgaggccgcccgggcgctgctgggcaccggcgcgccctggttcgaatcctggatcgaacacgccgacccgtccgatccgttctggaactcgttgcggtgcaatgaagccctggaccgggtgcgggtgccggtgctgttggtgggcggctggcaggacctcttcatccgccaaaccctgcagcagtacgcgcacttgcgcgcccgcggcgtcgacgtcgcgctcaccgtcggcccgtggacccacacccagctgctcaccagcgggctgggcgtctgcacccgggagtcgctgcagtggctggacacccacctgggtgacgcgcccggccggcgggcgggccgggtgcacgtctacgtcaccggcgtggaccggtcccgggcctggcgccgcctaccggactggcccccggccaccaccgagcgcgcgctgtacctgcgccccggcggctacctgggcgagacggcgccgagcctgaaagggttggcgccggccacctttcgttacgacccggcccacccgacgccgaccaccggcggtccgttgctgtcccccaacggcggttaccgcgacgacacccggctggcgtcccgcgacgacgtgctggcgttcaccagcgccaccctcaccgaggacgtgtacgtgtacggcaacccggtcgtcgagctcgcccacggcgccgaccatccgcacgcggatctgttcgtgcgggtgagcgaggtcgacgcagcgggccggtcgcgcaacgtcaccgagacctaccggcggctcagcgccgcggcaaaacctcaggccgacaaggtcattcgcctcgaactggacggcacggcccaccgcttccgggccggctcgcgcatccggctgctgatcgccggcagctggtcgccgcgctacgcccataatctgggctcgggcgaaccggtgctgaccgcccggcggctcaccccggtcacccacagcgtgcgttacgggcgctcccggctgctgctgcccgtcgggccggccgagccgtcagccgacggcgtcgcggacccggtcggcgacggcggctagcgtttcgtcatcgtgaatcggcggccccagccgagcgtgcaccggcagctgcacccagctcttgcagccggcgtagtccggcgtgcgggccagccgcaccggctcggccagcggcgtcaccgacaccaccagcacggccagcttgtgcttggggcggaagtcgagccggtcggcgcgcaccgactcggccgtccagatgtgcagatcctcgatggccggcaggccgtccggccggttgaccggaaccgccgcaacgactttcgcggccgcgcggatcaccagctcgtcgtcggtgctgtcggcggcggcgggcgccagcaagtcttgatgctcgggccgcacccgctgcgcgtggctgtgcgcgaccgtcgggaacaacaggaattcgccggccgccagctcgaaccgcttctccccgatgccgcccttgcgcagcagcacccgctgccgcccgtccagcagcgcgtgcaccgccgcactccactccttgagcgcgagagtcgttgtggcgagcatcatttcactcccgccaatcgcgccatcacctcgggccggcgcagcggcgggaccgtcttgggcggttgacgccgcggcggcagcgcggccagcagccgcgtcgtggcctcggtgacctcggcgaccgcggtctcgaaaacgtccgcgttggccgccgacgggcgggtgatgccgctgaccttgcgcacgtattggcgcgcggccgccgcgatctcctcggcggtggccgccggctgcagaccgcgcagttcggtgatgttccggcacatgggtccaaccataagcgctgcggccagataccgcctccgctcgcatcggccggctggctacggtaaacgcatgaccgacgagatcctgctgagcaacaccgaggagcgggtgcgcaccctcaccctcaaccggccccaggcccgcaacgcgctgtccgcggccttgcgggaccgcttcttcggcgccctggccgacgccgagacggacgacgacgtggacgtcgtcatcatcaccggcgccgatccggtgttctgcgcggggctggatctcaaggagctgggcggctcgtcggcgctgccggacatctcgccgcgctggccggcgctgaccaagccggtgatcggcgccatcaacggcgccgcggtcaccggtgggctggagctggcgctgtattgcgacatcctgatcgcctcggagaacgcccgcttcgccgacacgcacgcccgggtcggcctgctgcccacctgggggctgagcgtgcggctgccgcagaaggtgggcatcggcctggcccgccggatgagcctgaccggcgactacctgtcggcggccgacgcgctgcgggccgggctggtcaccgaggtggtgccgcacgaccagctgttgggcgccgcccaggccgtggcggcctcgatcgtcgggaacaaccagaacgcggtgcgcgcgctgctggcctcctatcaccgcatcgacgacgcgcagaccagcgcggggctgtggcaggaggccatggcggcccggcagttccggaccagcggcgacgacatcgccgccaaccgggaggcggtgctggcgcgcggccgctcccaggtccgctgaccggcaccgaccgggcgctccgttgggtctcatcccgccgacccaatacgatcagcagatgcgtgcggtggtcggcgtcaccaggctgctcggcgggctcgcgctggcggccatcgccgcggtggcgccgcgggcggtcgcgcagccgccgggcttccccaacctggacggtttcaccgccgtcccgtccgacggctacctgaccagcggcgcgccgggcagcccgccgcggatcggtttctccaccccctacgccgtggcctgcgacttctacggcgggccggcgccggtgccgcagccgtcccaggacatcaagtgcaagggcgacatgtccgggatggacgacgtgcccttccccggcggccggccccggccgggcgactgcgtgctgggcaccgtcgatttcaaggggccgggctaccagttgagccggatgtcctacggcgggtgcgacggcaatccggccccgctgccgtccggcggcaaaacgctgggcgccggccagaagctgacctacctcaacgtcacctgcgcggtgggagccgaccacctcatcgcctgcctggacaccaccagcggcgaccacgggttcgtcctgcagcgctcgggcagctgggcgttctgagaacctggaaagccgtgctaccccagggcggcgcgcagcgaggccaccgcgtcctcgatcgagccggtggtcgagtagccggccgccagccggtgcccgccgccgccgaacccggaggccaccgccgccaggtcgacctgcgccttggcccgcatcgacaccgaccactgccccggcgcgatctccttgaacaccgcggccacctcggcctgctgcgtggtgcgcacgatgtcgacgatgctctcgacttcttccgggcgtgagctgatccaatcctggttgccgacaacggcatacaccaggccgcggcccccgaccgcgtccggcagcagctgcgcggaggccagcacgcgcgacagcagcggcagccatccgaacggatgagtatccatcagggcccggctgatcccggcgttgtccacgccgatgtcgaccagccgggcggccagccgcagcgcccgggcgctggcccaccggaacgagccggtgtcggtggtcaggcccgcgtagatgcagtgcgcgacgtcggggtcgatgggcttgccccaggcgtccaggatgtcggcgatcatcatcgtcgtcgaatcagccgccacgtcaatgaaattggcggtgccgaacacgtcgttggaggcgtggtggtcgatgaccagcacctcgcggccggtgaccgccaactcactcaacacgcccagccgcttgacgctcggaacatccacggtgacaaccaaatccgcgtcgcgccggatctcgtccggcctgaccagcaaccggcagccgggcagcgacgccagcgactcgggcagcccggccggctcggcgaaactcacctcgacccgcttaccgcacttgtccagcaccagccccagggccagccccgccccgatggtgtcggcgtcgggatgcacgtgcgcgatcaccgcgacggtgcccgcccgcgacagcaactcgacggcgccgtgcgcatccacgcggacgccggtcagctcagtattcgggttggtcgtcgtcaccgatgctcccgtcccggccgggctcgacgcccgatccgctctcccggtatggatcggcctccccagccggcttggcgccggaccgaacccgcgccagatcagcgtcggcggcgcgggcccgggccagcaattcgtccatccgcgccacgctgtcggacgtggtgtcgcgggtgaacgtgagggtgggggtgaaacgcacgccggtgccggctccgaccatggtgcgcagcgcgcccttggcccgctccagcgcggccgcggcggcgccgtagtccggctcgtcgtccagcgtgcgtcccatcaccgtgtagaacaccgtggcgtcgtgcaggtcggcggtcaccttcgtgtcgacgatggtgacgccgtccagtccgggatccttgatctcgaactcgatcgccgaggcgacgatcgtgttgatccgcttggccagacggcgggcccgcgccgggtcaggcattcggattcaccgcctcctcctcatcacttcgcttccctgggcgctaccgcttaggtgcgctctttttggaccagctcgtaggactcgatgacgtcgccttccttgatgtcggaatagcccagcgtcataccgcattcgaagccctcgcggacctcggtcacgtcgtccttctcccggcgcagcgaattgatcgtgaggttctcgctgaccaccacgttgtcccgcagcagccgggccttggcgttgcggcgcaccaccccggaggtgatcatgcagccggcgatgatgcccaccttggaggaccggaagatcgcgcggatctccgcgcggcccagctggttctcctcgtagatcggcttgagcatgccgcgcagggccttctcgatctcgtcgatcgcctggtagatcaccgagtagtagcggatctccacgccctcgcggttggccagctcggtggccttgccctcggcgcgcacgttgaagccgatgatcaccgcgtccgacgccgacgccaggttgacgttggtttcggtgatgccaccgacaccgcggtctatgacccgcagcgccacctcgtcgtcgatctggatgcccatcagggcctcttccagcgcctcgaccgtaccggcgttgtcgcccttgaggatcaggttcagctggctggtttccttcagcgccgaatccaggtcctcgaggctgatccgcttacgcgaccgtgccgccagcgcgttgcgcttgcgggcgctgcgcttgtcggcgatctgccgggcgatccggtcctcgtcgacgaccagcaggttgtccccggcgccgggcaccgaggtgaacccgatgacctgcaccggccgcgacggcagcgcctcctcgacgtcgtcgccgtgctcgtcgaccatgcgccgcacccggccgtaggcgtcgccggcgacgatcgagtcgccgacccgcagcgtgccgcgctggatcaacaccgttgccaccggcccgcggccacggtccaggtgcgcctcgatcgccacaccctgggcctccatgtccgggttggcgcgcaggtccagggcggcgtccgcggtcagcagcaccgcctccagcagctggtcgatgttggtgccctgcttcgcggagatgtcgacgaacatcgtgtcgccgccgaattcctctggcaccaaaccgtattcggtgagctgcccgcggatcttctgcgggtcggcaccctcgacgtcaatcttgttgaccgccaccacaatcggcacgtcggccgcctgcgcgtggttgatcgcctccaccgtctgcggcatgacaccgtcgtcggcggcgaccaccaggatcgcgatgtcggtggccttggcgccgcgggcacgcatggcggtgaacgcctcgtgacccggggtgtcgatgaaggtgatcgggcgctccaccccgtcgtgctcgacggtcacctggtaggcgccgatgtgctgggtgatgccgccggcctcggcctcgcggacgttggccttacggatcgtgtccagcagccgcgtcttaccgtggtcgacgtgacccatcacggtcaccaccggcggccgggtctgcaggtcctcctcggtgccctcgtcctcgccgtaagtcaggtcgaaggactccagcagctcgcggtcctcgtcctcgggcgagacgacctgaacgttgtagttcatctcgctgcccagcagctcgagcgtctcgtcgccgaccgactgggtggccgtcaccatctcgccgaggttgaacagcgcctgcaccagcgacgccgggttggcgtcgatcttctcggcgaagtcggacagcgacgcgccgcgggccagccggatggtctcgccgttgccgtgcggcaaccgcacgccgccgacgaccggggcctgcatcgagtcgtattcctgacgcttctgccgcttggacttgcggccacgccgcggcgcaccaccgggacggccgaacgcgccagccgcaccgccgcgctgcccgggacggccaccgccgccgccaccggggcggccgcggaaaccaccgccaccaccgggcgaggcgccgacgccgccgccgcggtagttgccgccgccgccgtcacgaccgccgggcccaccgggccggccgccgccgggccgcggggctccgggccgcgccgggcggcccgggccaccgacaccgccggggcgcgggggcatgttgcccggcgacgcgccgggccgcggcgcacccgggcggggcgctccgggacgcggcaccgggcgcgggatgggccgatcgaccggctgggccgacgagaacgggttgttgccgacccgcggcgtgcgggcggcgggcttgggtgccgggccgggacgcgggcccggcgtggcgcccgggcggggcggttgccccggggcgggcggcttgggctgcccgggagccggcgccgacggccgcgcggccgcgggccccggtcgggccggggcctcgggcgtggcctgcgcggccggggtggtcgcggtgccgccgggctgggcgggcggcgcggccgcctcgccgttgccgccggccttgatcgcgttgtccagggcggcgtccagcgccttgtcgggcgccttgacgtcccccttggccgcggtcttcgcgtcgcccttggccgcggccttggcgggtgccttcgcggcgccctcggcggccttgccgccgccgaaggactcgcgcagccggcgcgccaccggcgcttctaccgtcgacgacgcggatttgacgaattcgccctgttcattcagtcgggcgaggacttccttgctggtgacaccgagttcctttgccaactcgtgtacgcgggccttacctgccactacttctcctgtctatgaggcgacagtcgtggggccgcgcctcgtgttcagctatgacgcattgtcatcgggacttcacggtgtgctcatgttctttgctacctgttctgtcgccgggcgctcgggcgcatggagggactctatgtgctcgaccaccgcggaggtgtccggtgaaccggtgatccgcagcgctttggtgaaagcacgccgccggatcgcctgctgggcgcactgcggcgcgggatgcagccacgcaccccgccccggcaggttaccggctgtgtcaacgatcgcggcgaattcgccgttcccggtgggcacagccaccacgcgaagcagttcgacggccaactctcgcttccggcacccgacacacgttcgcacgggtcccgaaggctcacgctggatcacggctcagtctagcgtcaccgaatcgatggtcagcaccacccgagcctgtccggccgcgcccggagtgtcccggaccatgcggtcagcggtcgtgggccattccgtgcgtggcgccgtgctcgggccggctctccgagtgcccgcccgcgccgccgggcgaatcgccgcggatgtcgatgcgccagccagtgagccgggccgccagccgcgcgttctggccctccttgccgatggccagcgacaactggaagtcgggcaccaccacccgggcggcccgggcggcctggtcgatgatcgacaccgagaccaccttggccggcgacagcgcgttggcgacgaaccgggccgggtcgtcgtcgtagtcgatgatgtcgatcttctccccggagagctcgctcatcacgttgcgcacccgctggcccatcggcccgatgcaggcccctttggcgttcagcccgggcaggttggacttcaccgcgatcttggagcgatgcccggcctcgcgggccaccgccacgatctccaccgatccgtcggcgatctccgggacctccagggagaacagcttgcggaccaggttggggtgggtgcgcgacagcgtgatcagcggctcgcgcgcgccgcgggtcaccccgatgacgtagcagcgcacccggttgccgtgctcgtagctttcgccgggcacctgttcggcggccgggatgacgccctcggaggccttggtctcggtgcccatccggaccaccaccaggccgcgcgcgttcgcccggctgtcccgctggatcacccccgcgacgatctcgccctcgcgggtggagaactcgccgtaggtccgctcgttctcggcgtcccggaagcgctgcagcatcacctggcgcgcggtggtcgcggcgatccggccgaaaccctccggggtgtcgtcccattcgctgatgacgttgccgtcctcgtcggtctcccgcgcgatcaccttgacgacgccggttttgcggtcgatctcgatgcgggcgtcgttctggtggccttcggtgtgccggtaggcggtcagcagcgcggacttgatggtctcgagcagctcgttgaccgagatgccccgatccacctcgatcgcgtgcagtgcggccatgtcgatattcatttgcgccgctcctcctcatcgctccgctctgcatcgtcgccggcgcgattcatttgcgccgctcctccgtcttgtccgtgccgcccacacccgccagttccagctccgcctgcgcagggggcgaaaactccacctggacaacggctttgacgacgtcaccgagcggaatctcgcgtatcgcccagtcccggccggcgcggaccaccagggcgatggtgtcgtcgcccgtctcgccgacccggccggtcaccgtcgagttgtccgacaggacgacgtcgaccttgcggccgcgggcgcggcgaaaatgcttgggggttctcagcggtcggtccaccccgggcgaggacacctcgagcacgtagtggtcctcgatggtgtcgagcttgtccagcagcgccgacgccgagcgggacaacgtggccgcggcgtcgaggtcgaggccgtcgtcgccgtcggcgatcaccgtgatgcgcggtggacgcgcgtgtgcgtcgatgaccacgtcttcgatctcgtatccggcgcgcgcaaactctccaccgagtagctcgatcacctgcgtctgggacggtagcccggtggtcacggcgagctcctcatcttgagttgtccggtcatctggcggatgttcgccaccccgatggcctcgcgggcggcttccggtgtcccggcggagcacacagcccttcagggtcggccctccgcgagaaccagctatccacgatacgccaggaatcagcgatgacggggtgatcgcgtcctggcatcgagcccgctttcgcgccgatggcaggatgtccttgtgcctagcgcagttccgcccgtcaacaggcgtgtcaacaggcgtgaggtcctcgccggtggcgcggcgctggccgcgctgggagcggtgtccgcctgcagcaagcccgcgcccaagccgccgccggtcgagcagctgctgggcccgctggaccaggcccgccacgacagcgcgctggccggcgccgccgccgcggccctgggcaacccgccgcaggtcgccgccgcgctgaccgtggtggcgagccagcgcgccgcgcacgcccgcgcgttgtccaccgagatctcgcgggcggccggcaagctcgccacctcctcgaccagcgagacgaccagcccgagccccgcgcaaccggccgggccgccaccacccccgccgccggtgtccgacgtgatcaacgcgctgcgcgcctcggccgacagcgccagccggctggtgggcaccgaatccggctaccgggccgggttgctggcctcgatcgcggcctcctgcacggcgtcctacaccgtcgcgctggtgcccggggggccgtcgatatgacctcgggcaaggacgccgacaacgcggcgctgtgcgacgcgctggccatcgagcactcgacgatctacggctacgggatcgtctcggcgatgtcgccgcccagcgtcaacgacatggtggtggaggccctcgagcagcaccggcagcgccgcgacgacgtcatcgccatgctgaccgcccgcaaggtcaccgccccggtcgccgcggcgggctatcagctgcccctggtggtgggcagcccggccgacgccgcgcggctggccgcccggatggagaacgacggcgccggggcgtggcgcgtcgtggccgagcacgccgagacgggcgacgaccgcgcgttcgccgccaccgccctggtccaaagcgcggtgatggcggcccggtggaaccgggtgctgggcgcctggccgatcaccaccagcttcccgggcggcaacgactgactagccgcgcagggcggccgcgatgtcggcggcaagcgacggcccggtggccagctcccgggtctggccggcgaagcggtcgcgcagctccaccacaccgtcggcccagccccggcccaccaccacgatccacggcacgcccagcagctcggcgtccttgaacttcactcccggcgaggcctgacggtcgtcgagcagcacctcgacgccgagccggtccaggtcgtcggccagcgcggtggctccggcgcgcgcctgcgcgtccttgttggcgatcaccaggtggacgtcgaacggcgccaccgacgcgggccagcgcaggcccagctcgtcgtggtgctgttcggcgatgacggccaccatccgcgacacccccaggccgtaggagcccatggtgagccgcaccggcttgccgtcctcgcccagcacgtcggcggtgaaggcgtcggtgtatttgcggcccaactggaagatgtgggcgacctcgatgccgcgcgcggacaccagcggcccggcgccgtccggcgacgggtcgccgtcgcgcacctcggcggcctcgatggtgccgtcggcggtgaagtcccggcccgcgaccagcccgacgacatggcggcccggttcgtcggccccggtgatccagctggtgccgtccaccacccgcggatcgaccaggtaacgaactccgttgtccttcaacgctttcggaccgatgtaacccttcaccaggaacgggtacctggcgaagtcggcgtcgtcgagcagcacgtactcggccggctccagcgccgcgcccagccgcttgtcgtcgacctcacggtcgccgggcaggccgatggccagcagctcccagtccccgccgggctggcgcaccttgagcaggacgttcttcaacgtgtcggccgcggtgacggcgcggcccaggcccgcccggttggcccagtcgaccagggtggcgatggtcggggtgtcaccggtgtcgtggaccaccgcctcgggcagaccctcgacgggttgcgggtccgggcgggcggtgatcaccgcctcgacgttggccgcatagccggactccaggcagcgcacgaaggtgtcctcgccgaccgggctctcggccaggaactcctcggaggcgctgccgcccatggcgcccgacaccgcggacacgatcacgtagcgcacctgcagccgcgcgaagatgcgctgataggcctcccggtgtgcgtgataggcggccttgagcccggcgtcgtcgatgtcgaacgagtaggagtccttcatcacgaactcgcgcacccgcaggatgcctgcccgtggccgcgcctcgtcgcggtatttgttctggatctgatacagcagcaccggaaagtctttgtaggagctgtattcacccttgacggtcagggtgaacagctcctcgtgggtgggccccagcaggtagtcgttgccgcggcggtcctgcagccgaaaaacgctgtcgccgtactcggtccaccggttcgtcgcctcgtacggcgcgcgcggcagcagggcgggaaacaggatctcttggccgccaatcgcattcatctcctcgcggacgatgtgctcgatccggcgcagcacccgcagccccagcgggagccagctgtacagcccgggcgcgacgggccggatgtatccggcccggatcagcagcttgtggctgggcacttcggcgtcggcggggtcgtcgcgcagggtgcgcaggaacagctgggacatccgggtgatcacagcgggctagcctagcctggcgaccgggtcgccctcaccggcgcgtgtgcgccggcgtcagaacagcgtgccgcagtagggcgcccgttgcgtggtgaacgcggcgtccaggtcgagcagcgcaccgctgcgcagttcggtgatgcggtcggcctggtgaagttcccaggcgcgatgcgcacccatgtagatcgatcccagatcgcccagaccgatcttgatgtcggcgggcccgtcgtgcggcgtgcaggttccgacgccgtcgcggatccgcagcaggaaccggccgccggccaccccgagcgggtcggtgacatccagcaccaaatccgcgtcggcgcggtaggcccgtttcggaagcacctcgggcacattcatgatccgcatccacagaaagtcgttgaccttcgtggtctgggcggcgagctggtccttcagcttgagcgggagcgggtcgtcgaccggcgtctcgatgacgctgttgtcgaacatcttcaggctcagcagggtcgcgagcaggtcggtgtgcgcctcgggggtgatcgggcagaaatcctggacgatcaggttgccgaagggccggcggaacgcgtgcggtgacgcgccgatcacccggtaggtcatgaagccgtccgggtgcacgacgtagttcagcattgatccgttgtcgcgctgggtcacccggtcctccaggacgtcggcccaccaggcacggctgcggctcagcgccccgggcgtcaccgcgcaccatcggtcgtagaggtcgggcagcagcccccgcgcctcgtcggcctcgacgacgcgcgcccggttccgctcgggcttggcgcgcaggtcggtgaagcgcggctcgatgttgtaggtgcgggcgtagctggccactccggcgcccaggatctcatacaccgtgggctgggtcggaacgccgcacaggatcggatagttgcgttcctgcaggatgccgaagccgcggatgctgagctgctgccagacgcctcgccccagatgcgttgcggcaacggcgatcatcgccagccaggccgccttcagcgtgacgccgcccggcacggtgagccgcagcttgtagcacaacgaggtaccgaccacggtcggccgcgccggatcggagacgtcctcggcgaccaggatgtcttccaggtcgacgcggcgtttccaggcttcgacgtcggccgggtccaccgaaaccccgtaggcgcccgcctgattcgcgtagaccgcctgccagtcgtcctcggtggcgaatctgatcctgatcgtgtcgtcggtggtgtccatcctcgtcccatcgcgtcggcgggcatgcatcgggcgacacttcggttcgtggaggcttcgtggagctgcgctgggggtcactgggggctcgttgagccgaaggcaccgcttgatgcactaccccgccggacacccggccaatcaccggccgacgaaaatcacggaactggttgcgccgcaaccactgggccgggtcagagctccccggcgtccatcgcttccttgacctcctgggcgtgcgcgacctgctcgggtgtgtagccgatgaacagcgccgcggcacccacgatgacggccgccccggcgacccacagcagcccgtaggtgtagccgtggtcgagcgcctgcaactgggcgtcgttcatggtcttcaccgggccggtggtgccgcccagatacagtgtgcgcgaggtgatcacggcctggatgacggccagcaccagcggtccgcccaggctctgcagcatcagcgtgaccgcggataccgggccgatctggtcgaaacccacgccggcgatggccgacagggtcagcgggacgacggccatgccgatgccgatgccgcccaccacgatgggcagtaccaggttcgggaaatagggaacgccgcggtgcatgcaccaccagccgtagagcatggcgagcaccagcaggtagccgccggcgatagtcagcacccgcggcgagaaccgcgccaccagttgcgaggagacgcccagaccgatgcccatcgcgatgacgaacgggatgaagcccaccccggcgcgcagcgcgctgtagccgaggatgtcctgcacgtacaggccgatgcacacggtcagggtgaacatgacgccgccggccaagaagatcgcgatgaaggtgaccagccggttgcggtcgcggaacaggtcgaacggcaccaccgggttttccgccgtgcgctccacgatgacgaaggccagggcggcgcccagcgcgaccacaccggagctgatggtggtcagcgagatccagcccttctccgggcccatcgagaaggcgaacacggcggcggtgcaggccagggtggccagcacggcgccggtggcgtccagtttcatccgctcgcggttggtctcgcgcagcgcggtgcgggccaggtacatcatcaccagcccgatcggcacgttcaccaaaaacgccagccgccaggacacctcggtcagcgccccgccgaccaccaggcccatcaccgagccgaccgccgtcatcgcggcgaacaccgccgtcgcgaagttacgggcgggccccttggggaaggtggtggcgaccagcgccaggcccgtcggtgaggcgatggccgacccgaccccctgcgagagccgggcgatcaccatggtcgcctcgtcccaggcgaccgcgcacagcaccgaggagatggtgaacagcgcgacgccgacgatgaaggtgcgtttgcgcccgatggtgtcgccgagccggccgccgagcagcatcagcccgccgaacgtcagcacgtaggcggtgatcacccagctgcggccggcgtcggagagactgagctcgttctggatccggggcagcgcgacgatcgccacggtgctgtccatcgtggccaacagctgcatgccgccgatggcgatgacggcggcgatgaagcggcgcgacggcagccacgccgggtagtacttgctcgtccgctttacggcggtctccgccgcgggcttgggggcggtctccgccggcggcgtgctgcgcaccggggccggacgatcggggcgtgcagatgtccagttctggaccgcgcgctctgagtcgttgagagccgtcataaagggttaccttacagtaatcttaagaaccgtttaaaccccgaaagccgccaccgcgccgatcacgatgatcgcgggaggtcggataccttcggcacgaatcttttcgggcgtgtcggccagggtggcccgcaaagtgtgttgcgccgccgtcgtcccgtgctgaaccaccagcaccggcgtatccgctggtcgtccgccctttagcagggcctcggcgaaaagttcgatacgttcgaccgccatcagcaaaacaattgtgccggtcaatgcggccagtgcatcccaattcactaacgattcgggatgaccgggtgggagatgcccgctgaccaccacgaattcgtgatttaccgcccgatgggtgaccgggacgcccgccaatgcgggcactcctatggcactcgtcacacccgggacgacggtgaccggaatcccagcgtcggcgcacgccagcacctcctcgtagccgcgggcgaagacgaacgggtccccgcctttgaggcgcaccacgaagcttccggcgcgggcgcgttcgatcatgacgtcgttgatggcgtcctgggccatggcccggccgtagggaatcttggcggcgtcgatcacctccacgtgcgggggcagctcggcgagcagttcgggcggggcgagccggtcggccaccacgacgtcggcctgggccagcagccgccggccgcgcaccgtgatcagttcggggtcgccggggccgccgccgatcagcgccaccccgcccttgacggcgtcggagcccaccgggccttccggcgtgatgaccccggtctgcagcgcctcccggatggccgagcggatcgccgccgagcggcggtgctcgccgccggccagcacgcccaccgacaacccggcatagctgaaagacgctggggtgaccgcggtccccgccacggcgacgtccgcccggacgcagaagatgcggcggcgttcggcctcggcgaccacggcctcgttgacccgcgggtcgtcggtggccgcgatcgcgtaccaggcgccgtcgaggtcgccgtcgcggtattcgcgcaattgcagggtgattccggtcatcgcctcgaccgatcgggtggcgctgcgggagatgacgtggacgtccgcgccgctggcgatcagcaacggcagccggcgctgggcgacggtgccgccgccgaccacgaccaccttcttgccggtcagccgcagccccaccaggtaggcgctctcggtcacccggcaagcctagtggttgccggggtgggcccgcgtcctgcccgggtcggcgcgagcggccagcgcgcacccgacgaagcgggccaccgccgcgggcgcggcggcggggtgggtgtgcagatacgacgcgtgcacaccgccgcgcaccgcgccgtcgcgatggccggactcctgggttcggtacatccacgccggcgggtagtcgtcgctgaatgtcactgtggtgcggtggaattcgtggcccaccgcccgctggccggcggcgtacagcggggagtcgacgacggccacggcatcgcgataggccagcgtcagctgcggggtgaaccgggcctgcccggccagcaccccgcacatggggtggccgtcgagttcggacaccaagtagagcagcccggcgcactcggcgtggacgggcgccccggcggcggccagctcgttgatctggcggcgcacgacctcgttggccgacagctcggcggtgaactgttcgggaaaaccgccgggcagcaacagcgcgtcggtgccgtcgggcaacgcgtcgacgagcgggtcgaattcggccacccgggcgccggcggcggccagcagctccgcgtgctcggcgtagccgaagctgaacgccttcccggtggccaccgcgacggtggcccgctcaccgccgcacccgccgggatcccccaccgccgccgccggatcccagggcgtcgtgacgggccgggcggcggcgaccgccgccaccgccgccaggtcgacgtggcgtgccaccagcgcggtcatcgcctcgaccgcgagccgggcgcggcgcccatactcgaccgccgtgaccaagcccaagtaccttgttggcaactctaattcggcgctgcgcgggatggcgcccagcaccggcacgccggcctgttcggacgcctgacgcagcacctgctcgtgacgggccgacccgacccggttcaggatcaccccggcgacccgggtcgcggcgtcgaacgtcgagaagccgtgcagcagggccgcgatgctctggctctggccgcgcgcgtcgacgaccagcacgacgggcgcgcccagcagcgcggcgacgtgcgcggtggatcccgccgccgggctggcgccggacggcccgatccgcccgtcgaacagccccatcacgccctcgacgacggcgatgtcggcgccggcggcgccgtgcgcgtacagcgggccaatcaggttctcccccaccaacaccgggtcgaggttgcggcccggccggccggcggtcaggccgtgatagccgggatcgatgaagtccggccccaccttgaacgccgccacccggcggcccgccccgcgcagggccccgatcaaacccgttgccaccgtggtctttccgctgccggaggcgggcgccgcgacgaccaccgcgggcacgttcaccactcgatgcccttctgccccttgcgcccggcgtccatcgggtgcttcaccttggccatctcggtgaccaggtcggccgcatcgatgagccgttgcggggcgtcgcgtccggtgatcaccacgtgctggtgtccgggccgccccgccaacacggacaccacctcgtcgacgtccacccagccccatttcagcggataggtgaactcgtccagcacgtagaagtcgtgccgggcggccgccagccggccggcgatctcggcccagccgtcggccgcggccgccgcgtgatcgtcgtcgctgcccgccttgcgtgtccaggaccagccggcgcccatcttgtgccactccaccggcgcgccgatccgctgttcctcgtgcaggcggccgagtgcggcgaacgccgcctcctcgcccaccttccacttggcgctcttgacgaactggaacaccgccacggaaagcccggcgttccacgcccgcaacgccattccgaacgcggccgtcgacttccccttgccggcgccggtgtgcaccgccagcaccggggtgtgccggcgggcccgggtggtcaggccgtcgtcgggaacttgaagcggaacaccttgtggcataagcggttaccctttctgctcgccccggctcaggcggcgtcgcgcaccgcacgcgtcagcgaatccgcatgcaactgctccagccgcaccgccggggcgcccagctggcgtgccaggtgttcggccaggcccagccgcacatacgacgtttcgcagtccaccaccaccgcggccgcgccctcggcgaccagccgggccgcggcgatccggctgcggcccaacggatccgggccggcggtggcccggccgtcggtgagcaccaccacgagggcgcggcgcgcccggtcgcgggccttctcccggacgatcagctcgcgcgcggccagcagcccttcggccagcggcgtcttgccgccggtgtcgaagcgggccagccgccgcccggcgatgtgcgccgaggaggtgggcggcaacagcagccgcgcctgctgttgccggaacgtgatcacggcgaccttgtcgcggcgctgataggcgtcgcgcagcagcgacagcgtggcaccgctgaccgccgccatccggtcccgcgccgccatcgatccggaggcgtcgacgacgaagatcaccagattgccttcgcgaccctcgcgcacggcccgtcgcacatcgtcgggccccggccgcagcggcccggcaccggcccgttcggcggccgagagcagggtggcgaacaggtgcagcccgtggccgccgcagccggtgtcggcgccgtcggtggctgcgatgacgctgccgctggcgttgcgggcccgcgaccgccggccgggtgccccttcgccgacaccggggacccgcagcgcgcgggtgcgaaacgtcttcgacggcggcgcactcggtttcgtcgtcggcggccgcggcttggcgtcctgcgccgaatcccgttgcggcggttgctgttctgtctcgccggcctggcctccgccgggcgggtcgggatccgggtcgggctcggagccggcctgggccagggcctcgtccagttgctcgcggtcgatgcccgggtcgtcgaagggatcgcggcggcggcggtgcggcagggccagctcggcggccacccggatgtcctgctcctcgacggtgggcgcgccgcgccaggccgcgtgcgcgaccgcggcgcgggccaccaccagatcggcccgcatgccgtccacgtcgaacgccgcgcacagcgccgcgatgcgctgtaactcggtgtcgggcaacaccacgtcgtcgaccagggcgcgcgccgcggcgatgcgccgggccagctcggcgtcggcgtcggcgtagcgttcggcgaaaccgtccgggtcggcctcataggccatccgctgccggatcacctgcgcccgcacctccacgtcacgcgaggcatgcacgtcgacggtgagcccgaaccggtccagcagctgcggacgcagttcgccctcttcgggattcatggtgccgatcaacacgaaccgggcgtcatgcgaatgcgagatgccgtcgcgttcgatgtgcacccgtcccatcgccgcggcgtcgagcaacacgtcgacgagatgatcgtgcagcaggttgacctcgtcgacgtagagcacaccgccgtgcgcgcgggccagcagccccggggagaacgcgtgctcgccgtcgcgcagcacccgctgcaggtccagcgagccgatcacccggtcttcggttgcgccgagcggcatttcgaccaggttcgcgtcgctgccggtggcggcggacagcagggccgccaggccgcgcacggccgtcgacttggcggtgcccttctcgccgcggatgagcgcgccgccgatctccgggcgcacggcgcacagcagcagggccagccgcagccggtcgtgcccgacgatggcgctgaacgggtagggcttcacggcttttccgccaatcccgagccgggtcgcagcatgggcacgtgcgggacgccgtcgtcgaggaaatcgtcgccgtcgcggacgaatccgtgctgggcgtacatgtcggccaggtaggtctgggcgttgatccggcacgggtagtcgcccacctcggccagcgccgcgcgcagcagccgggtggtgtggccctggccgcgggcgctgcgtttggtgcacagccgcccgatccggaacgccttctcgccgccggcgtgctcctccatcagccgcagcgtgcagatcacctcgccgtcggaggtttccagccagaagtgccgggtttcggcgagcaggtcgcgcccgtccaactccggatacgggatggcctgctcgacgacgaacacctcaacccgcagcttgagcagctcgtaaagcgtttgggcatcaaggtctttggcccacgtgcgtcgcaatgcttctgtcatctgcgccgctcctcctcatcgctgcgctctgcatcgtcgtcggcgcgagtcatctgcgccgctcctcctcatcgctgcgctctgcatcgtcgtcggcgcgagtcatctgcgccgctcctcctcatcgctgcgctctgcatcgtcgtcggcgcgtgtcacttagggcgctcctcatccaactcgtccagtcccaggatcttcgttccccatgaatagacttcctcatacagcgccggctcgtcggacagcgtcacgcccagcgagggaaccatctccttgagcgcgggcagccacgaccgataacggtcagcgaaacagcgctgcagcacatcgagcatgatcggcaccgccgtcgacgctcccggcgagccgccgagcaaccccgcgatgctgccgtcgccggccgccaccacggtggtgtcgaagtcgagcacgccgccgcggcgccgatcgcgccggatcacctgcacccgctgaccggccaccgtcagctcccagtccgaatccactgcggtgggcgcgaattcgcgcagcatccgcatccggtccggcgcggacagccgcaactggccgatcaggtaccgcagcaacgtcagctgggtgacgccgacgccgagcagcgcgaccagattgtgcggccgcaccgagcggggcagatcggtgaagtgcccgtgtttcaagaacttcggcgaccagccggcatacggcccgaacaccagccacggcttgccgttgacgtagcgcaggtccagatgcaacgctcccagcggcggggcccccggcgctggagccccgtacaccttggcccggtgcgcctcggtaagcacgggattgtcggcgcgcaggaaccgaccgccgatcgggaaccccgcgaatccgcgagcctcgccgatacccgacttctgcagcagcggcagcgcgtcaccgccggccccgaccaacacgaatttggcgttgcaccagtgcttttcgccggtccggcggttgcggatcagcaacgtccagctgccgtcggactcccgcgtcaggttgtgcacctgatggccgaacagcgccgtcgcgccgccgcgcacgcagaacccgatcagctgtcgcgacagcgcgccgaagtcgacgtcggtgccgtggcgcgcccaattcagcgcggtcggttcggagaagtcccgccggtcggccatcaacggcagccggcgggcgaactcgtcggcgtcctcgatcaattcgatgccggcgaacaacgggttgggcgccagcgcctgctgccggcgccgcagatactcgacggcccgcgccccgcgcacgaaactcgcgtgcgggatcggggtcacgaagccccgatcggtcagcatgccgttctccacggcatacgcccagaattggcgggtcacctggaactgctcgttgatgcgcaccgctttggcgatgtcgatggagccgtcggcgcgctgcggggtgtagttgagctcgcacagcgccgaatgcccggtgccggcgttgttccacgggctgctgctctcagcggcgaccgcgtccaggcgctcgacgaaggtcatcgaccaatccggctgcagccgccgcagcaacgcgcccagcgtggcgctcatgatgcccgcgcccaccagcacgacgtccgcgcgggtggtcctggctagcgatgacaccggcttgttggtccttttcctcgaggcatgccgatcctcaggttatccggtggcaaagcgacgcgaaccacgcgcggggtcgccgcggccggcaaaagctctaagctggcggggtgactggcggggcggctggctgggtgcccgacgtgctacccggctattggcagcgcaccctggcgctgggcgccgatccggccggcgagggcgacatcgtcgcgaccctgatccggcgcggggacgacgcggcgccggccgccgatcacgcggtgctggcggtgcacgggtataccgactacttcttccacaccgcgctggccgatcacttcgccgcgcgcggtttcgccttctacgcgctggacctgcacaagtgcggccggtcgcggcgtgacgggcagacgccgcacttcgtcaccgacctggccaactacgacaccgaactggaacgcgcgctgagcgtggcgagcgggggaaaccgcagggtgctggtgtacgggcattcggccggcgggctgatcgtgtcgttgtggctggaccggctgcggcgccgaaatcccgtcgcgcactccgcagttggcggtctggtgctcaacagcccgttcctggagctgcccggcccgcccatcctgcggcactcgctgaccgtggcgctgatcgccggcctgtcccgggtgcgttccaagggggtggcccggtccccggtgcagggtggctacggcaccacgctgcaccgcgactacggcggggaattcgactacaacctgcagtggaaacccgttggcggctttccgatcacgttcggttggctgcacgcagtgcgccgcggtcaggcccgactgcaccgcggtctcgacgtcggggtgccgaacctgatcctgcgctcggaccacagcgtgcaggagacgcccgacccggcatccatgcaccgcggtgacgcggtgctcgacgtcacccagatcgcccgctgggcgggctgtatcggcaaccgcagcaccatcattccggtcgccgacgccaaacacgacgtgttcttgtcgttgccggggccccgcgcggcggcctatcgtcaactggatctgtggctggacggctacctgcgcgaccggagcaccgatagcacccgggccccggcgtcccgggacgaagggtgaggcgccgaacatggaaacctacgacctcgcgatcatcggaaccggttcgggcaacagccttctcgatgcccgcttcgccggcaagcggaccgccatctgcgagcacggcaccttcggcggaacctgcctcaacgtcgggtgcatccccaccaagatgttcgtctacgccgccgacgtcgccacgacgatccgggaggcggcccgctacggcgtcgacacgcacctcgacggggtgcgctggcccgacatcgtctcccgcgtcttcggccgcatcgacccgatcgcgctcagcggcgaagagtatcggcgctcctcggtcaatatcgacctgtaccgcagccacacccggttcgggccggtgcaattcgacggccgttacctgttgcgcaccgacgccggcgaacagttcaccgccgagcaggtggtgatcgccgccgggtcgcggccggtgattccccccgcgatcctcgagagcggcgtcacctaccacaccagcgacaccatcatgcgcatccccgcgctgcccgagcatctggtgatcgtcggaagtggcttcgtggcagccgaattcgcccacatcttctccgcgctgggggtgcacgtgaccgtggtgatccgcagcggccgcatgctgcgccagtacgacgacatgatctgcgagcggttcacccggctggccgcggccaaatgggaactgcgcacccagcgcaacgtggtgggcggcagcaaccgcggctccggcgtcacgctgcgcctggacgacggatccacgctggacgccgacgtgctgctggtggccaccggccggatatccaacgccgatctgctcgacgccgggcaggccggcgtcgacgtggagaacggtcgcgtggtggtcgacgagtaccaacgcacttcggcccgaggggttttcgcgctcggtgacgtatcgtcgccgtatcagctcaagcacgtcgccaaccacgaggcccgggtggtgcggcacaacctgctctgcgactgggacgacaccgagtcgatggccgtcaccgaccaccgctatgttccgtcggcggtgttcaccgatccccagctggccaccgtggggctgaccgaaaaccaggcgatagcacggggattcgacatctcggtggcgatccagaactacggcgacgtcgcctacgggtgggcgatggaagacaccaccggggtggtcaagctgatcgccgagcgcaccagcggtcggctgctgggcgcgcacatcatgggccctcaggcgtcctcgatcatccagccgctgatccaggcgatgagcttcgggctgaccgccgcgcagatggcccgcggccagtactggattcacccggcgctgcccgaggtcgtcgagaacgcgctgctgggcctgtactgatttcgcgggcacgggccgtgtgcccgccttgcgtccggcaagacgcggaacttacagtcgtgcccgttgccctgtgcccgacaccgcccgcgccggaaggacccccgtgaccagtacggagatcgaccggtggccggcacgggcgaccaggtttctcggcgcgctggcgccgacggaatggtggcggctggcgtcgatgctgggcgccatcctcgcgctgcacctgatcggctggttgaccttggtgctgttggtggccccggggcaatacagcttgggcggcaaggcatttggcgtcggtgtcggattgacggcctacaccctgggtctgcggcacgccttcgacgccgaccacatcgccgcgatcgacaacaccacccgcaagctgatgaacgacgggcagcgcccgctggccgtcggcttcttcttctcgctgggccattccacggtggtgttcgcgctggcggtgctgctggcctgcggggtgaggacggtggtggggccggtgcgcgacgactcgtcggcgctgcaccactacaccgggctgatcggcaccagcgtctcgggcgtgttcctctatgcgatcgccctgctcaacgtcgtcgtcctggtcggcatcctgcgcgtcctcgcgcgagtgcgccggggtgactacgacccgcacaccgacgccgcggaattggagcggcagctggacaaccgggggctgatgaaccggtggctgggccggttcaccaagtcgatcacccagtcctggcactgctatccggtcggcctgctgttcgggctcggtttcgacaccgccaccgaggtcgcgctgctggtgctggccggcaccagcgcggcggccgggctgccctggtacgccatcctgtgcctgccggtgctgttcgcggccggcatgtgcctgctggacaccatcgacggctcgttcatgaacttcgcctacggctgggcgttttccaacccggtgcgcaagatctactacaacatcatcatcaccgcgctgtcggtggcggtcgcgtgggtgatcggcagcatcgagctgctcgtcctgttcgccgacgaattcggttggcggggctcgttctgggactggctcggcgggctggacctgaacacggtcggttacgccgtcgtcggcatgttcgtcctcacctgggcggtggccctgctgatctggcggtacggacgcatcgaagagaggtgggccggcgccgatccgcgcgccgggaccggccgagaagcctgaaccgcgccctgacggtcgggccgccccgggcccgaccgccgactggcgcgcgtgtgggccggacgccagactggccgggtgcccggttcgctgcgcgacgtgctgcccgccgcggccgccctgctcggcgtcgcagatgcggggcacgagccgggcgggtcggccgtgaccgactgggtcggcgccgagcgggtggaccgggtgctggtgctgctggtcgatgggctgggctggcagctgctcgcccagctggccggcgacgccccgctgctcgccgcggtgcgggccggcgaggtcggccggctgacccggctggattgcaccttcccgtcgaccaccccgaccagcctggtgtcgctggccaccggcgcggcgcccggccagcacgggatcctgggcttcacgctgcgggtgccgggcaccgaccgggtgctcaaccacgtccggtggcgcgacgacccggcgccggacgcctggcagccgctgcccacctggttcgagcggctcgccgccgccggtgtccgcgcccgcgccgtgctgccgtcgtcgtttctgggcagtggcctgaccgaggccgcctaccgcggcgcccggctggtgccggccgagcccgccgacgactacccgcggctggtcggcgaggagctgcgggcgggccccgggctggtgtacggctacaccgcggagctggacaccgcggcccacctgttcgggatcggctcgccgcagtggcacaccgcggcggcggccgtcgacgccctgctgtccggcctgctcgaggcgctgccgccgaatgccgcgctgctggtgaccgccgaccacggcggcctcaacgtcccgcccgaggcccgcgtcgacctggacagcgacccgcggctggccgcgggcatccgcgtggtggccggcgagccgcgggtgcggtacctgcacaccgagccgggcgccgcgcccgacgtgcaggccgcgtggtcggagctgctcgacggccgggccgccgtgtacagccgcgtgcaggcggtggccaccggcatgttcggcccggtcgccgaccggcacctgccgcggctcggcgacgtggtggtggtctgttccggggacaccgcggtgctggccagcgcccacgagccgccggagacggcgcgcctggtcggcttccacggcgcggccacgccggccgagacggcgatcccgctgatgctgttccgccggtagcgcccggcggccgtgccacaccggactccgaccgagttcacagctggttccgaccgtcgcgcgggtttcccgcgctacattcgatgcactgtgatcttgcgaggcggcgacgaaacgcggcgatggcggccggccatcgcggttgccgcagcgctcggggtgttcatcgcgctggtcgcggggtcggcgttgcggcccgcgtgcgccgcggccgccctgcccgagccgccggcctggacggccccgaccgtggcgcgggttgccgggcgcccgtcgacgatcagccgggccgccccggccacctcgcggtctgcggcaccggcgaacaacaccaacaagaagccgttccacagcacgtggatgaccaaggagcggccgctcagctggaaccgcctgtcgccgcacgcggttctgtcaccgatgccgatatccttcagcccgttgggttttgccccgcgaggggcccaatcccgcgcgcccgcaacctttctgcccgaccgggatgtcttgacactgttcggcgtggcccgacgctgatcgacgcgcggccggacccggggtccggcccaggacgtgtaacccccgtgtctatctgttgaaggaagccccatggtttcgggtaccgctcacaccggcgcagtcaggcagtggccgtaatggatttcgcaacgcttcccccggaagtcagctccgggctgatgcattcgggcccgggcgccggatcgctgatcagggccgccgcggcgtgggacgggctggcccgccaactgcgcgccgccgcgaccagctaccgggcggcgaccgccgccctgggcgacgcggccgcccgctacatcgactggctcggcggcaacgccgcgcgcggcgagcaggccgccgaggggctcaccgcggccgccgacgcgcaccggtcggcctgcgcggcgatggtgcccccgccggtgatcgccggcaaccgcacgcaccggctggcgctggtgtcggcgaactgcctgggccagcacagcccggcgatcgccgaggtggacgccgactacgagcggatgtgggcgcgcaacgccgccgccatgtacgcctacgccgacgcctcggccgccgcggtgacgctgaccccgttcaccgcgccgccgggagactgcggggcggcgacccgaagctgggcgttgaccgccgcacccgagctgatctcggccggcggccaggtgatggcggccattcccgacgccctggaacagctgtcggcggcgccgctgcgcacgctggacgcggccatgtccgccgtcacgccggcactgtcgaaactgaattcgctgaccgcgccctcggatctggcgatcggccacctcaattcgatgaacaaggcggcggcgctgcagacgctgttccccgggccggccgccgcgccccgggtgtgcgcggtcgtcggtcgcgcgatgacggtcggcgtgctgtcggcgccgccgggcgcggccgcgctcgccccgctggcgcggcagccgcgcccggaccgggcgggcgagcacatccggctggtgccgcccggcgagccggcgggcccgcacgcggccggcgagtccggcggttagagcggggtcacgtacgccgcgctgatgccgccgtcgaccaagaacgtggacgcggtgatgaaggacgcgtcatcgctggccaagaatgctgccgcagcggcgatttcgccaggttcggcgaagcggccgaccggcacgtgcaccagccggcgggcggcgcgctgcgggtctttggcgaacagctcctgcagcagcggggtgttgaccggcccggggcacagcgcgttcacccggatgccctgccgggcgaactgcaccccgagttcccgcgacagggccagtaccccgcccttggcggcggtgtaggagatctgcgacgtcgccgagcccatcaccgcgacgaacgacgccgtgttgatgatcgacccgcgtcgcgcggaaaccatgtgccgcaatgccgcccggcagcacagatacaccgacttcaggttgacgtcctggacgcgttgccaggccggcggttcggtgttctcgatgacgtcgtcgtcggggggtgagatgccggcgttgttgaacgcgatgtcgatgcgcccgtagcggcgcgccgcggtgtcgaacagcgcgttgaccgcgtcctcgtcggcgacgtcggtcggcacgaacaggccggacagttcgtcggcggccgccgccccggcgtcggcgtcgatgtcggccaccacgatggtggcgccttcggcgtgcatccggcgcgccgcggccagcccgatcccgccgccggcgccggtgatgaccgccacccggcccgccaaccgttgcgtcaggtccatcacggctcctcgtcgatcgcgatgaaaacgttcttggtctcggtgaactgcgccggggcgtccggtcccagttcgcggcccagccccgactgtttgaacccgccgaacggggtgtggtagcgaaccgacgaatgcgaattcaccgacaggttcccggcttccaccgcccgggacacccgcagcgcccgggacagatcgttggtccagatcgacccggacaggccgtagctggtgtcgttggccagcgcgacggcgtcctgctcgtcgtcgaaggccagcaccgtgaccaccgggccgaagatctcctcggtgacgcagcggtcggtgcgggacggggtcagaaccgttgggggaaaccagaatccaggcccggtcggcgccgtgccgcgaaaggcgaccggggctccgtcgggcacgtaggacgccaccttggcgcggtgcgcggccgacaccagcggccccatctgggtgtcgcgggacgccggatcgccgaccacgatgccggtgacggcgggctcgagcagctccatgaaccggtcaaagacggtgcgctgcaccaggattcgactgcgggcgcagcagtcctgcccggcgttgtcgaacaccccggccggcgcagtcgcggcggcccgctgcagatcgcagtcggcgaacacgatgttggcgctcttgccgcccagctccagggtcacccgcttcacctgggcggccgcgccggccagcaccttcttgccgacctcggtggagccggtgaacacgatcttgcgaacgtcggggtgcgtgacgaaccgctccccgaccaccgtccccggtccgggcagcacctgcagcaggtcgcggtccagcccggcctgcaccgccagctcggcgagccggatggtggtcaccggcgtcggctcggcgggtttgaccagcacggcgttgccggcggccagggcgggcgcgatgccccaggacgcaatcggcatcgggaagttccacggggtgatcacaccgaccacgccgagcggctcgtggaacgtgacgtccagcccgccggcgacgggaatctgcttgccggacaagcgttccgggctgcccgcgtagaacgtcagcacgtcgcggacctggccggcctcccactcggccgaggcgatggggtgcccggagttggcgacctcgagggcggccagttcgtcgcggtgggcgtcgacggcggcggcgaaggcccgcagcccggcggcccggtcggccggggcgagccgggcccaccgccgctgggccgcccgcgcccggtccaccgcgtcgtcgacggcggcggcgtcggcgtgctcgaccgatcgcagcacctcctcggtggccgggttgatcagtcgcgcggtactcaacgggcgaccccggcgtacgaccgggcggcgtccacgatcgcggtgaacagccgcaggtcctgcagggactgttccggatgccattgcacggcaagcacaaacgcgtcaccgggcagctccaccgcctccaccacaccgtcgggatcccacgcgctgaccaccagcccgtcgcccaccttgtcgatcgcctgatggtgatagcacggcgcatcgaccgtctcgcccagcagcgcggccagccgggtgcccgcgacggtgcgcaccggcagcgtgctgaacaccccgttgccggcccggtgcccgccgtgcccgagcacgtcgggcaggtgctggtgcagggtgccgccgaacgcgacgttgagcacctgcgcgccgcggcagatgcccagcaccggcagcccgcgctgcagcgcgccccgcagcagcgcgaattcccaagcgtcgcggtcggtccggggtgcatcggtgctcgggtgcggccgctggccgtagccggcggggtcgaggtcgtaaccgccggtgatcaccagggcgtgcaggccgtccagcaaggagccgacgatcccggtgtccatcggctgcggcggcagcagcacggcgatccccccggcccgggtgacgccctcgaagtagtcggcgggcaggtacccggcggggatgtcccagatcccggtctgcacccgttccagatacgccgtcaggcccaccaccggccgccgcggcggatcgcccccaaggggctcagagccgttcaaaaccacgcatcctctcccaatcggtggccgcggcgtgaaacgccgccagctcgacccgggcgttgttcaggtagtgcgcgacgacgtcgtcgccgaacacctgccgcgccagcgccgagtgctcgaacagcgccgccgcctcggccagggtgcccggcagccggccgacgccgcgggcgcggtaggcgttgcccgcgcagggttccggcagcgccaggccctgctcgataccgtacagcccgccggcgacgatcgccgccaccgccagatacgggttgacatcgccgccgggaacccggcactcgacgcgggtgtgcgcgccgtggccgaccacccgcagcgcgcaggtgcggttgtccaatccccaggccagcgcggtgggcgcgaaactctcatcggcgaatcgcttgtaggagttgatgttcggcgcgtagaacagcgtgaagtctgccatggtggccagcaggccggccaggaagctgcagaacatcgtcgacatgccgtgcgggcggctggggtcggcgaacgccgccccgccctgggcgtcgcgcagcgaaaggtgaacgcggcagctgttgccttcgcgctcatcgtatttcgccatgaatgtcaggctcttgccgtgctgatcggcgatctccttggccccgttcttgtagatgacgtggttgtcgcaggtccgcagcgcctcgtcgtagcggaagccgatctcctgctggccgcggttgcattcacccttcacggactcgaatcgcagtcccgcaccggccattccgcgccggatgtcgcgcagcagcggctccatgcgcgacgacgccgagatcgcgtagtcgatgttgtagtcactggccggggtcagcccgcggtagccgctggcccacgcctggcggtacggctcgtcgaacaccatgaattccagctccgtcgcggcgtcggcgaacagcccccgcccggccagccggtcgagctggcggcgcagcacggcccgcggcgacaccgcgaccgggctgccgtcggcccccaccacgtcggcgatcaccagcgccgtcccgggcagccagggaatgcggcgcagggtggacaggtccgggcgcatcaccaggtcgccgtacccggtgtcccagcccgagatcgcatagccgcccacggtgttcatgtcgacgtcgacggccagcaggtagccgcaacactcgaccccggtggcggccgcctcgtcgacgaacagccgcgcgtccatccgcttgccgaccagccggccctgcatgtcggggaaggccacgatgacggtgtccacccgcgtttccggcgcgccggcggccaccagtcggtccagcgcggcgagcgagagcatcgcggtatcggaaccggtcagcgcgctgtcttcactggccatgaccgtcgcgggctaccaggtgctggtgcgcagaatgatctcggcggccagttgcgccgtcgactcctgcaccgtgcgccgccccaggtgcaccacccggtagtcggcgtagacgtactgctggctggcttgggccaccgcccgggcggccggcgagctgaccaacaccgtggtgccgatctccaccggcgggcagtgcccatcgcggatggcgccgtcgcggtcggcggcccgcgggtgcccgcggtcgatcaccaccaggccgacgaaccggcccagccgggtcgccgtcaattcccaggcgagttcgccgccggcgcggtcacccatcacgacggcccagccgatgcccagcgcgtcgaggatgccgatcaccgatttgggggtgagccgcggatcgaagccgatcaccaccgtgcgcagcgacgcggtgtgcagccgttcgcagaccgcgtcgtaggccgcgggcgcgcgatcctcgtcaccgaggatgacgacgacgacgccgttctccggaccggccacaacgaccgggacaccgaacccgtccagggtggtcatcatcgaggacacccaagcacgctacagccaaacggcctgtgtgcgcgacgcttctcgagcatccgatacgcgggcgcggatttttgaccgcgccgtcaacaacggcgttcaccgtcggggtgcgcgaattccctaccggcacaaccgagttgccagccgcggccgcggcggcggaccgtccagcaacccgagcacggcgtcgacgtcgaggtgggccgccagcaggtcggcggccagatcgagttgggcgtcgcgccgcgcggcgacgtcggtgtcgccgggcacgaagcgccggccggccgcgtcggcgacccggacgagccaggcgcgccggaagtcgtcgttgtcgagcaggccgtgccagtgcgtcccgaacaccgcgccgcgcaccagaccctgcggctcggcgtccgagtcgaaccagctgtgctcggcgcagcgggagacccgcccgtggtggatctcgtagccggccagcggccgctgccagcggcgcaacgtcttggcgggatgaaaggcgatgtcggcgtccagcagacccagcccggccacctcgccggcgccggattccacccggtcgtcgatgcgtcggcacagcatctgaaatcccccgcagatgcccagcaccggcctgccggcggcggcgtgcgcggtgatcgcggcggccagtccgcgctcgcgcagccaggacaggtcggcgacggtggccttgctgcccgggatgacgaccaggtcggcgtcggcgacgtcggacggttcgctgacccagcgcaccagcaccccgggttcgcaggccagcgcctcgacgtcggtggagttggagatccggggcagccggacggcggccacccgcagccagtcgtcgcccagcggcgggtcgggcgcgccgacgacgcggtgcgccagcaccgacagcgagtcctcggcgtccagccacagccggtcggcgtacgggagcacaccgtaggtgggccggcccgtgatgtcgtgcaggcggcgcaatccgggctgcagcagcgcggggtcgccgcggaatttgttgacgacgaacccggcgatcagcgcctggtcttgcggatcgagcaccgcgaccgtgccgaacaggtgcgccagcagaccgccgcggtcgatgtcgccgaccaggatcaccgcgagatcggcggccctggccaggcccatattggctagatccgttgcacgcaggttgatttcggccggcgaacccgccccctcgcagatcaccgcatcgaattcgtcacgcaggcaagtcaattcgttcagaacgagggcggcgagccggtcgcggtgctgcacatagcttgtcgcggtgaccgattcggccacttggcccttgatcaccagctgcgaggtgcggtcgctgccaggtttgagcaggatcgggttgaaccgcacgctgggttccaggcccgccgcgcgggcctgaatcgcctgggcgcggccgatttccccgccctcgacggtgaccgccgagttgttggacatgttctgcgccttgaacggcgccacccgcaccccgcggcgggccagcaaccggcacaggccggccaccaccaccgacttcccggcgtcggagctggttccggcgaccagcagggctccgctcaccggctcacggcagcgtcaggatttccacgccggtgtcggtgaccagcagggtgtgttcgaactgggcggtccacttgcggtccttggtgaccaccgtccagccgtcgtcccagatctcgtagtccaggccgccgaggttgatcatcggttcgatggtgaacgtcatgcccggctgcatgatggtcgacaccgacggctggtcgtagtgcaagacgaccaggccgttgtggaaggtggtgccgataccgtgcccggtgaagtcgcgaaccacgttgtagccgaaccgatttgcatacgattcgatgacgcggccgatgaccgacagggcgcgcccgggcttgacggcgttgatggcgcgcatggtcgcctcccgggtgcgctcgacgagcagccggcgctcctcggcgacgtcgccggccaggaaggtggcgttggtgtcgccgtgcacgccgtcgatgtaggcggtgacgtcgatgttgacgatgtcgccgtcctcgatcaccgtcgagtccgggatgccgtggcagatcacctcgttcagcgacgtgcagcacgacttcggatagcccttgtagcccagcgtggacgggtaggcgccgtggtcgatcatgtactcgtgggcgatccggtccagttcgtcggtggtcaccccgggcgcgacggccttgcccgcctccaccagcgcgccggccgcgatccgcccggcgacccgcatcttctcgatcacctcgggggtttgcacccacggctcgctgccctcccgggcggtgggcttgcccacgtattccgggcgcggaatgcgggcgggcaccggcagagtcggcgacaacgctccgggggacagcgcggtgcgagcgggcatggtagctagcttaaccgcgccccgaccgggctcagccgctcaaccgccggcgcagcagcgagcggcggggtccccggatgaccaccgagccgcacaccacccgcccggtcagcacgacgtgcgggcggccctcaccgggcgcgtccttgcggcggtcgacggcgctgcccacatacacctcgacgtcgtcgatggaggcgctggcgccgtcgggcaaccggatctgcaccgagccgaaccgcatgtccagttcgatcaccaccaccgggccggcgaaccgggcgcgggtgaggtcgagttccaccgagcccagccggcgcaccagcgccagccgggtgggcaccgtccactcgccgtgccgcttgagcgaacccgcccagccgcgcagttccacccggtcggccgcggaggtgacgatggcgcccggcccgggcaggtcgccgaccaggtcgtccagctcgccgcgggtgcgcgcataggagacctgcgacgagcgctgctcgaattcgtcgatgtcgatcagccccagcgcgaccgcgttgtgcagccggcgcatgatgccgttgcggtcggcgtcggagacccgtagcgcgaccatctcttccccggactcgcccacgcttgcaatttaccgccgcgcgcgccctgtgagcgggcgtgttggtcaggccaaaaagtccggcggcagcgactcgaacatcaccttggtcatccggaccgcgtattccgagctgccgcccccgacgatcagcgccgcgaaggccaggtcgccgcggtagccggcgaaccacgagtgcgacccgccggggaactcggcctcaccggtcttgccgtacaccgcgccgcagccggcgatctccttggcggtcccgttggtgaccaccagccgcatcatcggccgcagcgcgtcgaccatcttcgggctgatcggggtggtgtcgccctggaccgcggtctgccggcccacgatcagctgcggcaccggcgtcttgccggcggccaccgtcgcggccaccagcgccatgccgaacgggctggccagcaccttgccctggccgaagccgtcctcggtgcgctcagccaggtccacggtcggcggcaccgagccggtgaccgtggtgatgccgtcgatctggtagtccaggccgatgccgtaccgggtggccgcctgggtcaggccgcgcggcggcatcttgctgctgagctcggcgaaggtggtgttgcaggagctggcgaacgcccgcgacatcggcaccacgcccagatcgaagccaccgtagttggggatggtgcgatgcccgatgtcgagatggccggggcagcccagcatggtgttgggggtggccatgtcgcggtcgacggccgcgccggcggtgatcatcttgaacgtcgacccgggcgggaagagtccgttggtggccggcaggccgtcggcgtcggcgccgccgttctgcgcgatcgccaggatctccccggtcgacggcttgatcaccacgatcattgccttgccgccgcgggtgtccaccgcgtgctgggccgcgttctgcaccgcccggtcgatggtgagcgacaccgacggcgccggcgacccctccacctcgtgcagcacctccacctcaacaccgttctggttgacgctgaccacccgccagcccgcctggccgtcgagctggtcgatcaccgccttcttcaccgcggcgacgacggccggcgcgaaatgcgggtcggtgggcagcatttcgggctgcggggtgaccacgatgccgggcagcctgccgatggccgggaacaccttgtcgttgtcgtcggggtgcagcgtgaccaggtccaccggctgggtcgacgagctggcctgctcggcgagcagctgcgggtcggcgagcgcgccgttgaacgggcgcagcacgtcgaccaccgcgtgcgcggtgccgaacagcgcggcgccgttgccggcctgggtggcgtccagcgtgtagtggtacaggtagcccggcaccagcacgtcgctgccgccgagttcgttgaccgaggcgcggcgcggccggtccgcgcgcaacgcgaaggtctggtgctcgccgagcttggcgtgcagcgcggtggtggtccagcgcacctcccagcggccctcgtcgcgcgccatcttcagctggccgtcgtaggtccaggtgcggttcttgggcaggtgccaggtgaagcgatagccgaccgtgccggtgtcctcggcgtacttggcgttgaggatctgcgcgtccaggtggctggcctgcagacccgaccaggccgcgttgagggcttcgcgggcctcgttggggttgtcgctgagctgggcggccgtcgcggtgtcgccgacggccagggcgcggaagaacttctccgcggccggtccgggcccgtcgggccgcggtgtgcatccggacagggcgatcaccgcgaccagcagcaagcccgaggcggatgtggccactgttcttgtagttaccatcggtgctgatgttaagaactgcggcctgaacagcggcgtcgacacaccgagaccggatcgtgatgtgccgattgcggactatctcgtccgccgagcgtcacgccagcgtgacttcggcccggggtccatcagtcgagcaggaccgtggcgaaggtgccgatctcggcgaagccgacgcgggcgtaggcggcgcgcgcgacggtgttgaagttgttgacgtagaggctggcggtgcgcccgctgccgacgatcaccgcggccaccgtcgcggtgccggcggtgcccaggcccaggccgcgccactccgggtgcacccacaccccctggatctggcccacccccggcgactgcgagccgacctcggccttgaacaccacctggccgtgctcgaaccgcgcccaggcacgcccggcggtgatcaggctggccacccgccggcggtagccgcggccgccgtcgccgatgcgcggatccacgccgacctcgccgatgaacatgtcgacggcggccaccaggtaggcgtccagctcctcgggccggacctggcgcaccgcggtgtcgatgtcgcagctgggatagctggacagcgccagcagcggctggcggtcccgcacgtcacgggccgggccccaggccgcttccagccgctcccacatcggcatcaccaggtcggcgcggcccaccagcgacgagcagcgccgcgccccgcgcatggcctcgtcggcgaacgcggtcaaatcacccggcgcgccgcgcagcgggatcaggttggcgccggcgaagcacagcgactcgtcggcgccgcgcagcgtccacagttcgccgccgatcgcgttggggtcgatgccgtggtcggccacccgggccgccaccatgcacgaggcgaccggatcgtcgtcgagcacccgccacaccgcggccgcgtcgcgcaccacggacacccgtcgctcgccgacaaggcggaacaggggtggagccgacatgctgcgaactctctgtgctgcaaactcgtggaccgacgctggcccttatcagcttacggtgacaaccggtgaaccgctggatgttgcctccggcccgccctcactgttcatctgcgcggcgatgcgcatcgcctcttcgatcagcgtctccacgatctgggattcgggcaccgtcttgatcacctcgccgcgaacgaagatctgccccttgccatttcccgacgcgacgcccaggtcggcctcgcgggcctcccccggcccgttgaccacgcagcccatcaccgcgacccgcagcggcacgtccaggccgtccaggccggcgctgacctcgttggccagcgtgtagacgtcgacctgcgcgcgcccgcacgacgggcaggacacgatctcgagcgaacgcggccgcaggttcagcgactccaggatctggatgccgaccttgacctcctcgaccggcggcgccgacagcgacacccggatggtgtcgccgataccgcgcgacagcagcgcaccgaacgcgaccgcggacttgatggtgccctgaaacgcgggcccggcctcggtgacgcccaggtgcagcgggtagtcgcactgctcggcgagttgctcgtaggcggcgaccatcaccacggggtcgttgtgcttgacgctgatcttgatgtcggaaaagccgtgctcctcgaacagcgaggcctcccacagcgcggactcgaccagcgcctcgggggtggccttgccgtacttggccatgaaccgcttgtccagcgagcccgcgttgacgccgatgcggatcggaatgcccgctgccgcagcggctttggcgacctcgcccacccggccgtcgaattccttgatgttgccggggttcacccgcaccgcggcgcagccggcgtcgatggccgcgaagatgtacttgggctggaagtggatgtcggcgatcaccgggatctggctgtgccgggcgatctcggccagcgcgtcggcgtcctcctggcgcgggcaggccacccggacgatgtcgcagccggccgcggtcagctcggcgatctgctgcagcgtcgagttcacgtcgtgggtcttggtggtgcacatcgactgcaccgagatcggatagtcgctgccgaccccgacgtcgcgcaccatcagttggcgcgtgcggcgccggggcgcaagcgtgggcgccggggtctgcggcatgcccaggcctgtcgtcacgttcgttccttcacgtcgattaccggagtcgattactggaagagcctgatcgggttgaccaggtccgcggtcaccgtcagcaacatgtagcccaccacgaacaccagcacgacgtaggtcgccggcatgagtttgaggtagttcaccggcgccgcggcgaccatgccgcgggccgaccggatcaggttgcggaccttctcgaacaccgcgatggcgatgtgcccgccgtcgaagggcagcagcggcaccaggttgatcgcgcccaggatgaggttcagctgggccaaaaagaaccagaacgccacccacagcccgtggtcgacggtgtcgccgccgatgatgctggccccgaccacgctcatcggggtctgcgggtcgcgctggccaccgccgatggcgtgcaccagcgcccccaccttggtggggatggtgaccagcgccttgcccacctcgacggtcaggtcgccggcgaacaccacgctggccgggatcgcggagaacacgccgtagtgggcgggcgcgaccttgaccgcgccgacgccgatggcgccgacggtcgagggttgcggcggggcgccctgcgggccggaccccgccgctcaggtagcgctgggtgggtgtgacgtcgacgtaggcggtgatggcggtgccgtcccggtcgacgacgatcgggacgttgccgtgcaccttgcggatggcggcggccatgtcgtcgaacgtcgacaccggggtgtcgcccaccttgacgatgacgtcgccggggcggatcccggccagcgccgccggaccgggcccggtgcagtcggcgagcttgcccggcgccacttccggtgccacacaatcggtttcgccgacgatcgccttggtcggcgggtgcaggttgggcagtccccagatcagggcgatggcgtagagcagcaccaggcagatgacgaagttcgcgccggggccggcgaacagcaccgcgacccgtttccaggtggcctgcttgaacatggcccggtcggcttcgtcgggcgccagctcctccaccgaggtcatcccggcgatgtcgcagaaaccgcccagcggaacggctttgaggccgtattcggtctcgccgcgccgcgtcgaccacagcgtggggccgaagccgacgaaatagcggcgcaccttcatgccggtggcgcgggccacccacatgtgcccgcactcgtgcagggccaccgagatcaggatggccagtgcgaacagcacaatgccgatgacgaacatcattaggctgcgaggacctttctcacaccactccgggggttttcgctgacgccgtggcgggccgtgcctgtgcgacggcacgctgcgcccgctgccgtgcccagcgctgcgcgtctagtacgtcatccacgttagcgggtgtttcgctgaatttgggcgcccattggtcggcggcgtgcagcacgtcggcgatggtttcgacgatggcgccgaaggagacccgtccggccaggaacgccgcggcggcctcctcgttggcggcgttgtagatcgcggtcatgcagccgccggcctgcccggcgtggcgggccagctcgacggcggggaagacctcgttgtccagcggctcgaattcccagctcgacgcggtggagaagtcgcagcaggcggccgccccgggcacccggtgcggccagcccagggccagcgagatcggcagccgcatgtccggcgggctggcctgggccagggtggagccgtcgacgaaggtgaccatcgaatgaacgatcgactgcgggtgcacgaccacctcgatgcggtcatacgggatgccgaacagcaggtgggtttcgatgagctccaggcccttgttgaccagcgacgccgagttcagcgtgttcatcggccccatcgaccaggtcgggtgggcgcccgcctgctcgggcgtgacgtgctcgagctcctcggccgtccagccgcggaacgggccgccggaggcggtcagcaccagcttggcgacctcgtcgccggtgccgccgcgcaggcactgggccaacgcggaatgctcggagtccaccggcacgatctgcccgggcgcggcggccgcgagcaccagcggcccgccggcgatcagcgactccttgttggccagcgccagccgggctcccgactccagcgcggccagcgtgggccgcagccccagcgccccgaccagcgcgttgagcacgacgtcggcctcggtctcctcgaccagccgggtcgccgcctcgggcccgcagaacgggatgtcgccggcccgccgggcggcgtgttcgtcggcgacggcgacgttggtcacacccgtctcggcccgctgccgcagcagcgtgtccaggttggcgcccccggcggccaggccgacgacctcgaagcggtccgggttggccgcgatcacctgcagcgcctgggtgccgatcgagccggtgctgcccagcaccagtacgcgcaggcggccgcgcggctgcccgtcgctcgtcgggttggtcacccattcattgtgccgcccgccaccggcgcgggccatgatgcggccgtgccccgcgagcccggccggccgttgtgccagaatctgggttcgacaagccgatccgatccgaaggggattcgccgtggccagtaccgaggtcgagcacttcaccggcgtcgacaccgtcgaggtgccgtcggcggcgtggggatggagccggatcaaccaccggacctggcacgtcgtcggcctgatcatcttcgggctgctgctggccatgctgcgcggcaaccacgtcggccacatcgagaactggtttctgatcgggttcgcgacgctggtcctcgtggtgctgatccgcgacctgtggggccgccgccgcggctggatcaggtagccggtcggcccgctgcccgcgccgccaggcgtggccgaacggcaccgccgccagcgcgagcagcgccagcgcccacggccagagcccgtgccgatgcacccagccgaccagcgcaccctgcagccgcccggccgcgccgatcaccgcgtcccgcgggtcgccgccggcgccgaacaggcgcacctcgtagccgccgtaatacgccacgtacagcccgaccagcaccagcaccgcgccgctgatccggtcgacgaacggcagcatccgccgcagccggtcggccgtcgccgcgccggccgtcgccgcggcgacggccggcacccccaccaccagcgtcaggcccgcgacgtagccgaggtagaccgcggcgccggtcagcagcgagccactgcgcaggcccgccgcggtgaccgccaggaatggcccgacggtgcaggacagggaggcgatcgcgtagctgatgccgtagccgtacatcgagccgagccgcgcggtgggcgcccaccgcggcccgaccggccggggcgtcagcgccgacagcgaccgcccggcgagcagccagccgccgagcgccaccagcagcaccccgacgaccacggtggcgtagggcagccaccgctgcaccgccccggccgccgacacggtcagcgcgccgaacagcccgaacaccgtcaggaagccgagcgccatgccggcggtggccgccagggcccgacccgccgcggcaacaccgggcgcccgcgttcccgcgccgcgcaccaccagcagcagataggcgggcagcatcgcgaacccgcacgggttcagcgccgccaccatgccggcggcaaccgccagcccgaccagaccgcggtccacgtcagcgcagcgccgccacccgggcggccagttcgtcctggggcatcgccgaggtggggttgttgacgaaggtggagctgccgtccgcccggtagaacacgtacgcgggctgccagggcacgccgtagcgggcccagatcgcgccgtcggcgtcgttgagcgtggtgaagttcaggttgtacttggagacgaagttggccatggcgccgacttcggagtgggcggcgacgccgacgaaggtgacgcccgggttggcggcggccacccggctcacgcccggggcctcggcgttgcagtacgggcaccacggcgtccagaaccacagcacggcgggcttgccctgcagactggcgccgttgaacggcgcgccgctgagcgtggtcgcggtgaattgcaggcggtcgtcggtggccgccgcgcgcggcacgtcgcccagcccgagtagcagggcgacggcgaaagcggttgcggccaaaagcctgcagacaaatgacaaacgggacatgccctgaagacgcaccgcgcgcctcccgggttcaccgcccggccccgcctgctatcccttctcgaaggccagctacccgccttcggcggcgagctgtccgcaggcccaggcccgatcgcctgcgctccagctacccgccttcggcggccagctgtccgcaggcggcgctgatctcgcggccgcgggtgtcgcgcaccgtgcaggacaccccggcggcgcgcacccgccggacgaactcccgctcgaccggcttgggactggcgtcccactggctgcccggcgtcgggttgagcggtatcaggttcacgtgcaccagcggcccgagcgcgcgatgcagccgccgccccaacagatcggcgcgccacggctgatcgttgacgtcgcggatcaacgcgtactccaccgacacccgacggccggtgacgtcggcgtaataccgggcggcgtcgagcgcctcggcgatcttccaccggttgttgaccggcaccagcgtgtcgcgcagctcgtcgtcgggggcgtgcagcgacaacgccagcgtcaccccgagccgttcgtcggcgagtttgcggatcgccggcgccagccccaccgtcgacaccgtcaccgaacgggccgagatgccgaaaccctgcggcggcgcggcgacgatgcgccgcaccgcggccaccacccgcgcgtagttggccagcggctcccccatgcccatgaacaccacgttggacaggcggtcaccgaagtcgtcgcgcagcgccgccgcgccggcgcgcacctgctcgaggatctcggccgtcgacaggttgcggctcagcccgccctggccggtcgcgcagaacgggcaggccatgccgcagccggcctgcgacgagatgcacaccgtgttgcggtgcgggtagcgcatcagcaccgactccacggtgaccccatccagggcccgccacaacgtctttcgggtctggccggcatcgcaggtcacctcggaggccgcggtgagcaggatcgggaacatggtgtcggcgatcgcgtcgcgcagcccggccggcagatcggtcatctggcgcggatcggcgatcagccggccgtagtactgatgcgccagctgcttggcccgaaacgccggcaagcccagctcggcgacggccgaggcccggccgtcggcgtcgagatcggccaggtgccgcggcggcttaccggggcgcggctcggagaacaccagttgttgaaccatgacccgtccagtatcggtcatcgccggggccggcctacggaacgagcgtcagcaccgtccaggcggcgaccgccgacggcagcacgccgtccagccggtccatcaggccgccgtggccgggcagcagccggcccatgtccttgatacccaggtcacgcttgacctgcgattccaccaggtcgccgagggtgcaggtgaacaccagcaccacccccagcagcgcgcccacccacggcgccttgccggccagaaaagtcgccgccagggtggccgcggtgatacccagcaccagcgagccggccaggccctcccaggatttcttggggctgatcgccgggaccatcggatgcttgccgaacagcacgcccacggcgtagccgccgacgtcggaggccaccacggtgatcatcaggcagaacacccgcccggcaccgtcggcgggatagaccagcagggcggcgaaggaggcgaacaacggcacccagcaggccaggaagacggtggccgacgcgtcgcgcaggtagttcgccgagggtgaaccggcgaacggctcggggcgcttgcggttgtcctgcatgaacaaccgccagaacaggcaggccaccacggtgacgccgaagccggccaacgcgccggcggcgtggaacggccaggtcagccacaccgtgagctggccgccggccagcaacggaatgaccgggatgacgtatccggcctcgcgcagccggcggaccacctcgtggctggcgaccaggatggccatcgcgacgatcggcacccagaagcggggcgcgaacaccagcgtgacgatgagcacggcgccgataccggcgcccaccgcgatggcggcccgcaggtcacgtccggcccgggaggttttcttcttggcccgctgcccggccgcaccctcggtcgtgttctcgacggcatgctccggctcgtcgcctgcaccgggatctgaggtagccacggacctgaatcaacttcgctgccggatggtcgctagacctccagcagctcgccttctttgtgcttgaccagctcgtcgatttgggtgatgtactgatgggtggtcttgtccaggtccttttcggcccgcccgacctcgtcctcgccggcctcgccgtccttgcggatgcggtgcagctcctccatcgccttgcggcggatgttgcgcaccgacaccttggcgtcctcccccttgctcttggcctgcttcaccagctcgcggcggcgctcctcggtgagctggggcaccgccacccggatcagggtgccgtcgttggtggggttgacgcccaggtcggagttgcggatggccgtctcgatcgccccgacctgactggcctcgtagggcttgatcaccaccagccgcgcctcgggcacgttgatgctggccagctgggtgatgggggtggccgcgccgtaatagtcgatcacgatccgggagaacatgcccgggttggcgcggccggtccggatggtcgacaagtcgtcacgggcaaccgctacggccttctccatcttctcttccgcgtcgaagagagcctcgtcaatcatctgcgccgctcctcctcaggtggtgaccagcgtcccgatcttctcaccgccgaccgcgcgggcgatattgccattggtcagcagattgaacaccaggatcggcatgccattgtccatgcacaggctgaacgccgtcgcatcggccacgcgcagcccgcggtcgatgacctcgcggtggctgatcgcggtgatcagctcggcctcgggatattgccggggatccgcggagaacacgccgtcgacggccttggccatcagcaccacctcggcgccgatctccagcgcccgctgcgcggccgtggtgtcggtggagaagtagggcaggcccatgccggccccgaagatcaccacccgccccttctccaggtggcgcaccgcgcgcaacggcagatagggctcggccacctggcccatggtgatcgcggtctgcacccgggtgacgatgccttccttctccaggaagtcttgcagcgccaggctgttcatcaccgtgcccagcatgcccatgtaatccgaacgggtgcgctccatgccgcgctgctgaagctgggcgccgcggaagaagttgccgccgccgatcaccaccgccacctggacgccgccgcggaccacctcggcgatctgccgggccacctgtgcgacgacgtcgggatccaaaccgacctggccgccaccgaacatctcgccgcccagcttgagcagcactcgcgaataccgggcccggctcgacggctggccggaagccagtccgttcgccggctctggcctcggagccgccgagccggcgacgtggggctccctggactccgtcatcagactcctcgcatgagagtgccatcccgggacgagtctctccggaacggcatttcacatcctgcctcatcgcagcacaacgcggcctcgccggggtgcattatgcgcacagttggcctgcccgaccgattttcgagtctctcggtaccggattgcggcggcgcgccggtgcgcgtttgagggctcggtggcgggggaatccgccaggacgcggcggaaatacgcggtcttgagcaacgaggacctgcctcgccgtatgaccggatcgatcgctcgcgatcgccgttcgagcgtgcatcgctcgcagtacgccaagaggaggaacggttccatggcggaagaaaacaagtcgggacccgcggaagcggtgaagggcgtcgtcgaggacgtcaaaggaaaggccaaggaggccgtgggcgcggtggccggtcgtgacgacctgacccgggagggccaggcgcagcaggacaaggccgaagcgcagcgcgacgcggcgaagaaggaagccgaggccgaggccgcccgcggcggcgccgaggccgccgaggagcgccagagggccaaccagtagctcgctggaaaagatgggtccggtccgtgaaaatgggccgggcccatcgcttttctgggatcgcctgcatagttttcggcggggcgggtatccagtacggcgctgtcagacatctcccgcagaggtgcctacggaccgggggaagcgagaacctcacgaggtttggagatgtcgttggacgtggtggtcctcaccaacgaggacgatttcgaatcggcgctacccgatctgagcagattcgcccgcccggcacgccgcgccgcgctgagcaccgacggcgacgggcaattcggccccgcggatgtggcgatcatcgacgcgcgcagcaacgtggccgccgcccaggcggtgagccaccggctgacggccgatcatccggcgaccgccgtggtggcgctggtcgccccggccgattgcgcggcggtggacgtcgactgcaatttcgacgacgtgatgctgcccggcacctgcgccgaggagttgcaggcgcggctgcggctggccatcgggcgccgccgcggcggcctggacggcaccctgaaattcggcgatctgttgctgcacccggccagcttcaccgcgtcgctggacggccgggaactgaatctgaccctgaccgagttcaaactcctgaatttccttgtgcagcatgccggtcaggcgttcacgcggacccggctgatgcaacaggcgtggggctatgagggcaacgggcgggcccgcaccgtcgacgtgcacatccggcggctgcgcgccaagctgggcacccggcaccagtcgctggtcggcacggtccgcggagtcggctaccgggcgccgacgccaccgcagccggaatggatcgttgggcaccagaagccctgagcggcaacacctttcgatgaggatcagccgaagaccgggaatgcccgccggcgcgccagcgcgtccattccctgctggatcgagtcctgcacctcccggtatttgcgctcgacgtattcgtcgtcctgcacccgcgcgggatcgttgtccaactcgacggggggcatgaaccgcgtccggatcttggccggcagcggcagctgaggcagcgccgccggcgcgatcccccagggcagcgagatcgccagcgggaacaccttgagccgcagtaaacggtccagccgcaaggctttcgagagccggtcgccgcgaatcagcaccggcatggcgtcggcgccgccgacggtggcgatgggcacgatgggcacgccggcgcggatcgccatcttgacgaacccggtccgcccggccaggttggcgcggtcccgctcggtccacggccgcagcgagtccacttccccaccgggccacagcgccacgtcacgcccctccgccagcgcggtggcgatcgcgtccggggctgccggaaggacccccatcgagcggaagtagcgcccgaacaacgggattgccatcaatgcgtcgtgggcggtgccgtgcagcgggcggtccggcccgaaccggcgccaccactgcaggccgacggtccaggcgtcccagacgaacggcgccccggagtgcaccccgaccagcagcgccggcggtgtgtccggaatgttctcccacccgtcgatctccatccgaaaccagtagtccaccagcgcattccacagatacttctgccgctgcagggtgtcctcgtcctggccggacagatcccatcgggccgcccgctcggcgacccatccgctcagcccgccgcgttggccgttgcgtcgctcctgcatggtcgcccgggtttcggcggcgtggcgctgcgcctgggcgcgcacctgcgtcggtctgtgatcggggttactcatgaattccggatacccgattcgcgcccgcacgattcccgcaccgcaaaactccccgcaccgttgcggtgcggggagttcttcgacggttcgacggtttacgtgtgcgccgccggcgcgggcggagcacccggtgccgggctgttcggcgcacccggtgcggggctgttcggcgcgccgggcgcggagctgggcacgttggaggtccacatcaggacatcctgcatgccgtcgttgtagaccacgccgttgggcggcgcgccggtcacgtcgaagtacagcgtcccggtcgactcggtgccctgcgggatcggcgcggggctcaggccgttgggcaccgccacgttgtcgatcacccggtagttctggccgttggggccgcgggcgatgaagtcgtggaccatcggggtgaccaccccaccgtccgagcggacgctgacgtcggcctggtagagcgtgcctttcggggtgtaacccggaatgctgacgttgctgggctgcagattgctcaccgtgtagtcggtgaccagcggcccgtccaccagctgctcgctgacgccgaacccctggatgttgggcgcggcggcggccggcgccgccgcgaacacgctcgccgcggcgatacccccggcagcggcggctgtcagcacggcgttcttggtgaccttcattgttcatttcctttcgtctcgaacaattgccccccggaagggcctttcgcagataatccggcaaatagccaacaaatcttcgacttaaacaccggcgccccgaatcaaccgcccaaccggcgcaaacgcgcacaaatggcattatttaccccgacgacatcttcggcctcagctcataacagccgtctcagcactcacaccggcaaccgcgctcccggtgcgattaggcgctgccccgccgggtagtcgtcggcaagggcgcccgcccggaaggacgcgagtcaagatatccgcgaagggagcagtcgggtgcaacgcggcaactccaagcacagttcacgccaagacgacgagctcaagcacgaattggacggcaccgtccggggtaaccggaccagccgcagcgaggaatggcgcgatccggaaccgccggccgacgacgacccggacgtgccgaccgccggccccagccggcgcgaatcctgaagcggcacatggccgccgaggcaatggacgacgaattttcgagcagctgaggaaatccgatgggctttgtggcgcaacaacaatccgtcccgggcgtgcaggcgaagatggaaccaattccggactgtggtgaaaacagttaccggggttcgggaaaactgctcggcaaaaaggcgatcatcaccggcggcgacagcggcatcggcagggcggtggcgatcgcctacgcccgcgagggcgccgacgtgctgatcgcctacctcaacgaggacgacgacgcgcgcgacgtggcccgccacgtcaccgacgccggccgcaaatgcgtgctggtgcccggcgacctatccgatcccgcccactgccgggcggtggtggaccgcgcggtgcgggagctgggcggggtggacatcctggtcaacaacgccgcctatcaaatgatgcacaagaacctcgacgagatcagcgacgaggagtgggactacaccttccggctcaacgtcggcgcttatttctacctgaccaaggccgcgctgccgcatctgcgcgccggctcgtcgatcatcggcagctcctcggtgaactccgatacgcccaatcccaccctggcgccctacgcggccaccaaggcggccatcgccaacttctcggccagcctggcccagctgctgggagacaagggaattcgggtcaacagcgtggcgccggggccgatctggacaccgctgatcccgtccaccatgccgccggacagcgtggagtcgttcggcgacaacgtgccgctgggccgcgccgggcagccggccgaactggcgcccatctacgtgctgctggcctccgacgaggcgagctacatctccggggcgcgggtcgccgtcaccggcggacggcccatcctctagcgccaaaggcattgggccgcttgaagttgcccaccggccgggcggctaaaccggtgaaaacaccggagccgccgctggtttggcgtgcggtcagcgggcccgcgcccggcggttgtgcttcttgatcgcgtcgaccaactcggacttggtcatcgtcgagcggccccggacatcgagtcggcgggccacgtccagcaggtgcttcttgctcgcgttggcgtcgacgccctcggccgacgcaccggacgcccgcgggccaccgctgcgggcccgctggtcggagggacccttcttcgccttgggctcccagtggtcgccgaccttctcgaaactgtgtttgaccgccgagtaggccacccggtgcgcgcgttcctcgctgccgtactcctgcgcggccgcgtcatgggctttggcgaacgtccgctgcgccttggcgctggaacgttgcagggtgctgggcaattcgcccttcttgggcgcgccgcccttggtcgtcttgggcatcggacctccttgtgtgccacccgactggttaccgccggacggttaccccgttgcggggccggcaatcacgccgccgaacacccgcaccggggcgccgcgatatgtcaagatcgttgacatgactgaggccgacgacgcgccgctgggttacctgctgtaccgggtgggggccgcgctgcgcccggaggtttccggggcgctgggcccgctgggtttgaccctgcccgaattcgtttgcctgcgcattctttcgatgttcccgggcatgtcgagtgcggagttgtcccgccgcgcgggcgtcaccccgcaggcgatgaacacggtgctgcgccggctgcaggaggtcggcgcggtggcgcggccgtcgtcggtgtcgtccgggcgctcgctgccggcccacctgaccggcgcgggctgcaccctgctcaagcgggccgaagccgccgtgcgcggcgccgatgcccgaatcctggccaagctcaccgagactcagcagcgcgagttcaaacgaatgctgcagaaactgggctccgacggctgatcaggcggcctggatgcgcgcccacggccgcgcctcttccagctcgtaggccagctgcagcagcaacgcctcctggccaatgtcggccgacagcatcatgccgaccggcatgccgtgctcggactgcgccaacggcagcgagatggccggctcgccggtgacgttgtgcagcggggtgaacgacacccagtcgatcaaccggctgatcacctgctgatagtcggtcggcgccaggaaaccgatgcgcggcgtctcgtcggcgacggtcggggtcagcgccgcgtcgtagatgccgaacaggggcgcggtgcgccgtcgcgcccggcgcagccgcgcgatcgccagcggcaggcggtgcaggttgcggctggtgtgccggtacaggccccgggtcaggctgtccagcttgtcgcggtcgaacgtcgggccgaacaggtgccggccgctgcgcaccggggccagcgccaaaacccccatacagcacgaaatcgtcgacgaagctggccgcgaccgggggctcgtcgaggagatcgaccccggtggccgagctcctcgagcaggccggccgtcttgagcgtcagctcccggatccgcggactgcactcgcgctggatcgaccgggtcagcaccgcgatccgcagccgctggcggcccgggccggtgacgtcgccgatcggcgccagcctgttgcgccagatccgctcggcctcccggtagaacgccgcggtgtcgcgcaccgaacgcgtcaccaccccgttggccaccaccccgaccggcatccggcgcagcgtggcatccagcggcagccgcccgcgcgacggcttaagaccgaccagcccgttgcaggccgccgggatgcggatggagccgccgccgtcgttggcgtgcgcgatcggcaccacgccggcgccgacgaacgcgcccgatcccgacgacgacgccccggcggtgtagtcggtgtcccacgggttgcggaccgggcccagccggggatgctcggccgccgcgctgaaaccgaactccgacagctgcgtcttgcccaccgagatcagcccggtggccaggtacagccgggtgaacacgctgtctgcgacggcgttgtacgacgtccacgcgtcggtgccgtgcatggtgggctggccggcgacgtcgatgttatccttgatgaacgtcgggacgccgtcgaaaaacgcggagaaaccggcgggcgggtcgggccgctcggcggccgaccgcgcctgctgaaaagccgcgtacgccaagccattgagcagcgggtcgacggcctcggtgcgcgcgatcgcggcctcgaccacctccgcccggctcacccgaccggctcggagggcgtcggccagcccgaccgcgtcgaggtcgccgagggcgtcgtcgccgaacgcgtgcacgtgtcgcatgcaccgacgctaacccgcgcgggcacgccgtcggcaggttttgtgccgctgcgcgcgaccggtcaggcctggccgacctcgaagcgcacgaaccgggtgaccgtcacgccggcctcgtcgagcagcgccttgacggtcttcttgctgtcggacaccgacggctgctcgagcagcacggcgtccttgaagaagccgttcaaccggccctcgacgatcttgggcagcgcctgctccggcttgccctccgccttggccgtctcctcggcgatgcggcgctcgctggccaccacgtcctcgggcacgtcgccgcgggacaggtagcgggccttgagcgcggcgatctgcagcgcgaccgcgtgggcggcctctttgtcgctgtctttgcccgagccctggtactcgaccagcacgccgaccgcgggcggcaggtcggccgcccgccggtgcaggtaggcctcgacggtgccgtcgaagtgcgcgacgcggcgcagctccagcttctcgccgatcttggccgacagctcggcgatcgcctgctcgacggtcgtgtcaccgattttcgcggctttcagcgcgtcgacgtcggcggccttcgaggacgcggccgccgccacgatctggtcggcaagcgcctggaattcggcgttcttggcgacgaagtcggtctcgctgttcagctcgatcagcgcgccgccctgggcggccaccaggccctcggccgtcgcccgctcggcgcgcttgccgacgtccttggcgcccttgatccgcagcgcctcgaccgccttgtcgaagtcgccgtcggattcggccagggcgttcttgcagtcgagcatgccggcaccggtgagttcccgaagccgcttgacgtcggcagcggtgaagttggccaatggtcagccttccttaggaggggtcggtggtgggttcgggtgcgcccgcttcggtgggggcggctgtcgcagtggccgaggcgagcagctcctgctcccactcggcgagcggctcggcggcctcgacctccggcttgccgtcaccgcggcccacgccggcgcgggcctgcaggccctcggcgaccgcggaggcgatcaccttggtcagcagcgcggcgctgcggatggcgtcgtcgttgcccgggatcgggtagtcgacctcgtcggggtcgcagttggtgtccaggatcgcgatgaccgggatgcccagcttgcgggcctcgccgacggcgatgtgctccttgttggtgtcgacgacccagatcgccgacggcaccttgctcatgtcgcggataccgccgaggctgcgctcgagcttgttcttctcgcgggtcagcccgaggatctccttcttggtgcggccctcgaagccgccggtctgctccatggcctcgagttccttgaggcgttgcagccgcttgtgcacggtggagaagttggtcagcatgccgccgagccagcgctggttgacgtacggcatgccgacccgggtcgcttctgccgcaatggattcctgcgcctgcttcttggtgccgacgaacagcacggtgccgccgtgggcgacggtttccttgacgaactcgtacgccttgtcgatgaacgtcagcgtctgctgcaggtcgatgatgtatatgccgttgcggtcggtgaagatgaaccgcttcatcttggggttccagcgacgggtctggtgcccgaagtgggtgccgctgtcgagcagctgcttcatggtgactacggccatggaggtgcctcacttgtgtcggttgtcgcccggcatcgggtgaggccgggccctggcgcctgcggcgatgccgaacccagcccggaaacccgggtgggaccggtcggcatgcggtgcgatctcctcgtggaaactccgagacgcgatgcagacgcgcgaagtcagcccgcggacgagctgcgaccagcagtttacacccactcagcaggtgctttttccacagccgccgccgccgtgactggcggcgccgccgccgcggcgctgaactcggtgcgtgcggtgggcggcgctgatgctggtcgtcggcctggtcggcgcggtcccggcggcggccggcgatcttcacctggagtggccgctgcggccgccgccggtcgtggtgcgggcgttcgaagccccggcccaggactggcatcccggccaccgcggcgtcgatctggccggcaccgccggtcagccggtgtacgcggcgggcgcggggaccgtggtgttcgccgggctgctcgccgggcggccggtggtgtcggtggcgcatcccggcgggctgcgcaccagctacgagccggtccgggcggtggtgcgggtcgggcagccggtgacggcgcagacggtgctgggcgagctgcggcccgggcaccccggctgccgggcctctccagctggaggggcctgcctgcactggggcgcgctgtggggtccggcgtcgggcgcacgctacctcgatccgctgggcctggtcgcgtccaccccgatccggctcaagccgctgggcggttgagcgcgctcgagtgttgcacctcggcgttcggtgttgcatcgcggcgcggatcgtcggcgtgtcgccgcccagggttcacactcgacgcgcgccggtcaggcccgcggatgggcctggtcgtgcacggcgcgcagccgcgagaccgcgacatgggtgtagagctgggtggtggccaggctggaatgacccagcagttcctggaccacccgcaggtcggcgccgccttccaggaggtgggtggccgcgctgtggcgcagcccgtgcggtcccatgtccggcgcgccgctgaccgccgcgatcgtctggtgcaccacggtgcgggcctggcggacgtcgagccggcggccgcgggcgcccagcagcagcgccgggccggactccgcgttcgccagggcgggccgcccgtcggccagccacgcgtgcagcgcctcgccggccggcgccccgaacgggacgctgcgctgcttgttgcccttgcccaggacgcggaccagccggcgcccggtgtccacgtcgtcgatgtccaggccgcacagttcgctgacccggatcccggtggcatacagcatctcgacgatcagccggtcccgcagcgcgatcggatctccttgtgccgcaccggttttagcggcagccatggcgcccagcgcctggtcctggcgcagcaccgcgggcagggtgcggtgcgtcttgggcacctgcagccgagccgccgggtccgcggtcagcaggccgcgccgcacggcccaggcggtgaacgccttgaccgccgaggtgcggcgggccagcgtggtgcgggcgacgccgccggcggcggccgcggacagccaggagcgcagcaggggcaggctcagcccgtccaggcccgtgccgcgctcaccggcgaaggccagcagcgagcgcaggtcgccgaggtaggcgcggcgggtgtgcgccgaacgcccgcactgcagcgccaggtactcgtcgaactcctcgaggatcggttcgctgtccggcactcccccacgctggcagaaaccgggcggccggactcagacgacgcgccgaagcgtgtccggggtgagatctttgcgcgtcggatatccgtcgacggccatgatgaggtcggcctcggccaggatcgagcgcagcgcgtgcacgatgccgtcgacgccgccgagcgccaggccatacgcatacgggcggccgatgccgaccgcggtggcgcccagcgcgagcgccttgacgacgtcggcgccgctgcggatcccggagtcgaacagcaccggcagaccgtcggccgcctcgatcaccccgggcaggcagtccagcgccggcagcccgccgttggcctggcgtccgccgtgggtggagcagtagatgccgtcgacgccgccgtcgcgggcgcggcgggcgtcgtcggggtggcagatgcccttgatgatcagcggcagatcggtcagcgaccgaagccagggcaggtcgtcccaggtcagcgggtttccgaaggtcgatatccactgcagcacggtgccctgcgggtcctcctcgggcgggcgcgccagggcggcgcggaacaccggatcgctggtgtagttgctcaggcacatcccccgcagctggggaaagttggcggtggacaggtcgcgcggtcgccagccggggatccaggtgtccagggtgacgatgatgcccttgaagccggcggcctcggcccggtgcacgaggctggcggccagctcccggtccttcggcgtgtagagctgaaagaagccgggggtgtcgccgaactgcgcggcgacgtcttccatcgggtcggcggtcagggtggaaacgaccatggggacgccggtggccgcggccgcccgcgcggtggcgaggtcgccgtggccgtcctgggcgcagatgccgatgacgccgatcggcgccatgaacaccggcgacggcagggtcaggccgaacatctgcaccgacaggtcgcgttcggcggcgccgacgaacatgcgcgggatcaggccccagcggtcgaacgcctcccggttggcccgctgggtgcgttcgtcgccggcgccgccggtgacgtaggaccacaccgacggcgacatggcccgctcggcgcgggactccagctcggcgaaggccatcggcagcgacggcgccaccccgcccaggccgcggaagtagatctcgttctggtagtcgccgaacgccatgagatagaggatgccagtcgggccgtcaggcttgcgccgactccgcctgggccagttccttcttccactgccggaacgtctcttcggtgcggccgcggcgccagtagcccgagatcgacgccgcccatttcgcgtcgacgccgcgctccttgcggacgtagggccgcaggttgtgcatgacggcttgggcctcgccgtggatgaagacgtgcacctgcccgggcagccagggggcgctggtgacggcctcgatcagcggcgcgtgatcgccggcgcggtcctcgggaaccaggtcggcgcggccgccgcggtacacccagtgcacctcgacaccgtcgggcgcggtcagcgggatctcgtcctcgtggccggcgacctcgatgaaggccttcccgaccgcgctgggcggcaacgcctccagtgccgcggcgatggccggcagcgccgattcgtcgccggccagcagatgccagtcggcggccgggtcgggggtgtaggcgccgccgggacccatcaggtagatcggctggccgggctgggccgtggccgcccactgcccggcgatcccgtgttcgccgtgcacgacgacgtccagggcgatctggcgggacgcggcgtcgacgtggcggaccgtcagggtgcgcaccgacggtttcttctcggccggtagctcggcgaagctgtccagggtcaacggctggggcagcccggccacgtccacgtcgtcggcgacgaaggccagcttgacgtaagagtcggtgaacttgctcggcacgaaggcgtcgaaatccttgcccctcagcacgacccgcaccatgtgcggggtgagttgttcggtcctgacaacctcgaagctttgcagtggtcggcccgccacgtgtcctcctgtccaaacctcgacccgccgtcgactatacgagtcacgccggtggcggggccgggcccgcggcggtccgcacgatcctccagcgcccgtcctggcggcgcaccagcccggccagctcgagcatcgccagcggccccagcgcctgctcgggcagcaacccgcagccggccgcgagctgctcgacggtggccgcgccgcggcccggcaacgcctcgtacacccggcgttcggcctcgcccaggccgtccagcggcgtgaccgggtgcggctcctcggcggccaattcgccgatgtggccgatgagctcgacgacgtgctcggcgcgggtgatcagctcggcgccgttgcgcagcagcgcgtggcagcccgccgaggccgacgacgtcaccggccccggcaccgccgccaccacccggcccagcgcgcgcgcccaggccgcggtgttggccgcgccgctgcgcagcccggcctccaccacgacggtggcccccgccatcgcggccaccagccgattgcgggtcaggaagcggtagcgggccgggcggactccgggcgcatattcggtgaacagcagaccgtgctgcccgatccggtgcagcagcgcggagtgaccgctcgggtaggcgacgtcgagcccgccggccagcaccgccacggtgacgccgtcgcagtccagcgcggcgcggtgcgccgcgccgtcgatgccgtaggcgccgccggagacgaccgcgacgtcgcgctgcaccaacccggccaccaggtcgccggcgacctgctcgccgtaggcggtcgcggcgcgggtgccgaccacggcggccgcccggtgggcgacctcgtcgagccgggcggggccctgcgcccacagcaccagcggcgccagcatcggcgcggtgccgggcgggcggggtgccgccgcgccgaacgcggcgaaggccagcaccggccactcgtcgtcgtcgggggtcaccaaccgcccgccgcgccgggcgatcagctcgagatcggccgccgcgcggtcgatctcgcgccgggcttcggtgtgtttggccagcgcgtcgtcgaccgctgcgcgccggacccggtcggccgcctccaccggcccgacccggcgcaccagggcgcccagcccggggcagggcggttcggcgacccgggacaggtaggcccaggcgcgcaacgcccgggggtcggcgggcgtcatcgccgtgctcccggtcccaagaatccgccaagaatccgtccagcctcgcccgcgactgtggtgtggtccgccgacggccgcccgccggcccgcaccgaacggagcgaacaatgatcctcgacctgccgctgggctacgccgcgtcgcaacgtcccaaaaacccgtgggcggtcgcggcgttcgcgctgagcctggtcgcctggctcggttttcccatcccggtgatcgccatcgtgctggcctgcatcgcgctgcgcgagatccaaacgcgcggcgaaagcggccgcgccatggcgcaattcgcccgcgcgttcgcgatcctggtgaccgtcgcgatcgcgctgcgcggcgggcacaccgactggctgaccctgctgcgctggtgacccggcccgtcggcgcgccgccgcgttcatcgctgcgcccccgcctggcgaaagctcagcgcggtggcgacctcctcgggtcccggcgatgtgcgcccggccaggtcggccacgctccacgcgacccgcagggtgcggtccaggccccggatgctgagcagtccgcggtccagcgccttctgcagcggatccatcgccgcgctgcccagccggaacttgcggcgcagcagcggcccgctcacctcggcgttggtgcgaaacccgtacggcagccagcgctgcgccgcggcctgccgcgcctgcgcgacccgccggcggacctgcgcggtggattcgccgtcgccgccgccgaacgcgccggcccgcatcggatgcatctgcacccgcaggtccacccggtccagcagcggcccggacagcttgcccaggtagcgccgcttggcgaccgccgcgcagacgcagtcctgcggatcggccggcgcgcacgggcacaggttggcggccagcaccagctggaagcgggccgggtagcaggccacgccgtcgcggcgggccagccgaatctcgccgtcctccaacggtgttcgcagcgcctccagcgcgctgagccggatctcggcgcactcgtcgaggaacagcaccccgcgatgggcccggctgaccgcgcccgggcgggccatcccggagccgccgccgaccagcgccgcgacgctggagctgtgatgcggcgccacgaacggcggccgggtgatcaacggcgtgtcccccgacagcagcccggccaccgagtgaatcgcggtgacttccagcgactcgctctccgtcagcggcggcagcagccccggaaggcgttgcgcgagcatcgttttgcccacccccggcgggccggtgagcatcaggtggtgggccccggccgccgccaactccaccgcgaaccgggcctgcgtctgcccgaccacgtcgaccagatccgccgtcggctccgggacggtggtgtccggctcgatccggccgtccagggcgccggtgccgctcagccagtcctgcagctggcccagcgtgcgcacgccccacacgtcgatgccgtcgaccaggctggcctcggccaggttgtcggccgggaccaccacggccggccagccgtcgcgcttggcggccagcaccgcgggcagcaccccgcgcaccggccggacccgcccgtccagcgacagctcgcccagcagcaccgtcttgtccagccggtgccacgggttcttccgctgcgccgacagcaccgccgacgccagagcgatgtcgtagacgctgcccattttcggcagcgtcgccggcgacagcgccagcgtcagtcgcgcctgcggccagttgttggtgcagttgctgaccgccgcccggacccggtcgcgcgactcctgcagcgcggcgtccggcaaccccaccagatgcacgccgggcagaccggacgtgatgtcggcctcgatctccacgatctgtccgtccacgccgcgcaccgcgacggagaacgcgcgtcccagcgccatcagccgatcccctgcagatgcgtgatctccggggtgcggcggcgccccacccgcacgccgatcacgtcgatgcggatggccgcccagccccggtcctggccggccagccacagcccggccagccggcgcagccggcggaccttgcgcggcgtgacggcctgcggcagcccgccgtagccgtcgccggtgcgggtcttgacctcgacgaacaccaccgtggacgtggcgtccactggcggaaggcacgtattcgaagggtgcgctattcgtcgcgtcaacatctgagtccgggttgagccgtggattggcatgcctggaggtaggcggcccagctgctctgggcgtactgcgcccactggtaggccgttgtcgggtgtatcccaaagagttctgcaacgactggtggtggaagtgtggcggcgttggtgatcatggcggtgttgcgtgcgtggatgaccggcagtccgtgtttcgtcagccgttgctgcagggagcgcgggtttacgggcctgctcggcggccggcctgccaataggtaggcgggattgtctgcagacccgttgcgcagcagcgtgtttaccgggcctcgtgcgatgagttgttcgatgaggcgggccagggttggtggtagcaggaccgggtggcggccgatggtgagatatgagccgtcatcgtcggtgtgataccggtcggtggtcagttcggcgatgcgcaccaggggtggggcgtagagcctgatcaacgctccgaccacgcgaacatcgagcgggagtgtgtcatcggtgaggcaccgcttgagttgctgttcgagttcgtcgtcggagagcaggcgcgacgggagctgggatcggcgttggggaacgacgagctctgcttgtgtcaggcgctgcttttccagccagccgatgaatgcggccaggtatttgtgtttggtgggatgggcgtccagccagcggtccaggtgaagttgggtgacggagtccagcgggatttcctggtcatcgagccaggtcaagaatgcgatggtggtgctgatcttttggcgatcgttggctgctgagccgatggtgtagcggcgtcgtgcggcgcgttttctcgcgtcacggatgacgcgccattcggcgaacggtcggacgacacgggattgatgcggtggaaggtgttgaattttgcggctcgcccagatctgcagttgcgcgaactcttcttggcgcgacgtcaggatcccggtagtgaccaaaagttggcggatatagcgggtggcgttgtcctggtcgagttcatcgaggagctcatgggagatcgcgcggcgctcagcgactagctgcgcgagcagtcgggcagacgaacttgcttgcagccaggtctgcaccgattcgggattggccgccgaaagagcatccgccaacggctgcagctgcggcaccaccgtaccgtcgtcgaggctgagtaggacgttgacgcggtcagtcattacgcagcacgtgcacttcccgtcggcgtagttcaggccctctatcccgcatgtcctgcaggaaaagtcgaggtccaccccgcagcacggggcgcagatgtcctggccgtccgggttgcggccaaccatcaccgcggtgcgatgacagttagcgcaaggttgcgggtgcaggcgtcgacggtgatagcagtcccggcatacggtccctaatggccatgtggcgcaagcaatccctggcttttcgcagctgtcgcagtgccgcgggtggtgcggccagcaggtaacgcagtgcaacgaccctccgcgatatttaccgccggcgcgggttcgcccgcagaccacacactcgccgatgttgcggtagcaccgcacgcaggtatcggggtgcgtgtcggtggcgcgagcctggatctgcgcgatctcgccgcatacaccacatttccttgctggtgatcggtagcaggtccgacagatcgggccgtctgcggtctgggcgtggacccggcgcacattgccgcagcggcaacacgattgtgtgggcggcaggctgcacctttggcagagcacagtgccgtcgtcgcggcgagcattgggcgggcgtttccgtccgcagccggcgcatacctgaaggaactgggggtctttgttgtagcagcgacgacaaaccgggccgtctgcacgacgagcgatgatgtatccgtcttcgccgcagcgcgcgcatggccgtagttcggtgcggatcacacaccagggacagcagcgcccctcggggctgtttcgccgcagcgccagatcggtgcgaccgcatttcgcgcatcccagcagactgaccgcgtccgcgtgcccggccgcggcaagcaaggtcaacaggcggggaaaggctgccgggcactcatgagtgggcgcggtgaaggcgcccggattctcgccgagatattcgtgaaggtgccgggcgttggccgtggaccatcctttggcttccactagcagctgctgtgctcgctgccgggtcatgcccgaaccgacagcgctgatcaccgacgacaccaaagactcgcgcacgtgcgcgatcggcgccgtcgagtgtggccgtgtcatgacttgccaggccgtcgtacgactgtttttctgggcgtgaccgccggcgcaccactccccccccgcgccggcggtcttgcggacgggtttgttgacgacctcgaggacgatgaggtcattgggtgtgcatccgaggatgtcgcacaacgccaccaacgtgtccatgctcaagcgctgaggaggctgtgtcaccaatcgaaaaacctgctcgcgtgagagcgtgatcccgcgctccaccaggtgcggaatcagatcagtggtcttaaacatctgctgatcggccatcaagtcacgcagccgccagcgataacccatcttcttgatcatgtcggtgctccatcccagtggtcgccgagacggcccatcagcgaggccttcagcagcttgttgcggtattcattagagacatgggtgtagatcgacgtcgtcgaagcatgcgcatgacccacctgttcctggacaaaccttgcgggataaccgaattcggtccagtgcgttactgcagagtggcgaaggcaatgcagattcagtgaacggtctaacctcgcgtcgtcacgagcggccacaaacgcttcgttgatcgatcgtggagatagccggcccccgcgctcggtcacccacagcgccgggtggcgatccggcggtgaaaaccgtggacggatctcggtgagccactggtccaatgtctcgaccacccagtccatctcggggacgagcagcacagtgcgccgcttaggcggtgctcccttcggggccttgccgtagcggaccatcaccaccccgaagccaccgaattgtggtgcttggctgttacggcgcagatcgaccaggtccagccgagacgcctcggttctgcgaaggccaaaggcgtagatagttttcaaaaccgcggcatcccgcgcggctcccaacgcgcccttcacgccgcgaccctggattgtgcctgagcgggcatccgctgcgtcaaagagcgcttggatctcgtcatagctaagcgggcgacgccggggatcaccctcgtagtccagcttgtgctgaatcgaattgccctcatggaagatcgcctgcgggacatcgccgaactgatcggcacacacaccggcccagccgtagcggggatccagcaagtactccataaacaggctgatatcgatctcgtaggacctcgccgtcgacaccgcctccaccgtcgtcgaccgcaagtgatcgatgaacgcctcgccgtcggccggcgcccattgccacggatacagcccgctgaacgcttccagccggcgaatcaaccgcagcctggcgccgatcgtgcccgctcgcaggaaacgcgctgattgctggcggcgccagccctccaacatcgcctcgaacaccgccgcagcctgatcgaggtgaaccacgttctgcgccaacaccagatgcgccgaaccaggcgccgataacgtcaccgctctgttgtatcagatgcaatgacgatgcgttggaagtgacatggctgatcacggccccaacgctccgatcccggaatccaccaccggtctccaccacctagcactacgctgatcccgcaacagtcccgaaatgttgcatccaatgcaattccgcgcatttgtcgcaggcgatgatgtcgagttctccgtagcggcagcgccagttgcggtgcagcacccgcagccccatccgggtcaggtggtccacggcgagcgcctcacccatcgcgcccagctggatccgggtcatcgtcgtttcggtcgtcatggcggccaccctgcccggcgccgccgacgggcgaggccgggccgccgggcgcggccgcccgcaccggccggttatccccagtgcggcgcgcatccacagccacgccgtgccaccggtgcggttcagccgatccggtcggcccgggtgtagatgttcatcgagtcctcccgcagaaaggccaccaacgtgactccggactcctcggccagcgacaccgccagtgacgacggcgcggacaccgccgccagcaccgggatgccggccatcaccgtcttctgggccagctcgaacgacgcccgcccgctgaccagcaacaccgtggcgcgcagtggcagccgctgctgctccagcgcccagccgatcaccttgtcgaccgcgttgtgccgaccgacgtcctcgcgcaccaccagcatggtgccgtcggcgcggaacagcgcggcggcatgcagacccccggtgctgtcgaaaaccttttgcgccgaacgcaattggtgtggcatcgcctgcagggtggcggccgcgacggtggcggggtcggcggccggcgaaaaccggctgaccgatcgcaccgcctcgagcgacgccttgccgcacaccccgcacgaggaggtggtgtagaagttgcgggtgacgtcgagctcggggcggccgaggccggccgccagcgtgacgtccagcacgttgtagctgttcgcgccgtcctcgccgcacccggcgcagtagcggatgctgtgcacgtcctcgcgggccccgatgatgccctcggtcagcagaaagccttgggccagttcgaaatccgagcccggcgtgcgcatcgtcacggtgaccgcggcgccgcccacccggatctccaacggctcctcgacgaccagagtctccggtcgggcgatcgcctgcccggcggtcagatgcgtgacccgccggcgcgacgttacctgcaccgcctcaaactaccgcgaccggtgggtcagcgagccgcgggagacccacgagccgatcacaccgccgacgccagcgccgccagcgcctgcgccgaggtgtgcacgggccgccagcccagttgggttttggccttggtggtgtccatcaccatcgacgtgcgcgcggtgtgcagccattccagcatcgagggcaccagcggcgccttggatatcgccgccgaggccgccgtcgccgccacggccggcacccgcaccggccgcccgcccagcgccttggccacgtcggccaccgtcaccaccccgtcgccggcgatgttgtacgcccccgggggcgccggcgcggtggcggccagcgcgatggccgacgccacgtcgtcgtggtggaccaactgcagcggataaccggggtccggcaccaccggcttgagcaccgggatcgcctgcaccgctttgacgatggcgcgcagcgggccgggcagctggttccacggcatcgcgtcggccagcgcggtcgcgcccggcccggccacgatgcagggccgcagcacgaacacctccagcggcgaatccttggtgatctcggcgagcatcgcctcggacgcggccttctgcgcggagtagtaatgctcggcggacccgcgcgccggcacgtcctcggtcagcgggacggggttgtcggagtggtagccgtaggccgccaccgacgacgtgtacaccaggcgccgcggccgcccggccgccaccgttgcctcgaagacgttgcgggtgccctgcaggttgacgcgggcgctctcgtcgcgcgaacccatgatgatgaaggccaggtggatcaccacgtcggcctgcgcgaccaccgcgtcgacggcctcccggtccaggatgtcgccctgctggtaggtggtcttctgccagccgcgcgaggacggggagaacggccggcgagccatcccgatgatcgcgtccacgcccggttcgcgctccagtgccgtcaccgcggagcggccgatctcccccgtcggtccggtcaccgcgacggtcacacccactcggtcacccccattcagacgtccttccccccggcggccggccgaaaccgtgcgaggccggcgtcgcgcacgcccgctcggcgcgtggtagaaccatcattccaacccgcgcgcgatcgcgcccgccgcccacgggcgggcatcgcacctcgtcgacgaccggcggtgacggcggatgccgtcggcaacccggccaaacggcatgtaaggctggtgtcggcgaggagataatttacggcgttggggagcgggtcatcccgccggcaccgcaggaaacgaggcagcagcatggcggaacaatcggaagccggcgcggtggcatccgcggcgggcggggagaaagccgaccccgcgacggttttcgcggcgctggccgagatcatctaccagggctcggacgccaacgagatgtatgccgccatctgcatcgccgccaccctgacggtgcgcggctgcgatcacgccagcctgttggtgcgcgagaacgaccgctacgtcaccgtcggcgccagcgaccagctggcccggcacatcgacgagctggaacgccgggccggcgacggcccctgcatcgacgcgatcgaggaggagacgccgcagatcgaccccgacctgaccacgccgtcgctgtggcccaagctggcctccgtgctggtcgccgagaccccggtgcgcggtgcgatgggctttcggctgctggtcgacaagcgcaagggcgcggcgctcaacctgttcagcgacacccccaacatgttcgacgccgagtcggccggccgggcggcggtgctggccgccttcgccagcgtcgccatcaacgccgtcgccaagggcgaggacgccgcgagcctgcgccgcgggctgctgtccaaccgcgagatcggcaaggcggtcggcatgttgatgctgttgcacgagatgaccgaggacgaggcgttcgacctgctgcgccgccactcccaggcgctcaacatcaagctggccgaggtggcgcgcgccgtgatcgacaaccgcggtcagctgccacccgagatcgagaaccagctgccgcccaacacctaggccgggctattcgggcagccgcagctcgggcttttcgacctcttcgatgttgacgtccttgaaggtgaccacccgcacctgcttgacgaaccgcgccggccggtacatgtcccacacccaggcgtcggagagccgcagctcgaagtagacctcgccgtcggcgttgcgcggcgtcatctccacgctgttggccaggtagaagcgccgttcggtttccacgacgtagctgaactgtccgacgatgtccttgtattcgcggtacagcgagagctccatctcggtttcatacttttcgagatcttctgcgctcatctgccactcatctgctcagacgtccttcttcggagacactgccctcgccatcccatctttcctcaccggccctcgtcgcgctgcagcggtaggtccggtttgcagtcggccaccacccggccgcccgagccgttggccacccgccgcacgttgatgaacgaatgacgatgctgcgggcacgggcccagccgggccagcgccgcgctgtgcgccggcgtgctgtagcccttgtggtcggcgaagccgtagccggggtgctcggcgtccatcgccaccatcaaccggtcccggctgaccttggccagcacgctggcggctgcgatgcacgccgcgacggcgtcgcccccgatcaccggcagcgacggcaccgccaacccgggcacccggaagccgtcgctgagcacgtagccgggccgcagcgacagcccggccacggcacggcgcatcccctcgatgttggcgacgtgcacgccgcgacggtccacctccgccggcggaatgaacaccacgtgataggccagcgcgtagcggcggatcaccgggaacagccgctcccgcacgctctccgtcagcttcttcgaatcatcaagggcggcaaggctttccagcttccccgggccgagcacgcaggccgctaccaccagcggtccggcgcaggcgccgcggcccacctcgtccacgccggccaccggccccagaccgctgcggtacagcgccgactccagggtgcgcagacccgacgatttacgaatcaccgtccggggcggccacgtcgtggccatggttactgcccctgttgcgggttcaccgatcccaccccgccccagcgggacggcggccacacgatgaacctggccttgccgatcacgttggacaccggcacggttcccgaggccggatccccggtgcacaacacgcccttgagcgcctcggccggcacgctggtgcagtgcgcgcgcgaatccgcggagtgggtccggttgtcgcccatcacccacagccgcccggccggcacggtgaccgggccgaactcactgcccaggcacgggtacaccgacgggtcggcggccatggtgttgcgatccaggtagggctcgcgcagcggcttgccgttgaccgtcagcccggtctcggcccggcactgcacggtctgccccccgaccgcgatcacccttttgaccaggtcgttctcgtccggtgggacgaagccgacgaaggacagcgcgttctgcgcccagcgcagcgcggtgttgttggaccggatcgacttgtagccgaggttccacgacggcgggcccttgaagacgatgacgtcgccggggcgcggggcgccgaagcggtagctgaccttgtcgaccatgatccggtcgcccacacagccggtgcagccgtgcagcgtgggctccatggactccgacggaatcaggtacggccgcgccacgaaggtcagcatgacgtagtagagcagcacggcgatcaccgccaggatggcgaattcgcgcagcgtcgaacgcttggagccctcggtgggagcggctgcgtcgggcttggtccccggttcgggaaccggtgcgggcgcgccggcgtcgtcgtcggggcgggtatccgggttgcgggtggagaccttcggatctgcgtcgccagcgtgggactgggggttagaggaatccgcggtgtcggtcacgagatcagcgtagccagcgcacgttacggcccggcaagcggcgagcggtcgggccgctcagcgcttctccttgatcttggccttcttgccgcgcagttcacgcaggtagtacagcttggcgcggcgcacgtctccgcgggtcaccacctggatgtggtcgatgttgggtgagtgcaccgggaaggtccgctcgacgccgacgccgtagctttccttgcgcacggtgaaggtctcgcgcacgccgccgccctggcggcggatcaccacgcccttgaacacctggatccgctccttggcgccctcgatgaccttgacgtgcacgttgacggtgtcgcccgggccgaaaaccgggatgtcgtcgcgcagcgacgcctgatcgacgaagtccagccggttcatgtgagagacacttccttgaggtcgcggccggcggcagccacccacacgcgggtgtgaggcggtcgcccggccgatggtttcgggctttctggcgcatctcgcagcaggcgggaagtggcccagccggcctgcaaccgctggagacaactggtcaattgtgccagacggggtccctggcgcggaaatcacagcgcgtcggcggttcacaacgagccgaactcgctggtgaatggtacatatgactggggtcagaacgcgctacccgcaccacggcgtgatggccggtgcgagtgccgcgagcgggccgccgtaggcactgtgtcgagtcgcgcgcaaggagacgaatgcgggtacggccgctgacgctgttcaccgccaccgcggcggtgacgttgctgatcgccgccggttccgaggcgctggtccaggccaaggtgtaccacctgcccgtcgccgcgccggtgcgggtgctcacccagccgccgcccccgcagtcggccgccctgatgctcgaggccgccaccccgccgcagccgccgcaggcgctgccgaacgccgggttcgcccagctgccggcccgcatccagcaggccgccgaccaggccgcggccagcggcgccgcgctgtcggtggccatcctcgaccgcggcacccaccagctggtgtccatcggcaacgggcagatcgtgggcaccgcgtcggtggccaagctcttcatcgccgacgatctgctgctgcaccaggccgagggcaaggccgcgctgagcgccgacgaccgccaggcgctggacatcatgctgcagtcctccgacgacggcgccgccgagcggttctggggccagggcggcggcgcggccatcatctccgaggtggcgagccgctacggcctgacgtccaccaccccgcccggcgacggccgctggtggaacaccatgagctcggtgaccgacctgatccgctactacgacatgctgctggacgggtcgggcggcctgccggccgaccaggccaggatcatcgtcagcgacctggcccagtcgacccccaacggtgtggacggttatccgcagcggttcggcatccccgacggcctgtacgccgagcccgtcgcggtcaagcagggctggatgtgctgcatcggcgccgactggatgcacctgtccaccggcgtgatcggcgccgaccgccgctacatcatggtggtccagtcgctgcagcccgccgacgacgcgaccgcccgggagaccatcacccgggcggtcaagacgatctttcccgacggccgcatcgaggccccgccgcacgggctctaacggcccggatcgtcttgcggcccaaccggatcggctagcagctccggtcggcgctcgcgggtgcgctgcagcgagacctcccggcgccacgccgcgatccgggcatggtcaccggagagcaacacctcgggcacgtccagcccgcgccagctcggcggccgggtgtagctgggcccctccagccgccggtccagtgccggcgagtgcgaatcatcgtggcgcgacgcgggattgccgagcaccccgtcgagcagccgcaacacggcctcgatcatcaccaccgccgccgactccccgcccggcaacacgtagtcgccgatggagacctcttcgacccgcatccgccgggcggcgtcctcgaccacccgctggtcaatgccctcgtagcggccgcacgcgaacaccagatgccgctcggcgctccagcgggcggcggtggcctggtcgaacagcacgccggccggcgtgggaaccaccaaaagtgtttccgctgaggcgatttcgtcgagcgcctcaccccacaccggcgccttcatcaccatccccgggccgccgccatagggggcgtcgtcgaccgagcggtgcgcgtcgtgcgtccagcgccgcaggtcgtgcacccgcagatcgaccaggccggactgaatcgccttgcccggcaacgactgccgcagcgggtccaggtaggccggaaagatggtgacgacgtcgattctcatgccggcctacaggtccagcaggccgtcgggcggatcgatctcgatgagcccgtcgtccagcgacaccgcggtgacgatcgcgctgacgaacggcaccaacacttctcgcggcgcaccgtccgcgtcgtcacgcaccgccagcaactcgccggcggcggtgtgcagcacctcggcgaccgcaccgacccgccggccgccggtggtgcgcacctgcaggccctcgagttgatggtcgtagtaggtgtcgggctcgtcgatgtcgggcaactcggcggagtcgacgacgaacagggtgccgcgcagcgcgtcggcggcgtcccggtcggtgacgccggccagccgcaccagcagccgcccgccgtgctcacgcgcgctctcgatgacgcagctgcgttccgggccgccacgggaaggcttggcgcgcaacgtgttacccggtgcgaatcgggcggcgggatcgtcggtgcggatctcgacgacgatctcaccgctgatgccgtgcgctttgaccacgcgcccgacggtcaactccaagggagttccctactggtcggtgtccaccacgtcgacgcggatcccgcgtccgccgatgccggcgaccagcgtgcgcaacgccgtcgcggtgcgaccgccgcggccgatcaccttgcccaggtcgtcggggtggacgtggacttccacggtccgcccgcggcggctggtcaccatgtccacccggacgtcgtcggggttgtcgacaatcccgcgaaccagatgctcaacagcgtcaacgacaaccgtgctcatgaccgcggtcagctctcggcgctcgactcggcctgctcgccaccctcggccggcgcggcggcggcctcaggctcggctgcttccgacgcggcggcttccggctcggcggccttcgcggccttcttggcccccgacgtcgcggccttcttcttcggcttggcggcctcggtggtcggtccgccctcggcctcggccagcgcggcgttgaacagctccagcttgctgggcttgggcggggcgaccttcaagcggccctcggcgcccggcagacccttgaacttctgccagtcgccggtgatcttcagcagcttgaggacgggctcggtgggctgagcacccacagacaaccagtactgcgcgcgctcggagttgatctcgatcaggctcgggtcttccttggggtggtagcggccgatgatctcgatggagcggccgtcgcgccgggtgcgggcgtcggcgacggcgatgcggtactggggattgcggattttgccaagccgggtgagcttgatcttcacagccatggttaagcgaattctcctgtgtggatcacgctgcaattcagcaatcggggcgggctgcccggatccggttttgcctcgcgtgcagccgcctattgtgccagaacggccgcggcgatcagaaatcgcgcgcgctcacatcaccttctggaagaccttggtctccacccgccgggtcatccgccagcccccgggcgtgcgtacgaactcgtcgtcgtaccagagcccgcagaacagcacctgatcggtgtcgccgcccagcaccatcgggttgaagcagatcacccgcgacgaggcggtgtccccgtcgatgcgcaccgagaagttgcccagcatgtgcgcgtacaccgggaagttgggcagcacctcggccagccacttcttcacctccgggtaccggccctcgatgccgcccagcgccgtgtagtcgatgtaggcgtccggcgtgaagacgtcgtccaggtcgtcgaatcgccggttgtcgatcgcggtcgagtagtccaccagcagctgctggatctccaggcggtcggagatctcctccaggctcaacatgcatcggacagtagacgaaaatcccctccgaaatggaccggaagttagactttgcggccatgcgcaagctctggaccgcggccgcggcgctgctgctcgtcggcgcctgcggtgcccccaccgccgcggcggacagcacccagccggccggctcgatcccgattcccgacggcccggcgcagacctggatcatcgccgacctggacagcggtcaggtgctggccggccgcgaccccaacgtcgcgcatccgccggccagcaccatcaagacgctgctggcccaggtggtgctggacgaggtgagcctggacgccaccgtggtcgccgacgccgccgacacccaggtcgaatgcaactgcgtcggcatcaagccgggccgcagctacaccgcgcgccagctgctcgacgccctgctgctggtgtccggcaacgacgccgccaacacgctggcgcacatgctgggcgggccggaggcgacggtggccaagatgaacgccaaggcggcggcgctcggcgccaccaacacgcacgcgtcgacgccgtccggcctggacgggcccaacgggtcggggtcgtcgacggcgcacgacctggccgtcatcttccgcgcggcaatggccaacccggtgttcgcgcagatcaccgccgagccctcggcgatgttccccggcgacaacggtctgcagccgatcaccaaccaggacgagctgctgcagcgctaccccggcgcgatcggcggcaagaccgggttcaccaacgcggcccgcaagaccttcgtcggcgccgccgcgcgcgggggccggcggctggtgatcgccatgatgtacgggctgatcaaggagggcgggccgtcgtactgggatcaggcggcgacgttgttcgactggggattcgcccagagcccgcaggccagcatcggctcgctgtaacaccgacgctcgccaccccgcgccacgccgcccccgccgcgagcagacacaaaagcgcccgattccccggcgtgtcgcgtgcttttgcgtctgctcgccagactcacggcggcagcgcggcgttcagcagcgcggtcaacaccgggatccggcgcgccgcgatttccggttgcggcagcacaccttccaccaccgcggcgccgtcgaacacgttgcgcatcagcgccaccagcaccgggaaggtgtcggccgggaaaccctcgacgccgggcagcgcgcgagacacctcgtcgatcttcgcggcgtactgcgcgagctcgtgttgcaaagtctccctgagcttttcgtcggtgcgcgccgcaaccgtcagttcgtagatcacggcgttgaccgggccgctggtgaggtcgcgcaggatgcccagcaccacttccagcaccggctggtcggcgggtatgtcggcgacccgcttggtgaaggactccagttgacggcgcaacacctccgaggcggtggccgccatgaagtcgcccatggtgtcgaagtgccggaacagcgcacccaccgacaccccggcccgcttggtgatcaccgccgccgaggcgcgggcgtagccgacctcgatgatggtggcgatggacgcgtccagcagccgcgcgacggtttcctcgcggcgctgttgctgggttctggccatctcaggcggtcaccctcggggcgccgaccctggcccggacccgctggccggcccgcaggtagcggcccgatttcacggtgtgcccgtagccgtcccggaattcgcccttgcggtggctgccgccgaagacgacgacgccgcccacgccggtggcgatgacggcgtcgtcgttgcggttgaccatgcggcgtaggccgccgtagaagggcaccgcttcctcgtggtaggcgtccaccgactcgtcgaggccggccgggtcgatcaccacgaagtcggcccggtcgcccgggcgcagggtgccggcgtcgatgccgaaccagtccgccagttcgccggtgaggcggtgcacggcccgctcgatcgtcaagaagggcgcgccggcggcctgcgcgtcgcgggtgcgcttgagcatgcgcagcgcgaagttgtagaaggccatgttgcgcaggtgcgcgccggcgtcggagaagcccatgtggatgctggggtcggcggcgagtttgtccagctgcttgggccggtggttggccacggtggtggtccaccggacgttgcgctcaccgttttccaccagcacgtcgaggaacgcgtccagcgggtgcaggccacgctcgtcggcgatcgcgccaaagctctttcctatcaacgacttatccgggcattcgacgatgaccgcatcgtaaaaatcgcggtgccacagcgacgggccgagcttgacccggtcgaattcgcggcggaaccgccgacggtaatcggtgtcggccagaagttcgttgcgctgcaactgatcccgcagatgcagcgcggccgtccccgcgccgaactcctcgaagaccggcagatcgattccgtcggaatacaattcgaacggcacgggcaggtgctgaaagcgcacgctggagcgcagcagtttgttgaggatgcgggtgcccagcccgaaggtgtgcacggccagcggcatggacttggcgtcggccgacaccagcatgctcatccggactcccctgccgcgaccgaagatccggctgctggtcagaaagaacatcagcgccagcgcggggttgtccagatccggtgcgctctgcaggatccggccgcggcggcgcagcacctcgatcagcttgcgccgttcccgccaggtggcgaaggtggacggcagcgcgcgggaccggaagcgttccccgtcgagcttctcgatggccgcatccatcccggacatgccgagcagcccggcgtccagcgcctcgtccagcagcgcggccatcttcgccagctcgtcgccggtgggccggacggcggggtcggtggcgcgatcgagccccagcaccgcggcgcgcagatccgaatgaccaagcagcgagccgacattgggccccagcggcaatgcgtcgacggccttgacgtagtcggcggccgtcgaccaggtccggttggaaatcagtgcgccgtaaacgtattcgcgcggcaccgcctccacccggctgaacaggtcggcggcgtcctgcgaatcggcgtagacggtggacagcgagcagttgcccagcagcaccgtggtgacgccgtgccgcaccgactcgcgcaggccgggatcgagcagcacctcggcgtcgtagtgcgtgtgcacgtcgatgaatccgggcagcacccacttcccggcggcgtcgatcacctcggggcagccggcctcgtccagcgactcggccacgtccaccagcacgccgtcccggatgccgagcgtgcgggtcagcgccgcgccgccggtgccgtcgaaccacaatccgtcgcgaatgatcacgtcgtaaggcatggcgtcctccaagtcgcgggctgccggaacgctaacatagatagcaagcactcgcaatcttttgcgccgagatccgctcgccgccgaccggtctgccccgccgggtgcgacgcgccgggttaggcaggagaacgaaagatgttgccgcgcaacatgatcagatcgggatttcgaagtacggccggcccggagcgcggatcctcggcgaagcacaacaggtcggccgacgcgccgtgctcgagtccgggccggcccagccagcgccgcgcgtcccagcacgccgcccccagcgcctgcgtcgccgtcatcccgatgcccttgagcgcttccacctcgtcggcgatgcgcccgggggcgaccatggtgccggcgtcgctgccggcgtagatcggcacgcccgcctcgcgagcggcggcgatccgggacgggccgcgcgcgtacaggtcgcgcatgtgggcggcatacgtcgggtacttggcggcggcctgggcgatgccggggaagttctcgacgacgttgaccagggtgggcaccagcgcggtgccgcgggacaccatcagctcgatggtgtcgtcggtcagcccggtgccgtgctcgatgcagtcgatgccggcgttgatcagcccgggcagcgcgtcctcgctgaagacgtgcgcggtgacccgggcgccgtgcgcgtgggcggtgtcgatggcggccttgagcacctcgtcggaccacaacggcgccaggtcgccgacgctgcggtcgatccagtcgccgaccagcttgatccagccgtcgccccgtttggcctcctgcgcgaccgcgtcgggcagctgccactcgtcgtcgagctcgcgggagaagcccgccgcgtaccgcttgggccgggccaggtgtttgccggcccggatgatgcggggcaggtcgtcgcgatcgtcgaggctgcgggtgtcggtgggcgagccgcagtcgcgcaacagcagcgcgccgacgtcgcgttcgatctcggcctgggcgatcgcctcgtcgagcgggatctcaccgtgctcaccgagcccgacgtgacagtgggcgtcgaccagcccgggcacgatccagccgcctccggaagccccgaagacggtgtcggcgccggccaccggttcggtgctgatccgcccgtcgacgacccagagttcgatcgggccctcgtcgggcagactccgaccgcgtaggtgccagcgcacggcggctacttgttgcccgggaacttcagcttggacaggtcgaagtcggccagcccgggtggcagctcgttgaggccctcgggcagctgcgacaggtcggggaacccggccggcatcccgggccccagcgggctgcgcacctccggcggggtggggccgcgcgcgcccttcttgcccttcttggctttacctttggcgcccttggcttttcgcgtcgccgacttgcggcccagcccgggaatccccatgccgccgagcatcgacgacatcatcttgcgggcctcgaagaagcggtccacgagctggttgacctccgacaccgtcacgccggagccgttggcgatgcgcagccgccgcgacgcgttgatgatcttcgggtcggcccgctcttcgggggtcatcccgcggatgatggcctgcagccggtcgagctgcttgtcgtcgacggcggccagcgcgtccttcatctgcccggcgccgggcagcatgcccagcaggttgccgatcggccccatcttgcggatggccagcatctgttccaggaagtcctcgagggtgagctcgccgctgccgatcttgacggcggcggcctcggcctgttcggcgtcgaagacctgctcggcctgctcgatcaggctcagcacgtcgcccatgcccaggatgcggctggacatccggtcggggtggaagacgtcgaagtcctccagcttctcgccggtggaggcgaacaggatcggcaccccggtgacctcgcgcaccgacagcgccgcgccgccacgggcgtcgccgtcgagtttggtcagcaccacgccggtgaagccgacgccctcgcggaaggcctcggcggtggtgacggcgtcctggccgatcatcgcgtccagcacgaacaggatctcgtcggggtcgatggcgtcgcggatggccgcggcctgggccatcagctcgtcgtcgatgcccagccggccggcggtgtcgacgatgacgacgtcatggtgcttggcccgggcctcggcgaggccctgtgcggccaccgccaccgggtcgccgggcccggactcgggtgaggcgccgggatgcggcgcaaacaccgggacgccggcgcgctcgccgacgacctgcagctggttcaccgcggcggggcgctgcaggtcgcaggccaccagcagcggggtgtggccctgcccgcgcagccaggcggccagcttgccggccagcgacgtcttaccggaaccctgcagaccggcgagcatgatcacggtcggtggagtcttggcgaacgcgagctggcgggtctcgccgcccaggatgccgatgagctcttcgttgacgatcttgacgacctgctgcgccgggttcagcgcgccggacacctcggcgcccttggcgcgctccttgatccgggtgacgaacgcgcgcacgacgggcagcgacacgtcggcttccagcagcgccagccggatttcgcgggtggtggcctcgatgtcggcgtcggtcagtcgacccttgccgcgcagtcccgcaagggcaccggtcaatcggtcggacagcgattcaaacacgacgccagcctagtggcactgcaagcgccgcgaagcggggcgcagcaggtgccgttcggcgcgagcgtcacgctggcgtgaccctcggcgtcgagcgccacgccggcgtgacgctcgacgggggttgacggcgcgacgccggcacagaaaagtcagctcatgctcgaggtgatcgagaaggggtccggcagcgccgagcacccgacgccgctgctcttcgtgcacggcggctggcacgccgcgtggtgctgggagaacttcctggacttcttcgccgacgccggctaccgcgcggtcgcgctcagcctgcgcgggcacggcgccagccccacgtccaagccgctgcacagggtctccatcgccgactacctggacgacgtcgccgcggtggccggcgagctgggcggcgcgccgatcctgatcggccattcgctgggcggcttcgtcatccagcgctacctggaaacccaccgcgttcccgccgcggtgctggtggggtcggtgccgccgcagggcgtgctcaggctggcgctgcgggtctggcgccgccggccgtcgatgaccatggaagcctggaacgaccccaccctgctgaaattcctcgccaccccggcgctggcccgcgagtacctgttctgcgccgccacccccgaggcgatcgtcgaatcctgccggcaacgcgccggggccgaaagcgtgcgcgccgccatgaccgatccgatgctgcgccgggtcaggacccgacgggtcagcacgccgatcctggtgctgggcgcgacgcacgacggcttcgtcagcgccgcggacgtgcgcgccaccgcgcgggcctaccgcaccgatccggagttcttcgccatgggccacaacatgatgctggaaccgggatgggtcgcggtcgccgaacgcatccgcgactggctgcaggccccgacggcggcccgtcaccgctagccggtcgagtcgctcccgcaccgaaaaccgttggcgtgctagatttcacagccgccgctcaatcgagctggccgcgtcgaggagcaacgattgggggcctgtgtcggtgccggtcagcagcttggatccgcgcgccggcaacgaccacagcgaccgctccggtgcgctgcgcggctggcagcgccgggcgctggtgaaatatctcgccgggcagccccgcgatttcctggcggtggcgaccccgggctcgggcaagacgacgttcgcgctgcgggtggccgccgaactgctcggccagcgcgccgtcgagcaggtcaccgtcgtggtgcccaccgagcacctcaaggtgcagtgggcgcaggccgcggcgcggcacggcctggcgctggacccgcggttctccaacagcaacccgcggatcgcgccggagtaccacggcgtgatggtgacctacgctcaggtcgccgcgcaccccacgctgcaccgggtgcgcaccgagcagcgcaggacgctggtcatcttcgacgagatccatcacggcggcgacgccaagacgtggggcgatgccattcgcgaggcgttcggcgacgccacccgccggctcgcgttgacgggcacgccgtttcgcagcgacgacagccccatcccgttcgtgcgctacgaggccggacccgacggggtgcgccgctcgcaggccaaccacacctacggctatcccgaggcgttggccgacggcgtggtgcggccggtggtctttctggcctactccggggaggcacgctggcgcgacagcgccggcgaggagcacgcggcgcggctgggcgagccgctgtcggccgagcagaccgcgcgggcctggcgcaccgcgctggacccggccggggaatggatgcccgcggtcatcgcggcggccgaccagcggctgcgccagctgcgtgcccacattcccgacgccggcggcatgatcatcgcctccgaccgggtcgcggcccgcgcctacgcgaccctgctgaccaagatcacctcggagacgccgaccgtggtgctctccgacgaccccggatcctcggcgcgcatcagcgaattcgcggcgagcaccagccggtggctggtggcggtgcggatggtctccgagggcgtcgacgtgccgcggctgtcggtcggcatctacgccaccagcgcctccacgccgctgttcttcgcccaggcggtcggccggttcgtgcggtcgcgccgcccgggcgagaccgcgagcatcttcctgccgtcggtgcccaacctgctgcaactggccagcgagctggaggcccagcgcaaccacgtgctgggcgagccgcaccgcgtctccgagggcgaccccctcgacggcgacccggccacccgcacgcagaacgagaagagcgaactcgacaacggcttcacctcgctgggggccgacgcggaactcgatcaggtcatcttcgacggctcgtcgttcggtaccgccgccccggccggcagcgaggaggaggccgactacctcggcatcccgggtttgctggacgccgagcagatgcgcgccctgctgcaccagcgccaggacgagcagctgcagcggcgggccgggcagccgtcggcgggcgacgccccgccggcgacggtgcacggccagctgcgcgagctgcgccgcgagctcaacacgctggtgtcgatcgcccatcatcgaacgggcaagccgcacggctggattcacaacgagctgcggcgccgctgcggcggaccgccgatcgccgcggccagccgcgaacagttgcgggcccgcatcgacgcggtgcgccggctcaacgccgagcactcctgacggcccatcacggccgctagtcgccgaccggttcctcgagcacttccacggccggaccgcccagcaccgtgagcaggctttgctcgacggcgccgcgggcgccggcgtcgccggccgtgacgcagaaggcgtcggccgcggtcgagccgaaggtgttgaccttcgcccagacgatgtcggtgccggcccgctccagcgcccgggtcagcagggccagcagcccgagccggtccatggcgcggacttccacgatcagctggtcggccgcggcggtgtcgacccacaggatgcgcggcggcgcggtcgaccgggtgacgggcaccccgacctggacctcgccggcccgcctggtggccgcgccgacggcgtcgctgtcccgcttctccagcgtgcccagcacgtcgacgtcgccgcccagcgcgccggtgaactgctggcgcagcaggcccgcctccgggggcgaaccgaacagcggcgacaccacgaattcgacgaccgcgaatccctcgtgcgtgctggccgaggccgagtggatccgcagcgagttcagcgccagcaccgcggcggccttggacaccagtccgcgttgatccggcgcggccatcaccacgtccagccgctcgccgccgccgggcttgatctgcacatgcacgccgcggtcggcggcgagcgaaaggtattggggcgcagcaggttcgaccttcggaagcggctcccccgccatcaccatccggcagcgccgaaccagatcgtcgatcagcgacgccttccagtcgctccacacgccgggcccggtggccttggagtccgcctcggtcagcgcgtgcagcacttccagcagcagcgggtcctcaccgagcgttttcgacacccgctcaatggttttcgggtcgttgaggtcgcttctggtggcggccaccggcagcaacaggtggtggcggaccagctgcgcgagcagctcgacatcggcgggcgccatccccagccgcggcccgatctcgagggccagccccgccccgagcacgctgtggtccacaccgcggcccttgccgatgtcgtgcagcagggcccccagcgcgagcaggtcgggccgggccacccgggtggccagcggcgcggcgttgaccgtggtctcgatgacgtggcggtccaccgtccacttgtgcgcgacgtcgcggggtggcaggtcgcggatggcgtcccactccggcaacagccggccccacagcccggtgcggtcgagcgcctcgatggtcgtcaccgtggtcggccccgccgacagcagcaccagcaggtcgtccagcgcctcccgcggccagggctccggcatctcgggcgcggcggcggccagccggctcagcgtggccgcgccgatcggtaaaccggtgctggccgacgcggcggccacccgcagcaccaggcccacgtcggtgtccgggcgggcgtcgcgggccagcacgatctcgccggcgtactccaccacgccctcgtccagggggcggcgcttgggccggcgcaccagggccgacaccccgcggcgcggcagcgcgttctccgcggtgcgcagcccggtctcggcgtgataggcgatggtgcggctggcgtcggacagcttgcgggccaagtcgaatcggtcaccgatgtgcagggccgcgctcagttcgtcgccgtactgggccagcagctggtccagcccgcgtccggacacccggtgcagctcggtgcgcacatcgagcaacgtcagatgcgcgtcgtccagcgagccccccggcgactcgggccgagccatgccgtgccggtcgatcagctgcgccacgcccagcgcgtccagcagctgcacatcgcgcaggccgccgcggcccgacttcagatccggttcggcgcgctgcgcgatccggccgcaccggtcccagcgggcctgggtcatctccaccagctcgtccatccgggagcgaattgcgctgcgccactggcgtcttgcgccggcgatcaactcgtcgctcaaccgcgcgtcaccggcgacgtgccgggcgtccagcatgcccagcgccgcgatcatgtcgccgtaggcgacaccgagcgccccggacacggttcgcacgctgtggtcgagccgaacgttggcgtcccacaacggataccacagcgcgtcggcgacccgctgcagcacctcgtcggacttgttgtcgtgcaacagcatcaggtccagatcggaatacggcagcagctcgtggcggcccaggccgccgatgcccaccagggcgaagccgctgtcgtcggcgataccgatctgggccgccttggcggccaaccacgattcgtgcagatccagccaggcgtgccgcagttcggcggcgtgcagcttgccaccctcggagagaagctgacgccgcgaggcagccaaatcgactgccccgcaagcgttttggtgcccggacggatcggggccggtcggggtcatgcgaccggcgcccgcccggggtgtatcagcaattggcgaaaggcgtcacagcgcatcggttccgcgctcgccggtgcgcacccgcacgatggtttccaccggactcacccacactttgccgtcaccgatcttgccggtgcgcgccgcccggacgatgctgtccaccaccttgtcgacgatcgagtcgtcgacgacgacctcgatgcgcaccttgggcacgaagtcgaccgagtactcggcaccgcggtagacctcggtgtgacccttctgccgtccgtagccctggatttcgctgaccgtcatgcccaggacgcccgcgtcctcgaggctggtcttcacgtcatcgagcgtgaacggctttacgatcgcggtgatcaacttcatgactgctctgcctccactttgtcgcccactcgctgctcctccaggccgttgcgggtatccgccacagcgacccggggcgggagaaccgagccggtagccacggcgaaatcgtaaccactctcggcgtgctcagcctcgtcgatacccgaggcttcggcctccgggttgagacgaagccccatcgtgtacttcaggatcaacgccaggatcagcgtaaccaccccagagtagatgaggacgctgaacgcgccgaccgcctgccgttccagctgcgcccagccgccgccgtagaacagtcccttggacacgccggtaacgccgctgatggccgggctctccggggcggccagcaggcccaccagcagggtgccggccaacccgccgaccaggtgcaccccgaccacgtcgagcgagtcgtcaaagcccagcttgaatttcaggccgaccgccagcgcgcacaccacgccggccaccaggcccaccaccagcgcgcccagcacgttgaccgacgagcaggacggggtgatggcgaccagcccggcgacgatcccggacgccgcgcccaacgtggtggccttgccgtcgcggatgcgttcggtgagcatccaggccagcatcgcggtggcggtcgcgatcgtcgtcgtcatgaacgtcgaccccgccgcgccgttggagctggtggccgatccggcgttgaacccgtaccagccgaaccacagcagcccggcgcccagcatcacgaacggcaggttgtgcggccggaacaacgtggtgggccagccgcggcgcttgcccagcacgatcgccagcatcaggcccgccacaccggaattgatgtgcaccgccgtcccgccggcgaagtcgatcgcgtgcagcttgttggcgatccagccgccgtgctcggaggcgaagccgtcgaacgcgaacacccagtgcgccaccgggaaatagacgaacgtcgcccacaggccggcgaacaccagccaggcggcgaacttcagccggtcggacaccgcgccggagatcagggcgacggtgatgatcgcgaacatcagctggaaggccacgaacacggtggccggcagcgtgccggccagcggaatgtccgttgccgcagtgcctttgctcgggtcggcggccaccgcgttgacgccgatgagacccttgaggccccagtaggacgtcggcttgcccatgaagttgccgacgtcgtcgccgaaggcgaccgaatagccgtaaagcacccacagcacggtgaccacgcccatcgcgctgatgctcatcatgagcatgttcagcacgcttctggcgcgcaccatcccgccgtagaaaaacgccagacccggcgtcatcaacagcaccagcgcggaactggccagcatccaggcggtatcgccggtattgggctggcccagtatcgggtatgtcactcgcaatctcctccggtcggcccgcttctggccatcagacatgcgtccgatgacctgatccagaacattgcgcaatggttgtttcggcgatagtgccgctgtgtttcggcgggattaacgtcccgcggggccgcggaggggttttcagccgagcagcgcgtcgacgaaggcggccggctcgaacggcgccagatcgtcggggccctcgccgaggccgaccagtttcaccggcaccccgagttcctgctgaacgcggaagacgatgccgcccttggccgttccgtccagtttggtcagcacggcgccggtgatctcgacgacctcggcgaacacccgggcctgggccagcccgttctgcccgatggtggcgtcgagcaccagcagcacctcgtcgacggcggcgcagcgggtgaccacccgcttgaccttgtcgagctcgtccatcagcccgaccttggtgtgcagccggcccgcggtgtcgatgagcaccacgtcggcgccggcggcgatgcccttgtcgacggcgtcgaacgccaccgaggccgggtcggcgccctcggcgccgcgcaccacctccgcgcccacccgtgacgcccaggtctgcagctggtcggccgcggcggcgcggaaggtgtcggccgcgcccagcacgacgcgccgcccgtcggcgaccagcacccgggccagtttgccgacggtggtggtctttccggtgccgttgacgccgacgatcagcagcaccgacgggtggtcggcgtgcggcagcgcccggatcgagcggtccaggtcgggccgcagctcgttgatcagcacgtcgcgcagcacggccttggcgtccgcctcggtgcgcacgtcgctgctggccagccggccgcgcagctgggcgatgaccgattcggtgaccaccgggcccaggtcggcgaccagcagggtgtcctcgacgtcctgccaggcgtcttcgtccaggtcgccgccgccgatcaggcccagcaggctgcggccgagcgcgttctgggagcgggccagccggccgcgcagccgctccagccggccctcggtgggcgcgatctcctcgatctcgggagcgggggcctccggagccggcgcctcgggagattcgggagcctcgggggccggggcctcagcagccggcgccgccggcgtctcgggttcgggaagctcgacctcggagatggtgcgtcgcggcgcgtcccgggggacggtggcgtcgtcgcctaccgccggcaggccggtggtgtcgagccgctcggccggctgggcggtcggtgcctggctgaacgtgatgcccgaggacgcggtgtatccgccggaccggtcgatcgccccgggttcggggcgggtcgagaagctgatccggcgccggcggtaccgcgccaggcccaggaccagtgcggtgatgacgaccaggacggcgatgacgacgaggaccgcgacggcgatccaaagaccttgggacacgctgacattgtttcaagcggacccgtgccgcccggccaccgggcctcgaccgcccgccatccgcgctgctcaggtggtgaccagctggtccacctgctgaccgcgcatccgctgcgagatcaccgcggtgatgccgtcgccctgcatggtgacgccgtagagtgcgtcggcgacctccatggtcggcttctggtgcgtgatgatgatcagctgcgagcgcgcccgcagcagctcgaacaggctgatcagccgccgcaggttggtgtcgtcgagggcggcctccacctcgtccatgatgtagaacggcgacgggcgggcccggaagatggccaccagcatggccaccgcggtcagcgccttctcgccgccggacagcagcgagagccgggtgatcttcttgcccggcgggcgggcctccacctcgatgcccgtggtcagcatgttgctcggatcggtcagccgcagccggccctcgccgccggggaacagcacgccgaacacgtcggagaattcccgttcgacgtcggtgtaggcctcactgaacacctgcaggatgcgggcgtcgacctcgtccaccacgccgagcaggtccttgcgggcggccttgacgtcctcgagctgggtggacaggaagttgtagcgctcctcgagcgccgcgaactcctccagcgccagcgggttgacccgacccagctcggccagctcccgctcggcccgcttggcccgccgctcctgggtgggccggtcgaaaggaatcggtgcgggcgcgaagacctgttcgccgcgctccttggcctgctcgtattcggccatctccagctcgctgggcggcagcgcgatgtgcgggccgtactcggcgatcagatcggccggcgccatgccgaactgctcgagcaccatctgctcgagctgctcgatgcgcagcgccgcctgggcgttggccacctcgtcgctgtgcagcgagtcggtcagggcggctacccgggcgctcagcgcgttcacctcgtcgcgcaccgccgccatcgccgtggcgcgctgctggcgttcggcggccagcgcgtcgcggatccgcgacgcggcggccaccaccgcgttcaaccgcgttgctagcaaccgccccgaatcggccaccgccgccgcgaccgccgcggcgcgcagccgcgcctcgcgggcctgctgggcgcgcacccgggcctcccgttcggcggcggcggcccggcgcagcgaatccgcccgcccgcgcaccgcgttggcccgctcttcggcggtgcgcaccgcgagccgggcctccacctcggcgctgcgcgcggcgtcggtggccgcggcgatctgctggcggttcaccggttccgcggccggctcctgcggggtttcctgcgcgttgcgcagccggttttccagctcggtgacctcggcgacggtctgggtgcggcccgcctcgagctcctcgcgctggcgcagcaaccggctccactcgtcctcggaggtccgggcttcctgccccagccggcccagctgctcgtacattccggagatcgcgctgtcggactcgttcagcgcggccagcgcctgctcggccgaatcctgccgggcggcctgttcggccagcgcgccggacagcgccgcgctgagctgggccacctgagcctcggccgcggccagctccgcgccggccttgtcgatctccgaggtcacctccagcgtggacagtttgcggtcggagccgccgctgacccagccggcgcccaccaggtcgccgtcgagcgtgaccgctcgcaaccgggggtgctccgccaccagcgccagcgcccggtccaggtcgtcgaccaccgcgacgccggagagcatggccgtgatcgccccgcgcagccgctcgggcgcgtcgatgaggtcgagcgcccacagcgcgcccgccggggccggctgcggtgcgggcggatcggcgggccagtcgcccagcaccagcgcggcccggccgccgtcggcctgcttgagcgcacccagcgccgagcgggccgcgcccagcccgtcggcggccagcgcgtcggccgccgagcccagcaccgcggccaccgcggcttcgtagccggagcggaccttgaccagcttggccatcggtcccaaaatccctgcgccggaatggttttcggtcagccaggcggtgccgtccttgcgctcgagccccaccgccagcgcgtcgatgcgggcccgcagcgaggccaccttgcgttcggcgtcacgctcggcggcctgcagttcggccacccgctcgtcggccagacgcagcgcggcgacggtgcgctcgtggtgctcgtcgaggcccacctcgccctggtcgagctcgccgacccggccctgcacggtttcgaactccgccttggcctgctgcgcgcgggcggcggccgcctcgatgcgctcggacagccgcgccacgctgtcgtcgatcgactcgacgcgggcgcgcatcgtctcgacctgaccggccagccgggccagtccctcgcgccggtcggcctcggcccgcaccgccgccatgtgcgcccggtcggcctcggcggcttcgcgttcccgctcggcgagttcggcgcgcgcggtttccagccggctgcgcgccgtggccagctcggccagcagctgctgctcggcggccgcgacccgctcggcctcggcctccagcgcgtcggggtcggtgtcgccggtggtcaccggctccaggtcgaggtgctgggcccgctcgctggcgatgcggaccgtcgccgccacccgttcggccagggcggacagcgcgaaccaggtctgctggaccgactcggcccggccggacagctcgccgagcgccttctcgtgcgcggcgagctcgtcggaggccaccgccagccgcgccgaggcctcgtcgtgctcgcggcgcatggcggcctcggcctcgaagatggcctcgcgctcgccccgccggttgaccaggtcgtcggcagccagccgcagccgggcgtcgcgcagatcggcctggatggtctgcgcgcgacgggccacctcggcctgacggcccagcggtttgagctggcggcgcagctcggtggtcaggtcggtgagccgggccaggttggccgacatcgcgtcgagtttgcgcagcgccttttccttgcgcttgcggtgcttgagcacccccgcggcttcctcgatgaacgcgcgacggtcctcgggccgcgactgcaggatctcgtcgagcttgccctgcccgacgatgacgtgcatctcccggccgatcccggagtcgctgagcagctcctgcacgtccatcaaacggcaactgctgccgttgatttcgtactcgctggcgccgtcgcggaacatccgccgggtgattgacacctcggagtactcgatgggcaacgcgttgtcggagttgtcgatggtgacggtgacctcggcgcggcccagcggcgcgcgcgagctggtcccggcgaagatgacgtcttccatcttgccgccgcgcagcgtcttggccccctgctcgcccatcacccaggccagcgcgtcgacgacgttggacttgcccgagccgttgggcccgacgaccgcggtgatgcccggctcgaaacgcagagtcgtcggcgaggcaaaggacttgaagcccttcagcgtcagactcttgaggtacacggccagccagactaccgcccaaatcggcccgcaccgccgcagcgcggggtgtcggccggcccgaaatcgggccgcgttccgcacattcgacgcactggtcacaatggtcacatcagccaccgcttgggtgcacgctcgccctccgaaacgcgctggtgccggcgctagcagggtttcgaactcggctgggcgcggagcctcagcgctcgacgaatccctcgaaccgctcctgcggcgccgaccagtcggcgaccaccttgtccacccgcccgggccgcgacggccacgtcgtgccgccccgcagcagctccagcagcttctcgccggccggccgcggcccctgggcgaccaccagcacccgcccatcgggctggttggcggcgtagccggtcagccccaattccagcgcccggcaccgcgtccaccagcgaaaacccacgccctggacgtgcccgtgcacccaggcggtgagccgggcgtcaggctccggcatggccggccccggcggcgatctcgaagttgaccgtggtgcccgaggtgagcgtgcgcccgaccgtgcacacctggtcgaccgcccggtggaccaccagcagcaggcgctgcctgtcctcgtcgctcaaccccgacaggtccagctccagcgtctcctcgagcagcggatagcgctcctgctcgcggtcggcggcgccggagacccggatgaccgcccggtagtcgtcgcccagccggcgggccagcgggacatcgctggccatcccgctgcaggccgccagcgcgatcttgagcagctcgccgggggtgaacacgccgtcgacgtcctcggagccgatcagcacccgggctccgcgcgagctgtgtcccgtgtagcggcgagttccggtgcgctccacccaaagttcggccatggctcttttctaccgggcacccgcccggccacgcacgggcatactgctgtgcatggccaccgtcgtcgcgttccacgcccacccggacgacgaggtcgtgctcaccggcggcaccatcgcgcgggcggtggcggccggacaccgcgtcgtcgtggtgacggccaccgacgggcgggtgcacaacgaggacaccgaccaccggctcgacgaattacgttcgagcgcaaggattctcggtgcacagcgggtggaatgcctcggctacgccgacagcggctacggcccgctgttctacccggacccgccggggcgcacccggttcgggcgggccgacctcgacgaggcggccggaaagctggccggcatcctccgcgacgagcacgccgacctgctgctcagctaccaggccaacggcggttacggccaccgcgatcacgtccgggtgcatcacgtcggcaagcgggccgccgaactcgccgccgtcccgcgagtgctcgaggtgacgatgccgcgcgaaatgctgttgcgcatcagcgatctggcgcacctgctgcggcttcccgggccgtacgaagccgacatcgtcggcagcgcgtacgccccgcgggccgcgatcacccatcgcatcaacgtctttcgcttcgcccgccagaagcgggatgccttcgccgcgcaccgatcccagatcgggcgttccggcccggccgcccggctgttcgggctgctgctgcgactgccgccgcaggtgttcggcgcgctgttcagccacgaatggttcgtggacccggcgttgccgacgggcaccgtgcgccgcgacatcttcgactgatcgtcctcaaagccgcgggcgcggttggcatttcgggcagtagaacgacgagcggttcatgaacttctcccggcgcatcaccgcgccgcagcgccggcagctttcgccctcccggccgtaggcgtccagcgatcggtcgaagtacccggattcgccgttgacgttgacgtacagcgaatcgaacgaggttccgccctgggccagcgcgtcgcgcatcacctcggcggcggcgtccagcacggcggtcagctgcctgccggtcatcgtggcggcgatccgggcgccgtgcaccttggcccgccacagcgcctcgtcggcgtagatgttgccgatcccggacaccacctgctgatcgagcagctgtcgcttgatttcggagtgcttgcgccgcaacacttttaccaccgcggcggcgtcgaagcggggatcgagcgggtcgcgcgccaggtgcgcgacgggccggggcaggatgctgccgtccacctcgagaaggtcggcgagcatccagccgccgaaggtgcgttggtcggcgaagctcagcacggtgccgtcgtcgagcagtgccgagatgcggacgtgctcggcgcgcggcaccgcgccgagcagcatctgcccgctcatgcccaggtgcaccaccagcgcggtatcgcagccgtccagcagcagccacaggtacttgccgcgccggtcggtgccggtgatccgcgcgcccagcagccgggcggtgaggtcggcggggccggcttcgtggcggcgcaccgcgcgggggtgatgcacccgcaccgcgccgatcgtcttgcccaccacgtgcgcgtgcaggccgcggcgcaccacctcgacttcgggcagttcgggcatcgatccggggcgggctccggctaggcggacgtctgcgcggcggagtcgagcacgtcgagcgccttccaggtcgccgccgcggccttctgctcggcctccttcttggagcggcccaccccggtcccgtattcggtgtcggcgacgacgacgaccgcggtgaactccttgtcgtgatcggggccggtggaggtgaccaggtaggacggggcgcccatgccgcgcgccgcggtcagctcctgcaggctggtcttccagtccagcccggcccccagcgtgggcgcggcgtccagcagcgcgccgaacaaccgcaggatcacctcgcgcgcggtgtcgatgccgtgctgcaggtagatcgcgcccagcagcgactccatgccgtcggccaggatgctcgacttgtccgcgccgccggtgttggcctccccgcgccccagcagcagatgcgcccccaggccgccgtcgcacagcttgcgggcgacgtcggccagcgcctgggtgttgaccacgctggcccgcagcttggccaggtctccctcggtgcggtcggggtggcggtggtagagcgcgtcggtgatggtcaggcccagcacggcgtcgcccaggaattccagccgctcgttggtgggcagcccgccgtgttcgtaggcgtagctgcgatgcgtcagggccaacgacagcagctcgtcgggcagctcgaccccgagggcgtcgagcagcggctgccgtgagctcaccgctcgtcccgggcttcgtcggacgcgaacatgcccgccagcttcgcccagcgcgggtcgatgcggtcgtgctggtggccgggctcggcagccagcgacacgccgcattccgggcacagccccgggcagtccggccggcacacgggtgagaagggcagctcgaggcccaccgcgtcgatgatggactgctcgaggtcgacggtgtcgtcgacgatgtggccgacctcgtcctcctcggtggtcgcctcggtggtgctgtccgggtaggcgaacagttcggtcagccgcacccgcacctcgccgtccagggcggtcaggcagcgcgcgcattcgccgacggtgggcccggtcaccgagccggtcaccaggacgccctcggacaccgactggacctgcaggtccagatccagcggggcgcccgcctcgatcgcgatcatgtccagcccgatgcgcgccgggctgggcacggtcgtgcgcagggtgaccatcgccccgggccgccgccccggccgggtgatgtcgaacgtcatcggggaggctggccggggcgctgcgccgcggaccgacgatgtgctgtgctgccgcgtcatatcagaaatcctacggcgccgaccgcacaattccagggcgcgtccgccccgccagggtggtgctaccgcaccgcgtagtcgtgcgtgccggccgccgtccgcagctggtgacggccgcggcccaccgagcgcagcgtgccgttgaggaattcctcgaactcggcgagcttgttatcgacgtagatgtcgcattcgccgcgcagccggtcggcctcggcgtgcgccgagtcgatgagccgggtggcctcggcgtgggcggcctccaccacgctgttctgcgacaccaggcgttgctgttccttgatgccctcctggacggccttctcgtaggagatgttgccgttctccagcagccggtcggcctcggcctgggcccggctgacgctggcctcgtactcgcgcttggcggcggtggcgatgcggagcgcctcctcgcgggcctcggcgaccatccgctcgctgtgctgacgcgcttcgctgaccatccggtcggcctgggccttggcgtcggagagcacccggtcggcctcggcgcgggcgtggttgagcatcgactcggactcggtggtcgccgaggacaccatggattcggcgtgcgtcttggcgtcggacagcatcgagtcccgcgcgtccagcacgtcctgggcgtcgtccagctcgcccgggatggcgtccttgatgtcgtcgatcagctccagcacgtcgccgcggggcaccacgcagccggccgtcatcgggacgccacgggcttcttcgacgatcgcgctcaattcgtccagcgcttcaaacactcgatacacggccgtaccctcctggcgtctgcaaagatcctgttgttaccagtgtgcctggtgttgtctctgtgacagcggtggcgacgccggtgtgtcggggatttgcccgttcggcacccgctaaacgccggaacgcccacgcttctttgccggcgattctatgttcggcgggtcaggagtgaacttcgcggcgggcagtggctctcgagcgccctcacttcggtcactagctggccggcgatgatggcgtagtcgtttcggcgccgttgctgccgcggatcctgccagtcggccggatcggcccgcgcctcccggaccaccgctgtagcccgagccgacagggcggcggcgctgcggaggcccggagcgacgtcgccgcccgacgatgccgcgtaacggtcgagttgctcgctccacaactggtagtcggccagggtcggtccgccgctgttcgccgaaatgaacgcggggtcgagcatatcgggatgcgaggcaacgaagcgcgccatgtcgttggcggtgcggcagtccggcgactggcggtgagccaggtagaccgccgccagcgccccggtcgtcaccagcaccacggcggtcaatagcgccaccgtcgggcgccagcgcggtgaggcgggttcggtgcgcggcgccgcgcgcagggctgccgccgcgcccggaaagcgctgtgaggcgtcctgcaacaggatgattcgccgttcgactcgccgggcaacgagccagccgcgaaccccggtaaccgcgaggaacgcggcgaccaagcctttcaccgccatgcgcccgggaccgtcggcgttggtggctgtcagcgccagccagctgaccgtcagcaggccgtagctgacggcgatgcggttcggagtcgaccggccgaagccgagccggaggtgggcgatgcggatcgccgccaccagaacggccgccgacgcggggacgtcgccgcgcacgctcgccgcgatcgcctgcgcccgctcggcggtcgaggccgcgcgtcgcggccacgtactcgtgtgacgcccgccggccgacgattaccgcctgctgggcgaacagggcgctgacgcccaccaggaagaccagccgccacggccaggccatcccggccatcaggtcaggcatgagcagcggggccaacaggccgaacgtgacagcggcgacgcagcagtgcaccagccaccgctgccaccgcggcgccccgagaagtcggatccacacggggtggagtctgacaaacgcgtcgccgatccgcccctcacttataccctcccggggtatactacgccgggagggtcagcgcaggaggaatcgccatgacgacggtactgtcggcggtcgggcacgccctggccgtcgccgggtcgatgacctgggaaatcctgtgggcgctgattctggggttcgccctgtcggcggtggtgcaggcggtggtgcgccggaccaccatcgtggccctgatgggcgacgcgcgcccgcgcacgcttgcggtgtcggcgggactgggcgcggcctcgtcgtcgtgctcgtacgccgcggtggcgttggcccgtgcgctgttccgcaagggcgccgacttcaccgccgcgatggccttcgagatcggttccaccaacctggtggtggagttgggcatcatcctgacgctgctgatgggatggcagttcaccgccgccgagttcgtcggcgggccgttgatgatcgtggtgctggcgctgctgttccggctgttcgtgcgcccgcggctggtcgacgccgcccgcgcgcaggcgcagcggggcatcgccgggtcgatggaaggccatgccgccatggacatgtcggtggccggcgacggcccgttctggcgacggctgctctccgccgcgggcttcaccgcggtgtcgcacgtgttcgtgatggagtggctggcgatcctgcgcgacctggtgctgggcttgctgatcgccggcgcggtcgcggcgtgggtgcccgaaaagttttggcagagcttctttttggtggaccaccccggctggtcggtgctgtggggaccgatcgtgggcccgctggtggcgatcgtgtcgttcgtgtgctcgatcggcaatgtgccgctggccgcggtgttgtggaacggcggcatcagcttcggcggcgtgatcgcgttcatctacgccgacctgctgatcctgccgatcctgaacatctaccgcaagtactacggcacccggatgatgctgaccctgctgggcacgttctacgccgcgatggtcgccgccgggtatctcgtcgaattgatcttcggcacaagcggtctcattccggcccagcgtgccgcgacggtggccgaggcgtccgtctcgtggaactacaccacctggctcaacgtcgccttcctggtgctcgcgctggtcctgatcgttcggttcgtccgcacgaacgggctggcgatggtgcggatgatgggcggctcccccgaccccgccgagcatcggcactgagtgcttcagccgtgccgggccgcgtcccgggccgggcgtccctaggtttgcggcagccgcacgtcgagcaccgcgcaccggccctggcccgcctcgtccagcgcccacccgatggcctcgcgcatctgcgccggggtgtgcacgtcgcgtccgctgcccccgcaggcccgggccagcgcggcgtagtcggtctccggggtcagccgagtttcgggaaagtcgttgtcgcgcacggatattccctgcgggtacagctccgtcaccggcgtcttggaggccaggtaggagtggttgttcaacacgacggtcacaaacggcgcgccgtagcgatgcgcggaccacagcgcggcggtgggcaccccgaagttgaacgacccgtcgccgcagatcgcgacgacgggtgcgtgcggccgggccagtttgatcccgaaggcgccgcccagcgcccagcccaaagccggtgcgccggtgtcgaagagctgcccgggcggccgccgcacctggcgggccaccgcgggccggttggtcacggcctcctggacgacgacggcgtcgtcgggcagcgcgccgccgagcgcggccagcatcgcgtcgggggcatcggcgtcgctgtcggactcggcccggcgcgccgcttcccggcggcgttgcgccacttgggattccaccgcgccgcggcgggtgctccacttttcgcgcagctcgtcgttggccagccgcagcagggtctgctcgagcagcagcagcgcgacccgggtgtcggcggtcaacgcgatttcgaccgggtaggaccacagcggcatgctcggcttgaccgggtcggcgtcgatctgcaccacccgggccgtcgcaggcggggccaactgtgcgggcacccacggcacttcgctgtccagcagcagcaccgtgtcggcgtcctgcagcggggccgcgtcgccggtgacgtgcagcggatgcccgggcggcaggttggcgcggtcgccctggtcgatcaccggcgctccgaggatctcggcgatgcgagccagcacggtcgcggcggccgggtcggcggcggtgcgggcggtgacgatgaccacccgctgcccggcgaccaggatcccggccagccggcccagcgcggcggggtcggggccgggcggaacggccggcggcagccgtcgctgcaacgcccggccgccgggctccatcagggcttcgcgcggcagcatgacgtaggccggtccgggcgggctggactgggcgacctggaatgcccggcggacgatgggggccagctcacgcccgcgcggaacctccatgtgccacttggcgtaattgcgcatcacggcgggctggtcgagttgttcctgctgccaatggatgtgggtgtcgcggtggccgcggacgtcgggcgccgagctgtagggggtgcgcccggcgaataccaccaccggggttccgttgcgctgcgcgttgtgcagctggcagcccaggttcagcgtcccggcgtcgacgtgcaccatgaccgcctgcggccgggcgctggccatgtggtggccgatggccgccgccagggcgacgctttcgtgcacgcacagcaccgcccgcgggctgggcgtaccggcggcgcgcgccgccgcgagcgcttcctggatgggcgccgagtcggttccggggttgatgaagaagtccgcgactccctcgtcggccaggagcgcgatcaggtccgccgccgcctcgggtccgtcgagtggattgtctagcgtcatggctgccgttctcctatcgacgtcgccgacctcgcaaatccccctcgtgtctcggatgagatcttcaagatacgttccgcgtcggcgttgttgatcctttttcgacggggctcggcggtgcggggtcgaagccaacgggtaccccggcagcggccggctactccatacggtggttgccgtgtcaaagagcttgccgcttaacggtttcgatgttggatggcgagctttcgcggggcggtcgggcaccgccgcggtttgacggccgaaacttgtcggaccccgttgtcatgatgttgtcatgtcctcgagcgtgctggcagctgaggtggaggtgcgtccttgcgatcggttggcggtgctgtttgacgagttggcggagttgaccgggcagcgtaatgcgattgatgggcgcatcgtggagatcgtcgcgcagatcgagcgcgagcagctgtggggagccaccggggcgcggtctcttggcgcgctggtggcctggaagacgggctgctcaccgggcaatgccgagacgatcgcggccgtggcgcgccggttggactcgtttccccgctgcgcggccggtctgcgggagggccggttgtcgctggaccagctcggggtcatcgcgcagcgtgccggggcgggatccgatgcgcattacgcgcagctggccacggtggccacggtcaaccagctgcgcaccgcggtcaagctggaaccgcggccccaacccgaggccaagccggcaccgcagcccggcctcaccaagacctccgacgaggagctcagctgctggcggatcaagctcgaccgcctcgatgcggccacattcgacgccgccctggccgcgcaccgcgaagcgctgatctccgaatggaaacgcgaccacaaccaccgggccggcgagtcggtgccgccgttgccgggcacgctggaggcgtttatccgcctgatcgaaaccggctgggacgccgaggcgcaccgccgcccccacggccaccacaccaccgtggtggtccacctcgacgccgcccaacgcatcgccggcctgcatttgggcccgctgctgtccgacgccgagcgccgctatctgacctgtgatgctacctgcgaggtgtgggtcgaacgcgacggccaacccatcggtgcgggccgctcgacccgggtgatcaaccggcggctacgccgcgccctcgaacaccgccaccgcggctgcgcgatccccggctgtggcgccacccgcggcctgcacgcccaccacctgcggcactgggaagacggcggccccaccgaactgtccaacctggtcctggtctgcccctatcaccaccgcgcccaccaccgcggcgagatcaccatcaccggccccgccgacaccctcctcgtcaccgacagctccgggcgccacctgaaaccaggatcactggcccgcaaaccgaccagacccccacccgccgtcccaccgtgccccggacccctcggccaacgcgccgactggtggtggtacgaccccttccaaccccaaccaccgccaacaacgaattaggcgcgtagcgcctcactaaatcccttgtgggccaatgctttacgtgtcgaccgagccgattcaggaacgcccggaaagcttttcgcgcaagcggcggttgaccggttcgggcagcagctccgacacgtcaccgccgagcatggcgacctccttggccagcgacgacgacacgaacgaatagcgcggcgcggtcgcgacgaaaaacgtgtccacaccggcgatgtgcttgttcatctgcgccatctgcagctcgtattcgaagtcggtgccggtgcgcaggcccttgacgatggcggtcatgccgcgcgacctgacgaagtcgaccaccagcccctgtccggcctccacccgcaggttgctcagatgcgtagtcgattcctcgatcatcgcgatccgctcgtcgaggtcgaacatgcccttcttggcgggattggtcaggatcgcgaccaccacctcgtcgaattgggccgacgcgcgctcgaagacgtcgacgtggcccagcgtcaccgggtcgaacgacccggggcacacggcgccggtcatgcgggccgtcccggcctggcgggtgaattcggagcggcgcccatgacgaacgacggtacacgcccgctcacagccgctcggccagctccaaacgagtgtcaccgtatacccgatgcggccaaccggaccagccgggaggccagctcagcggcgcgctgccggcggggcgctccaccaccgcgacgctgcccgcgcgcacccagccgtgcgcggccagcgccgccagcacggcgtcgatctcggcggcgcccacgtcgtagggcggatcggcgagcaccagatcgaccgcggtcgcggcgccgccggccagcacggccgcgaccgcgccgcggcgcagcgtcgcaccgggcagccccagggtgtcgatgttgcgggcgatcaccgccgcggcgcgcgggtcggactcgacgaacagcgcggtcgctgcgccgcgggagagcgcctccaggcccagggcgcccgaaccggcatagaggtccagcaccgccaggccggtcagctcgcggcgcgcggccaggatgttgaacagcgattcgcggacccggtcggtggtgggccgggtgccccggggcggcacggcgaggcggcgacccccggccacgccgccgatgatccgggtcatccgcgcgcccctacagcagcgtcgaccaatagtcccagaaccggaccatgatcagcagaaacaccgcggtgaaccacagcgcgacgatcgaccaccgccactggaacagcagccagcccgggccggaccggcggtcccccagcgcagggcggtaggcgatcgaggcgaccaccaccagcagcgcgatggtcaccacccacaccaccatgcagtacgggcacagcgcgccgatgcgatacaggctctggaagatcagccagtgcacgaacaccgcgccgaccaccagacccgccgccagtccgatccaataccattgcggcagaaccactttcgtcaccgccagcaggccggtgaccaccaccacggtgaacgccaccaggccgagcagcgggttggggaagcccagcagcgacgcctgcggggtgatcatcaccgacccgcaggacaggatcgggttgatgttgcaggacggcacatacgccgggtcgagcaggatgtcgatcttctccagcgtcagcgtcaccgacgcgaccaggccgatcaccccggcgaccagcaccgaccaggcgctcagcgccggcaccgccggcccggccggcgaatccggggtcaggccggtcgcttccgtcgccaccgcaccggtcacatggcggccggcgcgaccgcgccgtccagccccgggatgtcgcccacgatctccttgatcttgccgaccagggcatcgggcgtggacgggtcgtagtcctcgccgttgatcttgatcgtcggcgtggcgcggatcttggcggccgccgcctcgccggtgaccttggcgatgtacttgccgctgttgatgcagtccggaaccttgcccaccacgccggattcgcgggcgagctcgatcagccgcgcgttgtccgggaacgtcttgccggtctcgctgggctggatggcggtgctgaacaacgcggtgtggaaccggcggaacgcgtccagggactcgtcggcgacgcacagcgccgcggcgccggcccgcgacgaatagttctggtttcgcgggctgtcgaggatcgacaccatcgagtagtcggccgcgatggcgccgaggtcgatcagcttggacaccgtggggccgaaggtgcgctcgaagttgccgcaggccgggcacaggaagtcctcgtagagggtcacgacggccttggggttgctgctgccgggctgggtgatcagcttgctcgacgtcacccgcaccgtgtcgccggcgccggtgggcccggccttcttgtggtgcgaggtcacgatgtagaagaccagggcgacggcgaagatgacgacgaacgcggtgccgccgatctggacgagtcgcccggacttaccgccggaggccgacttcatgtcgaatcgcgggggacgtttggggttgtcggccacgggttccctgatctttcgtcactcgagttgtcggtctgccgacaatgcgatcggacaaggcgcctctagattaccggcgccgcccgtcgcatggatcagacccggctcaggtgcgcgcgcagcgccgagatcaactcgctggtggccaccatgctgtcgccgccgagctggaacaggttggcgaagccgtgcgtcagcgaacccaggtaccgcaggtccaccggggtgccggcggcgcgcagcgcctcggcgtagctctggccctcgtcgcgtagcgggtcgaagccggccaccgcgatcagcgccggggccaggccggccagcgattcggccagcgccggcgatacccgcgggtccgtccggtccagccgcgagttccgcaggtactgcgattcgaaccagtcgatgtcgcgcttggtcagcaggaagccgcgggagaacaggctcagcgaccgggtccgggcggtgaagtcggtgcgcgggtagatcagccactgcagcaccggtgccgggccgcccgcgtcgcgggccagctggctgacgacggcggccaggttgccgccggcgctgtcgccgccgaccgccacccgcccggggatcgcgcccagctcgccggcatgctcatgcgcccaggtgaaggcggcgtacgcgtcgtcgatggcggccggcgcgggatgctcgggcgccagccggtagtcgatcgacagcacgtggatgccggcgtcgcggcaggtcagccggcacagcgagtcgtgggtgtccaggtcgccgatcgaccagccgccgccgtggtagaagaccagcagcggggcctgggtctcgccgccggcgggccgatagtgccgcgccgggatgtcgccggccgggccgggcagcgccagttcggcgacgtcgacgtggatctgcgggccggggaaccccaccgtggactcgtgcatctgggcgcgggacagctcggggtcgtcgtcgaccaccaggccgtcgatgccgacggcgcgcagaccggacagcatcagctgcagggtcgggtcgagcgtgttgccgtcgatgatgaccgagcggccgcgcaccaggccgcggcgcacggcggtcgggatccacgggatgaccttgaccccgacgctggtgacggcgccctggatgcggttggtcagcggcatcgacccgcgctgcgcgccggggtcgacgggtgcggtgtcggtcagcggcttggtcatggagctactccccctcgcacgaacgtgggaccgcccgacgacgaacggttgttcactgccccgtcgtcgccgtcgtcacggaggctaactgtacgtggtggcccgcccggtgctgaagggcgcggatggacacctgcccaggtcgtggtgaggagacatttgctcactcggtaagatcgtgatcccaaagtcggtgaagccttcacggattgcgagcaacttcgacgtgttcgatttcgatttcggcgccgaaacggcgttgacctcctcgcgcgatgacggcccccggctcgatgcacacgaacgtttgacttcacaggcaggtgaatgaattgactggcgagtcgggctccgccgcaccctcgattgctctcaacgacgaaaacacgatgccggtgctgggcctcggtgtcgcggagttgtcggatgacgagaccgaacgcgcggtgtcggcggcgctggaggtcggctgccggctcatcgacaccgccgcggcctacggcaacgaggccgccgtcgggcgcgccatcgccgcctcggggatcccgcgcgccgagctgttcgtcaccaccaagctggccacctccgaccagggcttcaaaggggcgatggacgcctgcgaggccagcctggagcggctcgggctggactacgtcgacctgtacctgattcactggccggcccccgcgctgggcacctacgtgaactccttcggcggcatgatccagtcccgcggcaacggccacgcccgctcgatcggcgtctccaacttcaccgaggagtacttgacgacggtcatcgacctcacgttcgtcaccccggcggtcaaccagatcgagctgcacccgctgctcaaccaggaagcgctgcgcaagaccaacgccgagcacaacgtggtcacccagtcctatacgccgctggcgctgggcaagctgaacgaccacccgacggtgaactcggtggccgccgaatacggcaagaccgcgtcgcaggtgctgctgcggtggaacctgcagttgagcaacgcggtgatcttccggtcggccaacgccgagcacatcgccagcgacttcgacgtgttcgacttcgagctggccgccgagcacatggacgccatcaacgcgctcaacgacggcacccggctgcgcccggacccagacacctacgagggctcctaaccgctaccccgcggggcaggtggccgcggcctgacgcagcacaccggtggacgcctggtccaccggcagcgcatagccgcgcagcaccgcgatgaactgcatggcgtattggcagtggaacgccgcgttcggcggcatccactgcgcgggcgccgcatcgcccttgtcctggttggcctgcccgtcgacggccagcaggttggccggatcgttggcgaaccgccgccgctcgggccccggccacgcgtaggcgcccatgtcccaggcgtaggcgagcgggacgatgtggtcgatctggacggactcgccgaccttggggccgcgctggaaggcgatggtcttgttggtgtacgggtcgtgcagcgtgccggtggccaccgcgtccggacaccgcttgaccgacacatacgtcttgtcgacgagatcgcggttgaggatgtcgtcgcgggtgtcacatccgttgtgccccatgggcgcatcgttgtcgtcgtcccaggcgtcgccgaacgccgagcgcaggtagtcgtagcgatgctggcgcaccggcagcaccgcgatgccggccagcacgtcggtgcccggctgcacggtcggaacgtccgcgcgcgcagcgtattcggcggtatgccgggtcgaggagccgacggcctggtaggcgaccagcacggccagcgcggcggccgcggccagccacagcagcaccttgcggttgacgttcatgacttgtccaggtattcgatgcggtcggtgtcggtgaatcgtgcggccagcaacgacaatccggggtcgaagcggttaccggcgtaagcctggacgcagaagtcacgggcggcctcgatgtactcctggtggtcggccagactcagcagccgcagcgtgaccgccctgccggactggttgcggcccaacacatctccctcccgtcgctccttgaggtcgaggtcggccagcgcgaagccgtccatcgtctcggccaccgcggtcagccgccggccggccggcgagtccggcgcggcccagctggcgaacaggcacaggctgggatgctcgccgcgcccgatccgcccgcgcagctggtgcagctggctgatgccgaaccggtcggcgtccatcaccagcatgacggtggcgttggggacgtccacgcccacctcgatcacggtggtacacaccagcacatcgatgtcgccggcgcggaacgcggccatcacggcgtccttctcctcggccgagagccggccgtgcatcagtccgagccgcagctgcgccagctcctgcgaacgcagccgggcgtagagcccctcggcggtttcgggcgccttggcgttctggtccgccgccccgtcgtcgtcgctctcgtcgatgcgcgccgccaccacgtaggcctgacgcccggcggccacctcttcgccgatgcgccgccacgcccgacccaaccaggcgggcttgtccttgacgaagataacgttgctggtgatgggctggcgcccgcgcggaagttcgcgcagcgtcgaggtttccaggtctccgtacacggtgagcgccacggtgcgcggtatcggcgtcgccgtcatcaccagcagatgcggcgtcaccccgggacgggccttggcgcgcaaccgatctcgctgctccacaccgaagcggtgctgttcgtcgaccaccaccatgcccaggttgtggaactccaccgcgtcctgcagcaacgcgtgggtgccgacgacgatccccacctggccgccggccacctcgtcacgcacctgtttcttctgcgccgcggtcatcgacccgctgagcaacgccaaccttgtggcgttgtcggccccacccagctggccggccatcgccaacgggccgagcacgtcgcggatcgaccgaagatgttgcgcagcaagaacttccgtcggcgccagcagcgcgcactgatagccggcgtcgaccatctgcagcatcgccagcaccgagacgatggtcttgccggagcccacctcgccctgcagcagccgattcagcggccgggtcgacgcgagcccgtcggacagcacgtccagcacctcccgctgtccggcggtcaactcgaagggcaagcgccgcaacagttccgcggccagcccgtccgggcggggcggggccggcggcccggattcggagagctcgccgtgccggcgggccaccagcgcccactgcaaacctacggcctcgtcgaaggtcaggcgctcgcgtgcccgctgccggcgggcctcgttctcggcgaggtggatgtcgcgcagcgcctggtcctcgcacaccaggtcgaatttcgcgcgcagcggctcgggtagcgggtcgggcaccgggtcgagcacgtcgagcaccaagcgcacgcacgagaagatgtcccagctctgcattttcgtgctggccggatagatcgggaagaagtggcgttcgtaggcgtccagcaccgcctcgccgctggcacccgaggcgttggcgatgttcttcagggatcgggtgcccttgttgcggccgtccggggagtcgaggatgaggaaggccgggtgggtgagctgcatgacgttcttgaagaagcccacctccccggagagcatcaccttggtgccctcggtgaggccctttttcaggtagttcgcgttgaagaaggtggcggtcaccttgttgcggcccgcaccgagcgtgatgcggtggcacaccttcttcggggtcttcttcatcggccacgtcttggtttcggtgatcgtgtcgatgatggtgatgtgctcgccggccggcggccgctcgtcgtcggcgccccaacggctcgccccctcggtgtagctgcgcgggtagtggcgcagcaggtcgtcgacggtgcggatgccgaacaactcctcgagctgttcggcggccttggctcccaccacgaagtccagccggtcggtcagcgaggccatcgctattcgaccccgatcagcagcacgtcgccgtggtggccggtgcggtaggtgaccagctcggtgcccgggtgatggtcgtgcatgtgttcttccaggatgtcgacgaccgcgccggcatgagcatccgagccgtcggcgtcgatgccggcaccgagcaacaccgtcaccaggtcgccgcccgaggccagcagcagatcgagcaggccgatcgccgccccgaccgcgtcggcggccacgatcagcacctcaccgccggcgatgcccaggccgtcgccgggcctgcagctccccgcccaggtcagcgcggtctcggtggcgatgcgcaccgagccgtgccgcgccgccccggcggcgcgggccatggtgtagccgtcgtcgacggcctgccggccggtgtcgtgcacggccagcgcggccagcccctgcaccatcgactcggtcgggatgggcaccacgtcgatgccccagccgatggccgcggtgcagccggcgaccagctcctcggcggccacataaccgttgggcagcaccatcacctgcgcggcgccggtgtcgaccacggcccgcatcagctggtgcgcgctgatcgtggtaaccgggtcggccgcggccgggtcgcgctgcagcacgcaggcgccctcaccggagaacaggccggccgcgccgtcgccgtcgacgacggccagcaccgcgcgttcccgcgtccagccgcccgcgggcagcccggggccgccggagctcaacgccgagatcacgatgcggctgagccgtccggccgccagcccggcttccacggcggcgccggcgtcgtcggtatgcacgtgcaccgaataggtgtgctgggccgacgacggcgccgaggcgatgccgaccgaatcgcccagctcggtgagccggtcgcgcagcgcgtcggccgccgcgggtgcgcagtcgtccagccggtacatcacctcgaactgcggcgccgggcggggcgcggcggcctccggtgcggccgtccgcggcgcgagccggtagacggtgcgggccggcgcctgcccggtgatggtggtgcgcagcgcgtccagcagcaccagcagcccccgcccgcctgcgtccacggcgccggcgtcggccagcacgtcgagctgctcgggcgtcttctccagggcgatcaccgccgcgtcgccggcggcgatgaccgccgcggtgactccctcgccggcccgggcgcactgcgccacggcggtggcggccgcgcgcagcaccgagacgatggtccccgggatctcctcaccacccatcgaggtgatgaccagctccacgccgcgctgcagcgccgcacccagcacggccgcctcgatgcgcgccaactcaccaccggcccgggccgcggccgtcgcggtgacgtcggcgacgccgcgcaggatctgcgacaggatcaccccggagttgccgcgggcgccgttcagcgcgccggtggacagcgccgcggcggcccgggcgacgcagccggggccgccggccgcctgcagctcggccagcgccgagcgcatggtgaacagcatgttggcgccggtgtcggagtcggcgacggggaagacgttgagccggttgatctcgtcgatgtgggtgatcaggtcactgacggcggtgtgcgcccagtcccgcagggccgccgcgtccagcggacgatcgtgcgaggtccacgaactgcccagggttacccacctcctctgcgccgccacccggtgggcgccagcgtagcccggcgacgcgggcgctgcgcccggttactccccgccggtgaggaagatcgggtaccgcgggcgcggctaataaccctgccggataccgggattggcctgccccaccagcagccgctgattgctgccgtcggggctgacgccgtagcggctcatctgatagttcatcgacgcgcacgcggcggccaccggatcccacgccgaattcgacgtccccggctggtggaaggccgcgaacgtgtccggcatcagctgccacgggccccgcgtggcgtgcagtgggccgccgtcgagctgggccggcccatacgcgttgctgtcggccaggttgatcgccgccgagtgaaactgggattcgtggtcggcgatcgtcatcatgccgtcgatccagcggccgcgggccgacgcgtcggtgaccccgatccgggtcagcgcctcctcgaggtagccgcggatcgcctcggggccgtccgcccacgctccgcgcccgtcgaacgcgacctggcgcagctggataccgccacgcacggcggccacctcgtgcaccgcgggacggggctccgcgggcggccaccaccacgtcggcgcggcccgaggggctcgcgatgctctcgggccggggccgccctggccgatgtcggactgcccgcccaccgccgtcgggcaattgaccgactcgctaccgatggcgagactgcccagggccgccaccaccgcgtaggccgtcgccattcggcgcagcctcaaaacccaccgtcgtacgtccaccggagagccacgccgggtttcggcgcgggctggaccggcggtgttttcggcgcgcgcaaccaccccgcgcactcccctcgaactgccgatatttgcttcccagcctcatccgcagctccgcgcgggccggcaccgccgggaagaagacttcagtccaaccggcgcgccgtccgcgcctggtacaggcagcgaccgcgccgaccatcggcggcgccgccatcctaacgaccgcgcgcgccggcaacctcgctgcgagccggtattgtgatcgactccatgtcggcggcgggcatggctccagcgcacagtgaccgcacgtcagcgttttggtggttgccccgacagtcggtatcctcggttgggcccgggcgaacccgggccgtcccggtcgcggaggcagaccgccgagccggacccccgagatttgaggagcttgaaccatggccgctgtgtgcgacatctgcgggaaaggccccggcttcggcaagtcggtgtcgcactcccaccgccgcaccagccgccggtggaaccccaacgtccagacggtgcacgcggtcgcccgtccgggcggcaacaagcagcgcctcaacgtgtgcacctcgtgcattaaggccggcaaggtcgtccggggctgagaagtcccgtcgctcacatgacgacgtggccggcgtccaccgggatggccacccccgtcacgtagcgtgaccgcggcccggccagccacagcaccgccccggtgacgtcgcgcgactcgaccagcggcacctcgggcagcagggtctgcgacagcgccgggttcggattctccagcatccggttcaccacgaaatcgttgaggatcatcggcgtcgcgaccccgctcgggtgtaccgagttcacccgaatcttgtgcggcgcataggcattcgccgccgagcgcatcaggccgaccacaccgtgtttggacgcggcgtaggcgaacatcgccgcactgccgtcgccgccgcgcccggtcagaccctgcgacgaactgaccagcaccaccgagccgccgcggcccttgcgcacgatcgagggcaccgtcgccagcatggtgtgccacacgcccttgaggttggtgtccacgatcgtgttgaacaccggttcggactcggcctcggtgacgccgatggccaccaccccggcgttggcgacgacgacgtcgatgtcgccgagccggtcgatgcccgcctgcaccccggcccgtaacgcctgcaggtcgcggacgtcggcgatcaccggaaccgctgcgcggcccgcggattcgaccagccgcacggtttcggcgagctcggcctcggtgcccagggcgtagggaatggccggcaggtcggcgcagatatcgacgacgatgacgtcggcgccctgctgcgccagcgcgacggcgtggctgcggccctgcccgcgcgcggcgccggtgacgacggcgaccgtgttgtcgaattcgcccatggccgacctccctagaccctcagttccgtgccggtctcgcgctcggcgaaggccaccagtcgcgcggccgtgtcgtaatcgcaggccagcggggtgcgcccgatcagcaccggaccgccgcgcagcccgaacctgccgctgaccccgacgtagctgccgggcgggatcggctcgctgatgcagtacagggtgggcgccgcgccctcgtcgatgtcgttggccagccggtcggccaccactttgaccgccttgtgcgccaccgccttcagcggcgcgtcgcccaggttggacaggttcgacgccacccaacccgggtgggtcagctgagtcacgatcggcgaccccgccgcgcgcagccggcggtccagctcgagcccccacagcatgaccgcgagcttggactgcgcgtaggcgcccagccgggtccacttgtgccggcgcaggtgcaggtcgtcgaggtgcagcgtcgccgagcggtgcgcgtcggagccgacgttaatgatctggctgcgcaccttgggcagcagcaggttggtcagcgcgaacggcccgagcaggttggtgcccagcgtcatctcgaagccgtcgaccgtctcggtgcgccggtcggtcagggcgccggcgttgttgatcaggatgtccaccggcgcctcgatccggtcggcgaaggcgcgcaccgacgacaggtcggccaggtcgagcttttccacggcggtcgacccgcccatctgggccgcgcgttgcttcccgagttcggtgttgcgcacggccaggatcacctcggcgccggccttggccagggcacgggcggtgcccagcccgacgccgttggtggctcctgtcacgatcacgcgtctgccggtgaggtcgcccagccggtccggggtccacggtatggtcacggcgaaccagagtaatggtcggttctatgtaagttggaccggttctgccaacataagagccgacgactcccgaggcggttcgacatgactgacagcgccaccgagatcaccaacctcatctacacctacgcgcagctgctcgacggcggcgacctggacggggtggcccggctcttcgaacacggccgcatctgcggcgtgcaggacggcccgccggaaacggtgttcgccggctcggcccgggtgcgccagatgtacgagatggccacccgcatctacgaggacggcaccccgaagaccaaacacaacaccaccaacgtgcagctcgacatcgacgaggagcggggcaccgcgcgcagcacctcctactactgcgtcacccaggccacgcccgagctgccgctgcaggtcatcgtcaccgggcattaccaggacacgttccaccgggtgaacggcgcctggtgcttcgagagccggaccatgttcgtcgaccaggtcggcgacgtcagccaccatctgaagttctgaccagggtggaccccttcgacccggacgccgtgctggccgactacgggctgcggcccgagcaggtgaacgagctattaccttgtaccgcaagcgttttggtgaatatattggaggaacagccgatgcctgagcacccggtcgcgacccgctcccagcacgagcaggaactggccgcgctcgatttgatcgagcacccgaccgtcagggccgcctaccggtcggtggcgcagacctggctgggccgcgccgacgcgtcggacgcgatgcgcgcacggttcgacgacgcgttcgccgaggtgatgttctcggcggcgatctggtcgtccaatcaggacaagctgcggccgaaggtcagctgcatcacccggctggcgcaccccgtggacggccgccgggttcccggatcacgttggggcatcgacaatcccgacagcgtgtaccgggtaatcccgatctccggtgaggagcgctacgagatccacgggtgggtcggcgaacaccgaatgaccgagaactacttcaccctgtgggacgcccggatgggcaccatcgacgtgctcaacggccgcaccatgcgggtcgagccggacggcagcttcaccatcaccgtggacgcgcaacccgccaacggccgccccaatcatgtgcggacgtcggctgcggcgcacgagttctacatccgcgacgtgctgctggaccgggaccgcgacgaccccaattacttcgaggtgcaacggctcggcggcccgccggcgacaccggcgcgcaccctcgacgagcaggccgaggcgaccgcggcgatgatggcctacttcgccgatttcaccggcaagctcagccatggcgtgtacaagatgccggccaaccgtttcgatctggcctggtcggcggagaaggccggcgcgatgcgcaaccaggtgtacgtgatgggccgcttcgacctcgcaccggacgaggcgttcgtcgtcgaggtgaatgatggtggcgcggaatacttcacggtgccgctgagcaacatctggggcaccaccctggacatcgtcgaccgcaccggcagcctcaacaaggcgcagtcggtcgccaacgaggacggcagctacacctacgtgatcgcgcccaccgatccgggcgtggccaactggatcgactccgacggcctgcgcgaggccatcctgacgctgcggatggccgagttcggcgagcacggcccccgcgaagacctcggcgcccgcggccgcgtcgtcaagctggaccggctcgacaccgaggtggcgcacctgccgcgggtgagcccgcagcagcgggccgccgaactcgcgcagcgccgggccggctatctgcgccgcctacccgaagggacgatctagcgatggcacgctggctgatcacgggatgctccaccggcttcggccgcgaaatcgccggtgcggcactgcaagccggccaccgcgtggtggtgacggcacgacgggccgacgccgttcggggttttgccgaggaattcggcgagctggcgctgccggtcgcgctcgacgtgaccgaccgcgaccagatcgccgccgcggtggccgcggccgacgcggcgttcggcggcatcgacgtgctggtgaacaacgccgggcacggctacctgtcggcggtggaagagggcgaggacgccgaggtgcgaaagctgttcgacgtcaactacttcggtgcggtcgacatgatcaaggcggtgcttcctggcatgcgcgcccgcggctgcgggcacatcgtcaacatctcgtcgatgaccggcctggtggccaacccgcccaacgcctactactcgtcgaccaagttcgcgctggaggccgtcaccgaggcgctcgccgccgaggtccgcccgttgggtatcaaggtgaccgcgatcgagccgggggccttccgcaccgattgggccacccgatcgatgaaggagtccggcacgccgatcgccgactacaccgacgtcgcggcgcgcaaggacctgatcaagcagttcgccgaccacctgcccggcgacccgcgcaaggtggccgaggcggtgctgatggtgaccgggctggacgagccgccgctgcggctgctgctcggacgcgacgttctcaaggccatgcgggacaagatcgccgcgatgtcggcgtcgatcgacgagtgggaggccgtcaccaaggacgtgaacttcccgggcgcataggccgctgtcgccgctgtggcccgcgagcggccggcggcccaaccgcgagcgtcacaccagcgtggcggccgccggcgagcgtcacgccagcgtgacggccacggccgagcgtcacgccagcgtgacggccggcgccgagcgtcacgccagcgtgacgggcgccggcccaaccgcgagcgtcagggcagccgccagtcgatctcgtcggcgcccatctcggccagcagcttgttggcccggctgaacggccgcgacccgaagaacccccgcgacgccgacagcggagacgggtgcggcgactcgatggccacgcaattaccttgggccagaatcggtttcagggtcgaggcgtcacggccccacaggatggcgaccaggggctgctggcgcgcggtcagcgcccggatggcgcactcggtcaccggctcccagcccttgccccggtgcgacgccgggttgctggggcgcacggtgagcaccctgttcagcagcagcacgccgcgctgcgcccagggcgtcaggtcgccgcacgagggcggcgggtggcccaggtccgcggtgtactcctggaagatgttggccaggctgcgcggcagcggcgacacgtcgggtgccaccgaaaagctcagccccacagcgtgtcccggcgtcggatagggatcctgcccaacgatgagcaccttgacctcgtcgaagggataggtgaacgcgcgcaacacgtttgggccggccggcaggtaccggcgcccggccgcgatctcggcccgcagaaactgccccatccgggcgacctgctcggccaccggctgcaacgcacgcgcccagccgggctcgacgagttcattcagcgggcgcgccgtcatcgccggcccccgccggccgcgggatcggtcacttagagatcaccgggccaccctagtacgactgccagccggcggggccgctccactcccgctcgtcgaccagcacccgggccgggccgtcgagaacccgcccgatgatgcgccagccggccggcgcgggcccggggaaacaggccaccagggcgtggtcctcaccgccggtcagcacccacggccaggcgtcgacgcccaccgcggtcgccgcggccgccaccgcgtcacggtcggcggccagcgccgcggtggacacgtccatgcccaccccggacgcctcggcgacgtgccgcaggtcggcgatcaggccgtcggagacgtcgatcatcgcctgcgctcccccggccgcggccaccgcaccctggccgtagggcggctgcggcaccgcatgccggcggcgcagctcgtcgaacccgccaatctgattgcgccacaggtcaaatcccgccgcggatcggcccaggtcgccggccacggcgatcagcgagccgggttcggcgccagcgcggcgcaccggggaacgcccgtccagctcgccgagcgcggtgaccgagatgacccactgcgggcagctgaccagatcgccgccggcgatgccggcccccacccgctgcgcctcgtcccacatgccgtccaccagcgcgtccacctgcgctgccgcggtctgaccgggagcgccgaagcccaccacgaacgccgtgggccgcgcgcccatcgcctcgatgtccgcggcgttctgcgcgatcgccttgcggccgatgtcgtgcggcgtcgaccagtcgagccggaaatgccggtcctgcaccagcatgtcggtcgacaccaccacgcggccgtcgccggtcgtcaccagcgcggcgtcgtcgccgggcccgagggtcaccgcggccggctgacggcgcccggccaccagccggtcgatgacggcgaattcgccgagttgccgcagcgtcgattcgtcccgcacgccaccaccatagggctgtcgcccgggcgggccgaccgccaatactgggaagccgggtaacagtggcccgacagacaaggaggtgcgcgggcggtggcaaccgaatcggaggccgacggcgggcccccgcgggcggtgatcatggtcgcggtcgcgctggcggtgacgacgatcggggtgatcctggcgatcgcggcgacccgtgaggcgccgccgcaacccgttgccgtagcggcctttccggcgccgcacgccggggacgccgcctgccgggcattgctggacgcgctgccgcagcggctcggcgactatcagcgcgccccgctcgagcagccggccccggcgggcgccgcggcctggcggaccgggccggacagcgagccggtggtgctgcgctgcggcctggaccgcccggccgagttcgtcgccggatcccccatccaggtcgtcgaccgggtgcagtggttcgcggtgcgccccgacccgcaatccgccggggacgccggcagatccacctggtacacggtggaccgcccggtgtatgtggcgctcacgctgccgtcgggctcgggcccggcgcccatccagcggctctccgacgtgatcgggcagcgcatcgcggcggcgccggtcaaccccgggccgcccgccggctagcgcagcccgacgccgcgggccagggccgtctccaccatggtggccagcagactcgggtagtccacgccgctggccgcccacatccgcgggtacatcgagatggtggtgaagccgggcatcgtgttgatctcgttgagcaccggcccggtctcggtgaggaagaagtccacccgggccagcccttggcagtcaacggccttgaatgcgcggatcgccaattcgcgtaccgcgtcggcgatttcgtcatcgaccttggcgggcacgtccaattcggctgtgtcgtcgaggtatttggttgcgaagtcgtagaacgagtcctcacgcccgcgcaccccggccacccggatctcgccgaccgtgctggcttgcactgtgccgtcgggcatttcgagcaccccgcactccagctcccggccggcgatggccgcctcgacgatgaccttgggatcgtggtcgcgggcggcggccacggcggcgtccagctcgtcccagctcgagacccggctgacgccgatcgaggagccgccccgggcgggtttgacgaacaccggcaagcccagccgctcgcggtcctgcagcgacagtgtggactgcgacgggcgcagcaccgcgtagtcgccgatcggcaatccctcggcggcgaacagcttcttggtgaattccttgtccatgcccgcggcgctggcgaacacgccggcccccacgtagggcaccccggcgagttcgagcagcccctggatcgtgccgtcctcgccgtacgggccgtgcagcaccgggaacaccacgtcgacggaggccaacacctcactggctccggggggaagggaaaccagttggccgctacgccccggatccgccggcagcgccagctcggtccccgacgcggacgtcacctcgggcagttgccggtcgctgatcgccagcgcggccgggtcgccgtcggtgagcacccacgagccttgcggggtgatgccgatcgcgacgacctcgaaccgccgcgggtcgaggttgcgcaggatgctgccggccgagacgcacgagatggcgtgctcgttgctgcgcccgccgaagacgacggcgacgcggacccgctggctggcattcacaatctgaacaggctaccgggtggcggccacgtcattctggcttggtgcgccggcccagcaacagcgccatcgcctcatcgacggacagccccttgtggcagacccggtgcaccgcgtcggtgagcggcatttccacgtcgtagctggcggccagcgccagcaccgactggcaggacgtcacgccctcgacgacgtgcccgtcgccgccgtcggggctaccggcgagcaccgaaccgatggttgccccgcggccgagccgctcgcccagcgaacggttgcgggagtgcggcgagctgcaggtggcgaccaggtcgcccaccccggccagcccggccagcgtcgcgcccttggcgccgagcgcgatgcccagccgcatgatctcggccagcccccgggtgatgatggccgccgcggtgttctcgccgaggcccacgccggcggccatcccgcaggccagcgcgatcacgttcttgcacgccccgccgatctcggtgccgaccacatcgctgttggtgtagggccggaagtatccgctgttgagcatgcgctgcagggcgacggcgcggccggagtcgctgcacgccaccaccgtcgcggcgggctggcacgcggcgatctcgctggccaggttcggtcccgagatcaccgcgacctgagccgggtcgacgccggtcaccgagacgatgacctggctcatccgcatcagggtgcccaactcgatgcccttggccaggctgaccagggtcgccccgtcccgcagcagcggcgcccagcgctcgaggttggcgcgcatcgcctgcgccggcacgcccagcagcaccgtcgtcgcgtcccgcagcgcctcgccggcgtccgcggtggcgtgaatgcccggcggcaacgacgtcccgggcagatagtcggggttcgatcgggtcgcgttgatccgttcagcgagctcgggcctgcgggcccacagcgtaacctctgttccggggccgccggcgtcgacgagcaccttggccagcgcggtgccccacgccccggcgcccatgaccgtgacggcgccggccgcaccggccttcggaccgccccctgggccggccatgtaccaccccctgtccgtggtcggtgtagctcacgcggcacttgcagccgctacaccctagatcagcggccgaccgtgcgtcacgcaagccggctgcgcgccggcgctggcaggatgacatctcatgagcggcaaacgagccgacggcgggcacgacggtgcgggcgatgtcgccctgatcattgcggtcaagaggctggccgcggccaagaccaggctggccccggtgttctcggcgcgcacccgcgaaagcgtggtgctggccatgttgaccgacaccctgaccgccgccacacgggtcccgtcgctgggttcgatcaccgtgatcacgcccgacgaggccgccgcggcggcggccgccgggctgggcgccgacgtgctggccgacccgaccccggaggggcatccggatccgctcaacaacgccatcgccaccgcggagcgcgcggtgagcggttcctttaccaatatcgttgcgctgcaaggagatctgccggcgctgcagtcccaggagctggccgaggcggtggccgccgcgcgtgcgcaccggcgcagcttcgtcgccgaccggctggccaccggcaccgcggcgctgttcgcgttcggcacccggctcgatccccggttcggctccgattcgtcggcgcggcaccgcagttcgggcgcgatcgagctgaccggcgcctggcccggcctgcgctgtgacgtcgatacccccaccgatctagccgccgcccgccgcctcggggtgggggccgcgacggcccgggccatcgccgcgcattgattttcgctcaccgcggccgaatctgtccggccggtgaacggcggcccaacggcgaatggatgtcccgcgggcgctagcagcagccgcgcgtgatgcgccatgatcgcaatgtgactgaaatcgacgctgagactcgacccgacgagaacctgtggcattcgggcgactcggccgtgggggcgccacccgcggcgaccccggccgcgatgaccgacctgccggaggaccgttatctcaaccgggaactgagctggctggatttcaacgcccgggtgctggcgctggccgacgacaactcgctgccgctgctggaacgggccaagttcctggccattttcgcctccaacctcgacgagttctacatggtgcgggtcgccgggctgaagcggcgcgacgagatgggcttgtcggtgcgctcggccgacgggttgacgccgcgcaaacaactcgccctgatcggcgagcacacccagcggatcgcgacccggcacgcgcgggtgttcctcgactcggtgcgcccggcgctggccgaggagggcattcacatcgtcacctgggccgatctcgatcaggccgagcgcgacgaattgtccacctatttcaccgaacaggtctttcccgtcctgacgcccctggccgtcgatcccgcgcacccgttccccttcgtcagcgggctgagcctgaacctggcggtgatggtgcgccagaccgaggacggcggccaacacttcgcccgcgtcaaggtgcccaacaacgtcgatcgcttcgtcgaactcgcggcgccgagagcgggcgccgagggcgaaaaccgcggcgtcgtccggtttctgccgatggaggaactgatcgcggcgttcctgccgctgctgttcccgggcatggagatcgtcgaacaccacgcgttccgcatcacccgcaacgccgacatggaggtcgaggaggaccgcgacgaagatctgctgcaggcgctggaacgggagttggcgcggcggcgcttcggcccgccggtgcggctcgagatcgccgacgacatgaccgagggcatgctggaactgctgctgcgcgaactcgacgtgcatcccggcgacgtcatcgaagtgcccggcctgctcgacctttcgtcgctgtggcagatctacgatttggatcgccccgcgctcaaggatccggcgttcgtcccggacacccaccccgccttcgccgaccgcgaatcccccaagagcatcttcgcgacgctgcgcgagggcgacgtgctggtgcaccacccctacgactcgttctccaccagcgtgcagcgcttcatccagcaggccgccgccgaccccaacgtgctggcgatcaagcagacgctgtaccgcacctccggtgattcgccgatcgttcgggcgctgatcgaagcggccgaggccggcaagcaggcggtggcactggtcgagatcaaggcgcgattcgacgagcaggccaacatccgctgggcgcgcgccctcgaacaagcgggcgtgcacgtggtttacgggctcgtcggcctcaagacgcattgcaagacatgcctggtggtgcgccgcgaaggttcggcgatccgccggtactgccacatcggaaccggcaactacaacagcaagaccgcccgcctgtacgaggatgtcggtctgctgacggcggcgccggacatcggcgccgacctcaccgatttgttcaattcgcttaccggctattcgcgtaaggtctcctaccgcaatctgttggtggcgccgcacggaattcgcaccggcatcatcgaacgcgtcgaacgcgagatcgccgcgcaccgcgaacgcgggcagggccgaattcggttgaagatgaacgcgttggtggacgagcaggtgatcaactccctgtaccgggcgtcgcaggcgggggtgcgggtcgaggtcgtggtgcgcggcatctgcgcgctgcgcccgggcgtgcagggttactccgaaaacatcttcgtgcgctcgattctgggacgtttcctggagcactcgcggatcatccacttccgcaacatcaacgaattctggatcggcagcgccgatatgatgcaccgcaatctcgatcgccgcgtcgaagtgctggcgcaggtcaaggatcccaaactcaccgcgcagctggacgagttgttcgaatccgcgctggatccgtccacccggtgctgggaattgggacccgacgggcagtggaccccgtcgccgcaggagggccataccgtgcgtgatcaccaagtatcgttgatggagcggcatcgcagtccctagccctgcgggtgagttcggagttgtttttccggccgcagcgtgatccagcgtgcgacttgaccgaattgacctgcaggagttgaggtgccgacccagaattcgtcgactgctcgacgcgccggaacccgggtggtctacgccgccggcgcggtgctgtggcgacccggcgacgccgagccggacggcggtgacgtcgaggtcgcgatcatccatcgcccgcgctatgacgactggtcactgcccaagggcaaggtggaccccggcgagacggcgccggttgcggcggtgcgcgaagtgcgcgaggagacgggccagtgcgccgtgctcggcagacggctcgacacggtgcgctatccgatcgaacagggcgtcaagaaggtctactactggtcggcgcgcgccaccggcggcgaattcgtacccggcgacgaggtcgaccagttgctctggttgccggtggccgaggcgatgcagcggctcaattacacacaagaccgaaaagtgttgcggcacttcaacaaaaagcccgcggacacacacaccgtgctggtggtgcggcacggcacggccgggcgcaaatctcgtttctccggcgacgacgccaagcggccgctggacaagcggggccgggcgcaggccgaggcgctggtcccgcagctgctggcgttcggtgcctcacaggtgcacgcggccgaccgggtccgctgccaccagaccgtgcaaccgctggccgaggagctcgacgtgccggtgcacaacgagaccacgctcaccgaggaggcatacgccaagaaccccaagcgcgctcggcaccggatgctcgagatcgccggggagccaggcacaccggttgtctgcacgcagggcaaggtgattccggacctgatcgcgtggtggtgtgatcgcgacggagtgcggcccgacaagtcacgcaaccacaagggcagcacctgggtgctgtcgttgtcggccggccggctggtggccgccgatcacatcggcggcgcgctggccgccaacgtgcgcgcctgagttcgcggcggcgtgcccgctcgctagcacacgaataccctccgggcggcaccgctgccggccgaagggtattcgtgtctaggacgtgctctgcctacttgcggccgcgacgcgcggtcgtcttcttggccgcggccttgcgagccggagccttgctggcggccttcttggccggagccttggtcgcggccttcttggccggagccttcttcgccgcaaccttcttggccggagccttggtcgcggccttgcgcaccggagccttggtcgcggccttgcgggccggagccttcttgaccgcagccttcttcgccggggccttcttggcggcggccttcttggccggagccttcttcgccgcagccttcttggcgggcgccttcttggcggcggtcttcttggccgcgccgccgaccacgccgcgcttgacggccgggccctcggacgggagacgctgtgcgccagagacaaccgctttgaattgagcgccggggcggaacgccgggacggacgtcggcttcaccttcaccgtctcaccggtacgcgggttgcgggccacccgtgcggcgcgccgccgctgttcgaatacaccgaacccggtgatcgtgacgctgtcgcccttgtgtaccgcacgcacaatggtgtcgacgacattctcgaccgctgcggtcgcctgccgacggtccgtgttcaatttctgtgtgagcacatcaatgagctctgccttgttcatcaatccctccgacactagtggtcctcgatttgaaccgactagtggacacggtaaaccctcacccagcaaatttccaagagccacgcgcaatttcacggcggggcgggcggcgttttcgcaatccggttgccgcccttgaccggtggagggcgtcgcaaatcgggccggtttagttagcccatcgagcagaaattcggcccggctcagcggttcacgcgacgggcgaagtgcgcggtttccaatcgggatacgtcgcttcgtaggattcgattctgtcgagtttccgcagcgtaagggctatatcgtcgagcccttcgagtagtcgccacgcggtgtggtcgtcaatcttgaacggcagcaccgtcgttcccgcggtgatatttcgatcttgaagattggcagtgatttccaagccggggctctgctcgatgagcttccagagcagctccaccccgtcctgggaaacttcggccgccagcagacccgccttgccggcgttgccccggaaaatgtcgccgaatcgagacgagatgaccacccggaacccgtagtccatcagtgcccacaccgcgtgctcgcgcgacgaccccgtcccgaaatccggtccggcgactaggactgagccacggtcaaaggggctgaggttgagcacgaatgacggatccgaccgccagctggcgaacaagccgtcctcgaaaccggttcgggttacgcgcttcaaatacaccgccggaatgatctggtcggtgtcgacattggagcgccgcagcggcacaccgatgccggtgtgggtgtgaaatgcttccatgctcatcccttcacggtcgaatacgtcagtccaaatcggccggagcggacaatgtgccgcgcaccgccgtggccgcggcgacggccggagacaccaaatgcgtgcggccgcctttgccctggcgcccttcgaagttgcggttcgaggtcgccgcgcaccgctcccccggcgccagctgatcgggattcattcccaaacacatcgagcagcccgcctgccgccattcggcgcccgcggcggtgaaaacctcgcccagcccttcggcttcggcctgcgcgcgcacccgcatcgagccgggcaccacgagcatccgcacccccggcgcgaccttgcggccgcgcagcacgtcggcgacgacccgcagatcctcgatacgaccgttggtacaagagccgacgaacaccgcgtcgaccgcgatgtcgcgcatcggcgtgcccggtcgaaggtccatgtatgccaacgctttctcggcggcctgacgctcggcatcgtcggtcatcagttcgggatccggtaccgcggcagccaacggcacgccctgacccgggtttgtgccccacgtcacgaacgggctcagcgacgcggcatccagatagacctcggtgtcgaacaccgcgccgggatcggtgcgcagctgctgccaatagcgcatggccgcatcccattgcgcgcccttgggggcgtgcgggcggtcccgcaggaactcgtaggtggtgtcgtcgggagcgatcatccccgctcgggcaccggcctcgatgctcatgttgcacacggtcatccggccttccatcgacagcgattcgatggcgctgccgcggtattcgatgacgtgcccctgcccgccgccggtgccgatcttggcgatcagcgccaggatgatgtccttggccgtcacgccggccggcaactcgccgtcgacgttgaccgccatcgtcttgaacggccgcagcggcaacgtctgggtggccagcacgtgctcgacctccgaggtgccaattcccatggccagtgcgccgaatgcgccgtgcgtcgaggtgtgactatccccacacaccaccgtcattcccggttgggtcaggcccagctgcggcccgacgacatgcacgatgccctgctccgcgtcgcccatcgggtacagccggacgccgaattcggcacaatttcggcgcaatgtctcgacctgggtgcgcgacaccgggtcggcgatcggcttgtcgatgtcgacggtgggcacgttgtggtcctcggtggccagcgtcagatcgggccgccgcaccggccggccggccagccgcaggccgtcgaacgcctgcgggctggtgacctcgtgcaccaggtgcagatcgatgtagatcaggtccggctcgttggccccgccggacaccacaacgtggtcgtcccagactttttcggccagcgtgcgcggcgtggccgtcgtccccgtgtcgattcccatctcgaactcgcctcaattcgcttggtccgcggctcgccgatccgtcgggctggtgatctcataatgcgagacgctagtatctcgttgtgagacagcatagcggcatcggcgtcctggacaaagcggtgggtgtgctgcacaccgtcgcccaatcaccctgtgggttggccgaactctgcgagcggaccgagctgccccgcgccaccgcctaccggttggcggccgcgctcgaggtgcatcgcctgctggcgcgcggcgacgacgggcgctggcggctcggcccggcggtcaccgaactggcggcacacgtcaacgatccgctgctggccgccggcagcgcggtgctgccgctgttgcgcgagaccaccggcgagagcgtgcagctgtaccggcgcgagggcaccgaccgggtgtgtgtggccgcactggaacccgctgcgggccttagggatacggttccggtcggggcgcggctgccgatgaccgcggggtcgggcgccaaggtgttgctcgcccacagcgacgccgccacccagaaggcggtgctggcaaacgcgaaattcaccgagcgcacgctggccgaggtgaggcggcgcggctgggcgcaaagcgtggccgaacgcgagccgggggtggccagcgtgtcggcgccggtgcgcgacagccgcggtgctgtcatcgcggccatctcggtgtcgggccccatcgaccggatcggccggcgccccggggcgcgctgggccgccgatctggtgtccgccgccgaagcgctcacccgccgcctctagttctttctcgcgagcagacacaaaagtccccttttcggacgactttcgcgtgcttttgcgtctgctcgcgaggggacacagcggacctgacagactgaccggcatgggaaccaatcagcgcgcgagcatcgtcatgtccgacgacgagatcgccgacttcgtcgtcaagagccgcaccggcacgctggccaccatcggccgggacgggcagcctcatctgaccgccatgtggtacgccgtcgtcgacggcgagatctggctggagaccaaggccaagtcgcagaaggccatcaacctcaagcgcgacccgcgggtgagcttcctcatcgaggacggcgacacctacgacaccctgcgcggcgtgtcgttcgaaggggtggcggaactcgtcgacgatcccgacgtcgcccaccgggtgggggtcagcgtcttcgagcgctacaccggtccctacaccgacgagatgaagccgttcgttgagcagatgatgaacaagcgggtctgtgttcgcatcgtggcccgccgggcgcgttcctgggatcaccgcaaactcggcttgccgcccatgccggtgggtggatcgacggcgccggcggtgctgggcaccgaccggtgaccgcggtcttggttttgtagccccgatgggattcgaacccacgctaccgccgtgagagggcggcgtcctaggccgctagacgacggggccagacacgatccacagacgatccgaggtgtcagcatagctcaccccgctaagcccacctaatcgcttggaacggcggggttttgctggggtaccaggactcgaacctagaacggctgaaccagaatcagctgtgttgccaattacaccataccccattggctgcctaaaacagctggtcagcgtcgatctcgggcttttgttagcgcttcggggaccgccgccgccagtcgttcttcggcctttgtgaaccgcagtgcagactaccaaagactcgccggggccatccgcacgtgtggtgctcgtcgctcaggcgctgtgctgaccggcccgctcccgcgccgcgcgcaacctccgcaagctgcggtcccggcccagcagctgcagcgattcgaacagcggcgggctgatcgtcgtcccggtggcgcccacccggatcggtccgaacgccttgcgcggtttgaggcccaggccgtcgatgagcgcggtcttcagcgcggcctcgatctgcggcgccgcccagtccgtcacggcgtccagcgcgggcagcgccgcgtccagcaccgcggcgccgtcgggccccagttccttggcggcggccttcgggtcgatcgcgtactcgtcgtcgttgaggaacttcaacaggtcccacgcgtcgccgagcaccacgatgcgggtctgcaccaactcggcggcggtggcgaacgccgcgtcgtcgagcgcgaggcgatgcccgtggacgtcgaggtagtggcgcagcctggcggcgaagtccgcggcggtcagcatccggatgtgctcggcgttgagcgcgtcggccttcttctggtcgaagcgggccggattggagttgacgtcgacgacgtcgaaggcggccaccatctcgtccaggctgaacacgtcgcggtcgtcggcgatggcccagcccagcagcgcaaggtaattgagcagcccttcggggatgaagccgcggtcgcggtgggcgaacaggttggactgcgggtcgcgcttggagagctttttggtgccctcccccaataccgttggcaggtgggcgaactgcgggatgcgctcggccactccgatccggatcagcgcctgatacagcgcgagctgacgcggtgtcgagggcagcaggtcctcgccgcgcagcacgtgggtgatcttcatcagcgcgtcgtcgcacgggttgaccaacgtgtacaagggatctccgttggcgcgggtcaacgcgaagtcgggcaccgagccggcggcgaagacggtgctgccgcggaccaggtcgtcccagccgaggtcttcgtcgggcatccgcagccgcaccaccggttggcggccctcggccaggaaggcggcgcgctgcgaatcggtgaggtggcgatcgaagttgtcgtagcccagcttgggattacggccggcggcgatgtgacgggcctcgacctcctccggggtggagaaggcgtaatacgcctcgcccgcctcgaccagcttggccaccacgtcgcggtagatctcgccgcgctgtgactgccggtaggggccgtacgggccgcccacctccggcccctcgtcccagtccaggccgagccagcgcagcgcgtccagcagcgccaggtagctttcctcgctgtcgcgcgccgcgtcggtgtcctcgatgcgaaacacgaaggtgccgccggtgtggcgggcgtatgcccagttgaacagcgccgtgcggaccatgccgacgtgcggggtgccggtgggcgacgggcagaatcggacccggacgttcgcgggtgcagtcacgattttcctttgcggaccacgggattggtgagggtaccgatgccctcgatggtgatggagacggtgtcgccgtcctcgatgggacccacgcccgccggtgttccggtgaggatgagatcaccgggcagcagggtcatcacggccgagatccattcgacgatggagccgatgtcgtggatcagcagcgacgtgcggctgcgttgcttgacctcgccgttgacctcggtgcgcaattccaggtcgcccgggtccagcggattgaggtcggtgacgatccacggcccgaccgggcagaaggtgtcatggcccttggcccgcgtccactgaccatcggatcgttgttggtcgcgcgccgacacgtcgttgccgatggtgtagccgaggatgttctcggcggcctgggcggccgagacgtccttgcagggccggccgatcaccaccgccagctcgccctcgaagtgcacgggtgatgcgttggccggcaaccgaatcggcacgttcggcccgatgatggcggtgttgggtttgaggaagatcaccgggtcggccggcacggggccggtcgcctcgcccatctcggcgatgtggtcggcgtagttcttgccgacgcacaccaccttgctggccagtatcggggcgagcagccggacgtcggcgagcggccacgaccggccggtgaagttgggggtgccgaatggatgctcggcgatttcgcgggcgatcatctcggcggggttgtcgagttcgccctcgatactgacgaaggcgacaccgtcggggctggcgattcgaccaaggcgcatttggctcagcctagtgagggccgcgagcgcggcgtagccgggcgtggcgggccgtcgatcccaagcaccgatgaccggcaacggcacacgtcctacccctaaatatcccggcggtatgcaagcatggggaatgcagaccgaccccgtcgccacgcccgacgtcggcgccggcacccgctggtcgatcatggtcgtttcgctgctggcgacggcgagttccttcctgttcatcaacggcgtcgcattcttgatcccgtcgctgcaaggcgcgcgcgggattcggctcgacgaagccggtctgctggcctcgatgcccagctggggaatggtggtcacgctcgtggcgtggggctatgtgctggaccgggtcggcgagcgggtggtgatgaccaccggctcggcgctgaccgcactggccgcctacgccgcgtcgtcggcacactccatggtgctgatcgcggcgtacctgtttctcggcggcatggcggcggccagctgcaacacggccggcggccgactggtgtcggcctggttccccccgcaccagcgcgggctggcgatgggcatccgccaaaccgcgcaaccgttgggaatcgcgttgggcgccatggtcattcccgagctggccgaacacggtccgcaggcgggactgcgctttaccgcgttggcatgcgtgttcggcgcggtcgccagcgtgatcggtatcgtcgacccgccgcgcaagccccgcgccagcgccagcgatcaggaactcgccagcccgtatcgagggtcgttgacgctgtggcgaattcacgcggtggcgggcctgatgatgatgccgcagacggtgacggtgacgttcatgctggtgtggttgatccggaacctgcactggtccgtcgcggccgccggcgcattggtgacgctgtcccagctgctcggcgcgctcggccgggtcgcggtgggccgctggtcggaccggctcggctcgcggatgcggcccgtccgctacatcgcggccgcggcggtgctggttctgctgctgttggcctgggccgactacctcaattcgcggtggcaggccggcctgatggtggccatctcggtgatcgcggtgctcgacaacgggctggaagccaccgcgatcaccgaattcgccgggccgtattggagtggacgcgccctgggcatccagaacaccacccagcggatgatggcggccgccggtccgccgttgttcggcgcgttgatttcggccgcgaaatatccaccggcatggctgttgtgcgcgttgttccccttggcggcgatgccgctggtgccgacgcagctgctgccgcccggcttggaaactagagcgcggcggcaatccgttcgccgacttcggtggtggcgggccgttcgttcccacgcgttgccagatatcgttcgacggcccggtcaacccgggtagcggcggcgtcctcgccgaggtgggcgagcagcagcgccaccgacatgatcgcggccgtgggatcggcgatgccttggccggcgatgtcgggcgcgctgccgtgcacgggctcgaacatcgacggattggtccgggtgccgtcgatatttccactggcggccaagccaattccgccgcacaccgcggccgacagatcggtgatgatgtcgccgaacaggttgtcggtgacgatcacgtcgaagcggcccggatcggtgaccatgaagatggtggcggcgtcgatgtgctgatatgccacctcgacatcggggtagtcccggccgacctcggccacgatgcgcgaccacaacttgccggcgaaggtcagcacgttcgtcttgtgcaccagcgtcaaatgcttgcggcgccgccgggcgcgctcgaaggcgtcaacgaccacccggcgcaccccgaaagcggtgttctgactgacctcggtcgcgacttcgttgggcgtgccgacgcggatggcgccgccggtccccgtgtaggggccttcggtgccctcgcgcaccaccacgaaatcgatgtcggggtttccggccagtgggctgctcactcccggatacagccggccgggtcgcaagttgatgtgatggtccagctcaaaacgcaagcgcagcaacagacctcgctccagcacgccgctgggcaccgacgggtcgccgatggcgccgagcaggatcgcgtcatgcgcgcgcaactcgtcgatcaccgagtccggcagcagctcaccggtggcgtggtaacgccttgcgcccaggtcgtattcggtcttgtccacaccgggcagcaccgcgtcgagcaccttgagcgcctcggccgtcacctccgggccgatcccgtcgccgccgatcaccgcgagtttcatcggcgccgctcctccccatcgctacgctctgcatcgtcgtcggggcggttcacgagagatcaaccacctcaagcttgttcgcgccgaccgccgcgccgatggccgaccgcacatcggccggcacgtcttgatccagccgcagcagaatcgtcgcgcctgggccctcggcgtcctcggacagctgcgcggcttggatgttcaccccggccgagcccaacagggtgccgatcttgcccagcgcaccgggctggtcgacatagttgatcaccaggttgatgccgcgggcgcgcaggtcgaagttgcggccgttgatctgcacgatcttctccaccagctgcggcccggacagcgttcccgcgacgttgacggcagtgccgtcgtgcgacaccgcgcggacgtcgaccacgctgcggtggttggggctttccgaggcggtgctgatctcggcggtgacgccgcgctcttcggccagcgccggcgcgttgacgaacgtcacgggcccctccacgacggcggagaacaacacccgcagagccgaaagtttcagcacctcaacgtcttccgacgccaactcgccgcgcacctgcaccgacagcgacaccggcgggccgtcggacagcgtggcggccagcaggccgagcttgcgcaccaggtccagccagggcgccacctcctcgttcaccgtgcccccggcgacgttgaccgcgtcgggaacgaattccccggccagagcgagctttacgctcgcggcgacgtcggtgcccgcccgatcctgcgcctcggtggtggacgcacccagatgcggcgtgaccaccacctgcggcagctcgaacagcgggctgtcggtgcacggctccttggagaacacgtccaggccggccgcgcgcacgtggccgctgcgcaccgcgtcggccagcgccgcctcgtcgaccaggccaccgcgggcggcgttgacgatgatgacgcccggcttggtcttggccagcgcgtccttgtcgatcagccccgccgtctcgggggtcttgggcaggtgcacggagatgaagtcggcgcgggccagcagctcgtccaacgacaacagctcgatacccagctgcgcggcgcgggccggcgacacgtacgggtcgtaggcgatgaggtgagtgccgaaggcgctgagccgctgggcaaccagctgcccgatccggcccagcccgacgacgccgaccgtcttgccgaagatctcggtgcccgagaaggacgaccgcttccaggtgtgctcgcgcagcgaggcgtcggccgccgggatctcgcgcgcggcggccagcagcagcgccagcgcgtgctcggcggcgctgtggatgttcgaggtcggcgcgttgaccaccagcaccccgcgctcggtggcggcgtccacgtcgacgttgtccaggcccaccccggcgcgcgcgacgatcttcagcttgggcgcggccgccagcacctcggcgtcgacggtggtggccgagcgcaccagcagcgcgtcggcctccggcacggccgccagcagcttctcccggtcgggcccgtccacccagcgcacctcgacctggtcgcccaaggccgcgacggttgattcggcgagtttgtcggcaatgagtacaactggcagattcacccggccagcctatcggctgtaattgacgggtggacgtcaccatcgtcggcagcggacccaacgggctgaccgctgcgctcatctgcgcccgggccggcctgaaagtgcaggtcgtggaagctcaaccgaccttcggtggcggcgcgcgcaccgcggccgaccccgactcagcgggagttttgcacgacatctgctcggcggtgcatccgctggcactggcctcgccgttcttcgccgagttcgacctgcccgcccgcggcgtgcaactggcggtgccggagatctcctacgccaacccgctgccgggccgcccggcggcgatcgcctaccgcgatctggaccgcacctgcgccgaactggagcacggcgcgtccttccggcggttgctcggcccgttggtcgcccgctccgacgacgtggtggccctgctgctgggcgacaagcgttcgctgccgaactcgccgacgtcggcgttgcggctcgggctgcggatgctcgcccagggcacgcccgcctgggggacgctggccggcgaggacgcccgcgcgctgttcaccggcgttgccgcccatatcatttcgcggatgccctcgttgacggcggccggcgccgggttgatgctggccacgctggcgcattcggtcggctggccgatcccggtcggcggcagccaggcgatcaccgacgcgctgatcgccgacctgcgcgcgcacggcggcgaactcaccgcgggcgccgaggtcaccgaaccgccgggcggtgtggtcgcctacgacacagcgccgaccgccctgctgcggatctacggtgacgctctgccacctcggtacgcgaaagcgttgcggcgctacacctttgggcctggtgtcgccaaggtcgacttcgtgctttccgacgagatcccgtggtcggacccgcggctgcggcaggcccccaccctgcacctgggcggcacccgggagcagatggcccgcgccgaggccgacatcgccgccggccggcacgcgcagtggccgatggtgctggccgcctccccgcacgtcgccgaccccggccgcatcgacgccgccggccgtcgcccgttctggacctacgcccacgtgccggcggggtccacactcgacgccaccgaggccgtcaccgcggtggtcgagcggttcgcgcccggtttccgcgacgtcgtggtcgcggcgcgcgcgataccggccgcccggttgtgcgatcacaacgccaactacgtgggcggcgacatcgggatcggcggcaactccgcgtggcgggcgatcgcggggcccacgccacgggtaaacccttggagcacaccgattcccaaggtgtatctgtgctccgcggccaccccgcccggcgggggcgtgcacggcatggccggctactacgccgcccgcacgctgttgcgccgcgagttcggcctcggcatgcctaggctggctccatgaccaaactcgcgatcatctactactcggccaccggacatggcaccacgatggcgcgacgcgtcgccgcggccgccgagtcggccggggcgcaggtccggctgcggcacgtcgccgaaacccaggacccggaatcgttcgcccacaatccggcctggacggccaattaccaagcgacgaaagaccttccggcggccaccggcgacgacatcgtctgggccgacgcggtgatcttcggctccccgacccgcttcggctcgcccgccgcgcaactgcgcgcgtttctcgactcgctgggcggactgtgggcgcaaggcaagctcgccgacaaggtgtatgcggcgttcacctcgtccaacaccctgcacggcggccaggagaccacgctgctgtcgctgtacatcacgctgatgcatttcgggggcatcatcgtggcaccgggctacaccgatccgtccaagttcgtcgacggcaacccgtacggggcaagcctggtcaccacccacgacaacatccacgagttcgacgagcccaccgcgaacgccctcgaccatctggcccgccgggtggtcgagacggcgggacggctggcttcctagctgacgaacgtcacgccagcgtgacaccggtgaccgagtgtcacgccagcgtgacggtcgacgaaagcgctaggccgtctcggtgatcggccggtcgacccagctcatcaggtcgcgcagccgcttgccgaccacctcgatcgggtgctcggcgttctccttgcgcagctgctcgagttgcttgttgccgccctcgacgttggcgaccagcttcttgacgaagtcgccgttctgaatgtcgcgcaggatctcccgcatccggtccttggtcccggcgtcgatgacgcggggcccggacagatagccaccgaactccgcggtgtcggacaccgagtagttcatccgcgcgatgccgccctcgtacatcaggtcgacgatcagcttgagctcgtgcagcacctcgaagtacgccatctccggcgggtagcccgcctcgaccatcacgtcgaaaccggccttcaccaattcctctgtgccaccgcacaacacggcctgctcaccgaacaggtcggtctcggtctcgtccttgaaggtggtcttgatgacgccggcccgggtgccgccgatggccttggcgtaggacagcgccagcgcctcacccttgccggtcgggtcctggtcgacggcgatcaggcagggcacacccttgccgtcgacgaactggcggcgcaccaggtggccgggccccttgggggcgaccatcgcgacggtgacctcggcgggcggcttgatcaggccgaagtggatgttgagcccgtgaccgaaaaacaatgcgtcgccgtccgacaggttcggctcgatgtcgttcttgaagatgtcggcctgcgcggtgtcgggggccagcagcatgatgacgtcggcccacttggccaccgcggccggggtgtcgacgtcgaggccctgctcggaaaccttggcgcgcgacttcgaaccctccttcaggcccaccttcacctgcacgccggagtcgcgcaggctcagcgagtgcgcatgcccctggctgccgtatccgatgacgccgaccttgcgaccctggatgatggtcaggtccgcatcgtcgtcgtagaacatcggcaatgtctccccggacgggttagccacttcactatctccttctcgttgcagctgaaaacttacttggccgtgccgattccgcgcggaccgcgggacagcgacaccactcccgattggacgatctcacggatgccgaagggctccagcacccgcagcagcgcctcgatcttgccgcggtcaccggtggcctcgatcgtcagcgcctccggcgaaacgtcaatcaccttggcgcggaacaggttcaccgcctcgataacctgactgcgggtgccggcgtcggcgcgcaccttgatcaacgccaattcccgcgacaccgagttgccgtcctccagctcaacgatcttgatgacgttgatcagcttgttgagctgcttggtgatctgctcgagcggggtctcctcggcggagaccacgatcgtcatccgcgacatgtccttctgctcggtggcaccgaccgcaagcgattcgatgttgaaaccgcgccggctgaacagcgccgccacccgggcgagcacacccggtttgtcttcgaccagcaccgacagcgtgtgcgtctgcggactcatcaggcgtgcccttcggtctcgtcgtcgaacagcgggcggatcccgcgggcggcctggatctcgtcgttgctggtgccggcggccaccatcggccacacctgcgcgtcggcgccgacgatgaagtcgatcaccaccggccggtcgttgatcgcccgggcagcgttgatcacgtcgacgacgtcttcctcacgctcgcaacgcaatccgacgcagcccagcgcctcggcgagcttgacgaagtccgggatgcggtgcgagtgggtggccagatccgtttgcgaataccgctcttcgtagaacagggtctgccactggcgcaccatgcccaggttgccgttgttgatcagcgccaccttgatcggaatgccctcgacggcgcaggtggccagttcctggttggtcatctggaaacagccgtcgccgtcgatcgcccacacctcggcctccgggcgagccatcttggcccccatggcggccggaatggcgaaccccatggtgcccaggccgccggagttgagccaggtgcgcggcttctcgtaggagatgaattgcgccgcccacatctggtgctggcccaccccggcgacgtacaccgcgtcggggccagcgatctggcccagcttctcgatgacgtactcgggcccgaggctgccgtcgctctgcggcccgtagctcaacggataggtggactggacgtcgtcgaggtaggcccaccagtcggcgatgtcgagattgccgggcgccccgtcgtggcgcagcatctcgaccagttcggcgatgacggccttgacgtcgccgacgatcggcacgtcggcatgccggttcttgccgatctcggccgggtcgatgtcggcgtggatgaccttggcttccggggcgaaggtgtccagcttgccggtcacccggtcatcgaaccgcgtacccagcgcgatcagcaggtcgctgcgctgcagggccgccaccgccgcgacggtgccgtgcatcccgggcatgcccaggtgctgacggtggctgtccgggaacgcgccgcgggccatcagcgtggtcaccaccgggatgccggtcagctcggccagttcgcgcagctgctcgctggcctccccgcggatgacaccgccgcccacgtacagcaccggtttgcgggcggccgcgatcagcttggcggcttcgcggatctgccggctgtgcggtttggtggtcggcttgtacccgggcaggtggatgcgcggcggccagctgaacgtgcactggccctgcagcacgtccttggggatgtcgacgagcaccgcgccggggcggccggaggcggcgatgtggaacgcctcggcaagcacctgcgggatctcgttgccggagcgaaccaggaagttgtgcttggtgatcggcatggtgatgccggagatgtcggcctcctggaaggcgtcggtgccgattagcgtgcgtcccacctggccggtgacggcgacgacgggaatcgagtccatctgggcgtcggccagcgcggtgaccaggttggtggcgcccggaccggaggtggccatgcagacaccgaccttgccggtggcgtgcgcgtagccgctggcggcgtgaccggcgccctgctcgtggcggaccagcacgtgccgcagcttcttggagtcgaacagcgggtcatagaccggcagtaccgcgccgccgggaatgccgaagatcacctcgacgccgagctcctccagcgatcggatcaccgattgcgcgccggtaacttgttcgggcccaatgcgtttcggtttgccggcggcgggcttcgcggccggggccggcggggccggggcgatgccggcagcgccgggtgcgtcgggggcgggccgcctggtgggagcgctcactgtcgatcagtccttattcactctgggagtctcgcggggcaacaaaaaacccccgacagcttgtgctgcacgagggttgcgcgttggtgctggattgcttcacatgctgacgggcaactcaggcaccaacgcgcctaattactacgagcatcccgggctttccggcggtatccatagcgctcgacggtagtcttcgcacagctcagcagtcaaatccgtggccgtgggcgccccgctggtcagggtgaaatgatggtcgggtggccagtggttcgtcgtccccagtaccgtccccaccgcccgctgcggccccggtggtgatcaaggtgtcacccgtcgcgcacctggccgtcgggtttttgaccttgggcctgctgataccggtgatgctctggccgccgtcggcgccgttgctgctgctgccggtgctgctttcggcgctgatcgtgcggttgcggaccgtcgccgacgatcgcggcgtgaccgtgcgcacgctgctggacagccggacggtgcgctgggacgacatcgacgggctgcgtttccaccgtggttcctgggcgcgcgcccgcctgaaaagcggcgacgagctgcgcctgccggcggtcacgttcgcgacgctgccggagctgacccgggccagcgccggccgggtgcccaacccgtaccagtgaaaccggtgaaaacgccgctcagccgatcggattcacgccgttgagcgccacccacaccccgacaccggcggcgatgccggccagcagggcgacgaacgacccgatgaagggccggtgcgcccagccgcgccgcgcgtccaggccgtagcggcccggtccgcacaggatgaccgcggtcgccatcacgatgagggtgatctggtattcgtgcccctgcggcaggaagaacgagaaggtgtgcgcgtgcggccgcgccgagaccgtcgccagcaggccgttgatcaagaacgccagcgcgcccgccgcggccagcggggtgaacaggcccagcaccagcagcaccccggccaccagctcgccgccggcactgacgtaggccaggatgtcggcgtgctggtagccgacgtcggacagtgagttccggagtcccgtcacgcccgagccgccccaccagccgaacagcttctgcagcccgtgggcgcccagcaccacgcccagcccggcccgcaacaccagcaaacccaggtgctgggttccgcgccggccgacgtcgagcaaccggtcgtggtgctcgtcgtcgtcgacgtcggtcggctcgggggccgcgtgccgggccgccgaatgcggctggacgtagggcaacggctcctgctgttcgagcaggtggtagcccgcggccccggagccggcgaccgcggcggcgccgccgtaggggatgacggtggtggtcccggtggacggattgaagtcgccggggtatccgaccggggtcaggtcatcttcgggatcgaccagccgtgccgaggcggggcgtcccggggttggctccggggattcgccgggccgctgccaatgtgcgtcattcggttgactggtcacgggtgtcagggtaagggcagttggccccgaattggggatttgagcggcgctttcgccaggcaatcggcggtttgcccgccaaatgggcccgccggggcccgaaatcggcccgccggcccgttttgagggccggcgccgggcgggccgaacgcgctctcaatgccgctttcggggccggacatgcgggacgcgtgtggcggcggggtcggcaatgtccgtagcctgacggtcatgcgaggagggcgatcagggcggtcggtgcggcgcgggctcgctgcgctgtgcggcctcgtgctgctgacgagcgggtgcgcacgcttcaacgacgcgcagtcgcagccgttcaccacggcccccgagctcaagccgcagccgagctcgacgcctcccccgccgccgccgctgccgcccaccccgttccccaaggcctgtccggctcccggggtgatgcagggctgcctggagagcaccagcggcctgatcatgggccccgacagcaaaaccgcgctggtcgccgagcgcaccaccggcgcggtcaaagagatctcggtcagcgcggagccgaaggtgaagacggtcatcccggtcgatccgtccggggacggcgggttgatggacatcgtgctgtcgccgacgtatcagcaggaccgcctgatgtacgcctacgtcagcacgccgaccgacaatcgggtcatccgggtggccgacggcgacatccccaaggacatcctgaccgggattcccaagggcgccaccggcaacaccggcgcgctgatgttcaccagccccaccacgctggtggtgctgaccggcgatgcgggcaatcccgcgctggccgccgatcccaagtcgctggccggcaaggtgctgcgcatcgagcagcccaccaccgtcgggcaggcgccgccgaccaccgcgctgtccggggtcggctccggcggcggcctgtgcacggacccggtcgacggctcgctgtacgtcgccgaccgcaccccgacggcggaccggttgcagcgcatcaccaagacctcggacgtctccacggtgtggacctggccggacaaacccggcgtggccgggtgcgcggcgatggacgggaccgtgctggtgaacctgatcaacaccaagatgacggtcgcggtgcggctggcgccgaacaccggcgcggtcaccggcgaacccgacgtggtgcgcaaggacacccacgcgcacgcctgggcgctgcgcatgtcgccggacggaaacgtctggggcgcaacggtcaacaaaaccgccggggacgccgagaagctggacgacgtggtgttcccgctgttcccgcagggcggcggcttcccgcgcaacaacgacgacaagacctaactgtcgacgcgtcgagcgtgggccctaggtacgaaattcgttgattagtgcgtcttttcccacacgctcggcgagctgcgggtgctcagcctagccttggccgcaggcggccagcaccagttcgcgtacccgcgcggcgtcggcctgcccgcgggtggccttcatcaccgccccgacgatcgcgccggccgccgcgatcttgccgccgcggatcttctccgccacatcgggattggcggccaacgcctcgtcgaccgcggcctgggtgaccgagtcgtcgcgcaccagctcgaggccgcgggcgttcatcacctggtcgggttcgccctccccggccagcacgccttccacgacctggcgggccagcttgttcgagagtttgccctcgtcgaccagggcgatcaccgcggccacctgggcggggctgatgttcagttcgtccagcccgatgttggcctcattggccttttgcaccaagaagtttccccaccaggcgcgggcctgctcactgggtgcgccgtgcttgacggtctcgatgaccaggtccaccgcgccggcgttgaccagatcgcgcatcacctcgtcggaaacgccccactcctgctgaatccgcttgcggctcaaccacggtagctcggggatggtcagccgcagccgctccaccagttcgcggctgggcgcaacgggctccaggtcgggctcggggaagtagcggtagtcctcggcggtctccttgacgcgcccggggctggtgtagcccgcttcgtgaaagtggcgggtttcctgggtgatccggccgcccgaggccagaaccgcggcctggcgctgcatttcgtaacgcaccgccacctcgacgctcttgagcgagttgacgttcttggtttcggtgcgggttccgaactcggcggtgccgatcggtttcagcgacacgttggcgtcgcagcgcatggagccctgatccatccggacgtcggatacacccaaggcgcgcaacaggtctcgtaaagccgtcacatacgcccgggcaatctgcggtgcgcgctctcccgcgccgacgatgggtttggtgacgatctcgatcaacggcacaccggcacggttgtagtcgatcagcgacgtcgtcgcgccgtgaatgcggcccgtctcgctgccgatgtgggtgagcttgccggtgtcctcctccatgtgcgcgcgttcgatgtccacccgccaggtggtgccgtcgtccagcggcgcctccaggtagccgttgatggcgatgggctcgtcgtactgcgaaatctggtagttcttcggcatgtccgggtagaagtagttcttccgggcgaaccggcaccagggcacgatctcgcaattgagtgccagcccgatccggatggccgactcgaccgcggcctggttgagcaccggcagcgagccgggcagccccaggcacacggggcacacctgggtgttgggttcggcgccgaacgcggtggtgcagccgcagaacatcttggtcaccgtggacagctcgacgtgcacctcgaggccgagcaccggatcgaaacgcgcgatgacatcgtcgtagtccataagctcggcgttggcggcaacactcatggcgtcgatcctagtggggaccgcgaccgcgctgctctcccctgcccgggaacatatcggccagtgcggccgccatctcgaggtagctgcgccggctttccttgctcaaccggtccagcgcgatctttctgccctcgtgcacgtgccggtcgaacggcaacaccacggtggcgccgacccgggcggacagccggtcgagttcggtgacggccaccgcgtccaccttggccggctcgacatggttgacggccagcacggtcgagcgcatcagtcgctgatacccgttgtggcgcaaccactccagcgtggtctgggtcttgcggatggcgtcgatcgccgggctggtgaccaccaccagcgcccgcgactcgggcagaaccgcttccatcacactggaattgagcgccttgacacaatcgaccaacaccaccgagtagtggttgcgcagcatcgaaaacgccttgacgacgtcctggcgctccagccgccagtcggtgcgcgcatagtccggcaagccgagcacttccagcctgaagccgttcatgtaggtcagcgcccggatgtcctcgtaccgggtcgccgggccgccgcgcagcaggttggccatgctgtgcgggttgtgccggccgtgccgctccgcgagatctccggcgtcgatgtccagggcgagcacccggtcgtcgcgcacggcggcgaaggtggaaccgagcgcctccaccaccgccgtcttgcccactccgcccttgaggttgagaacggcgatgggaaaggcggcgccgacggccgcccgaatgcgggcccggagttcgttttcgtaggtggcttccttgcccgggccgaggtcgattccggtgaggcgatgcaccaggccccgccagtcgaaccgggccgcctcgtcctcccgctggtcgaagcggtccagcgcggtggcgcccagcgtcggcgtcggccgagcgggcggcgaaacccgctgggacggcgcgggcggccggcgaccggccgggccgtgcggttgcgggacggtggcggccgcggggtcgttgccggggcgccatccgggcggacgcggcgcgcccggcgcccccgccgatgcagcgggctgctgaacggctccgcgaatcgcaccgcggttgcgcatacccccggtataacccttatgacccggtccggaaaccacaaataggcggtcagtgcgtcaacctggaccgttcgccggcgaattcaggccgcggttgactcgtcgccaccgattgtttgcccgaccgcgggcccgaccgcctaaccgaagaacgcggcggcgtcgtcgtagcggctttcgggcaccagcttgagctgacgcaccgcgtcggccagcggcacccgtccgatgtcctgcccgcgcagcgacaccatctggccgtactccccggcgtgcgcggcgtcggccgcgttcacaccgaaccgggtggccagcacccggtcgtaggcggtcggggtgccgccgcgctgcacgtggcccagcaccgtcacccggacctccttgttgatccgcttctccacctcggcacccagctgcgcggccaccccggtgaagcgctcatggccgaattcgtcaatcccgccttcccgcaaggaaatcgaaccggggatgggtttggcaccctcggcgacgacgcagatgaaatgcgaatccccgcgctggaagcgacgtttgacgagccggcagacttcttcgacgtcgaagggctgctcggggatcagggtcatgtgcgcgccggaggccagtccggcgttgagcgcgatccagccggcgtgccggcccatcacctccaccaacatcacgcgttgatgcgattcggccgtgctgtgcaggcggtcgatcgcgtcggtggcgacggtcaaggcggtgtcgtggccgaaagtcacgtcagtgcaatcgatgtcgttgtcgatggtcttcggcaccccgaccacgggaacgttctcctcggagagccagtgcgcggccgtcagcgtcccttcgccgccgatcgggatgaggacgtcgatcccgttgtcgtcgagggtctgcttgatctggttcagcccggcccgcaacttgtccgggtgcacgcgggcggtgcccagcatggtcccgcccttggccagcagccggtcgttgcggtcgtcgttgtgcaactggatgcgccggttctccagcaacccgcgccagccgtcctggaatccgaccaccgacgagccgtaccgggagtcgcaggtccgcaccaccgcccggatgacggcgttgagcccggggcagtcgccgcctccggtgagcactccgatccgcatgacctcatcttgcctggggcggcggcttcatggcgagctgcttagatcgcgctgcgcagcgggccgcgcgcggcctcgtaggcggcgccgacccggtacaaccggtcgtcggccagcgcgggcgccatgatctgcaaccccaccggcaggtcgtcgtcgggcgacaatccggatggcaccgacatgccgcagttcccggccaggttcagcggcagcgtgcacaggtcgaacaaatacatggccagcgggtcgtcgaccttctcccccagcccgaacgcggtggtcggggtggccggcgagaccaccacgtcgacggactcgtaggcggcgtcgaggtcgcgggcgatcagcgtgcgcaccttctgggcctggttgtaataggcgtcgtagtagccggccgacagcgcgtaggtgccgatcatgatgcgccgcttgacctccgggccgaaaccggcggcccgggtcagcgccatcacctcctcggcgctgtggctgccgtcgtcgccgatgcgcagcccgtagcgcatcgcgtcgaagcgggccaggttgctagacacctccgagggcaaaatcaggtagtaggcggccagcgcgtactcgaagtgcgggcagtcgacctcgctgacctcggcgcccagcgcggtcaactgctcgacggcggcctcgaaggaggccagcacgccgggctgatatccctcgccgcgcagctgcttgaccaccccgacccgaacacccttgaggtcaccggccgtgccggcccgggcggcgccgacgacgtcgggcaccggcgcgtcgacggaggtggagtcgcggatgtcgtggccggcgatcacctggtgcagcagcgcggtgtcgagtacggtgcgcgcgcacgggccgccctgatccagcgatgacgcgcaggccaccaggccgtaccgggacaccgtgccgtaggtgggcttgaccccgacggtcgcggtcagcgcggcgggctgccggatcgagccgccggtgtcggagccgatcgccagcggcgcctggaacgccgccagcgcggccgcgctgccgccgccggaaccgccgggcacccgctcgacattccacggattgcgggtcgggccgtaggccgagttctcggtcgaggagcccatcgcgaactcgtccatgttggtcttgcccaggatcgggatgcccgcggcccgcagcttcgtggtgacggtggcgtcgtacggcgaacgccagccctgcagaatcttggacccgcaggtggtgggcatgtcgacggtggtgaagacgtccttgagcgccagcgggaccccggccagcggcgagggcagccgctcgcccgccgccaccgcctcgtcgacgaccgcggccgcgcccagcgcctcgtcggcggcaacgtgcaaaaaggcgtggtagcgctcgtcggtcgccgcgatctgatccaggcaggcctgggtgacctcgaccgaggacagctccttggcggcgatgcgggcggccagcgtcgcggcgtccgaccggatgatctcgttcactcgtcccccaggatctgcgggacggcgaaccggccgtcgacggcttcgggcgcttcggccagcgcttcggcctgcgtcaggcagggcatcggctcgtccgggcgggtgacgttgaggtccttcagcgggttgtcggtcggttcgacgccggtgacgtcgaccgcctgcacctggctgacgtgggtgaggatggcgtcgagctggccggcgaagctgtcgagctcggcgtccgtcagcgccagccgggacagccgggccaggtgcgccacctcatcgcgggagatctgggacacgatcggaaagcctagcccgccgcgtccgccgcgctggcgtgacgttcggcggccaccgccacgctggcgttacgcccggttacgcccggcgggcagaacaccccgggctgtgcaacagtgttggccgtgccgtcctatctgttgcgcatcgagctcctcgaccgtccgggcagcctgggatcgctggcggtggcgctcggttcggtgggagccgacatcctctcgctggacgtggtggaccgcagctcgggttatgcgatcgacgacctggtgatcgagctgccggccggggccatgcccgacacgttgatcaccgccgccgagtcactgtcgggggtgcgggtggacagtgtgcgtccgcacaccggtctgctggaggcccaccgcgagctggaactgctcgaccacgtcgccgcggccgacgacaagacggccaggctgcaggtgctggtcgacgaggcgcccaaggtgctgcgggtcagctggtgcacggtgttgcgcagcgccggcggcgagctgcaccgcctggccggcagttcgggcgctccggagaccaaggcggattcggctccctggctgccgctggagcgggcgatgacgctggacagcagcggggactgggtgcctaaggcgtggcgcgatatggacatgacgatggtcgcggcgccgctgggtgacccgcacaccgcggtggtgctgggccggccgggcccggaattccggccgtcggaggtcgcccggctgggctatctggccgggatcgtggccacgatgctgcgctgattcccgcgtgtgcccgaatgatgttgcgctacttaggttttactcgccgccaccacattggccctcggcagacgccttttcagggcggcgacccgcagtaactgaacggtcaggttggtggctcccagtatcgggaacaacccgatgtagatgcgcagcgatctgaccccgtgcagttcgagggtgctgaacacgatgaagcatccgatggtgaacacggcggccgggatcgaaaaggccagcggggaactgcgatcggcgatggtctgcgccgcgcaatcgaattcctcctgcgacatcggttcgcctttgcgcaatttgtccaaagcccttctggtgccgccgatctcctcaccgatcggcgtgggctggcgccccagcagccgcttcacgaaggcgaagacgaagacggcgagcaccaattcggtcacgccggcgagcaccgccagataaccaaacaggcccaagttccttcaccctttcccggacaaggcggtgtggcatcgccggagaactagccgcgggaatgccttgctgctgacggtgtctcgggcgcgacggcggggtcgccgtcttcccagagcagcagctggcgaaccgccggccgcggaccgtagggccgcagcatcgtgctggccggccggggacgcacccgctggggccaccagaaccaccggcccagcagcgcggcgaccgacggcgtcatgaacgaccgcacgatcaacgtgtcgaacaacagccccagcgcgatcgtcgtcccgatctgacccagcaccaacagcgaggcggagacgaaggaggccatggtaaaggcgaacaccagcccggcggaggtcaccaccgccccgctgcccgccatggaccggatgatgcccgtgttcaaaccggcgtggatctcctccctgaaccgggagatcagcagcaggttgtagtcggatcccaccgccagcaggatgatgacggacagcgccaggcagatccagtacagcttgatgccgaggatgtcctgccaaaccagcacggacaggccgaacgaggcgcccaacgacagcgccaccgtgccgacgatgacgatcgcggcgaccaggcttcgggtgatgagcaccatgatcagcaggatgaggctcagcgcggcgatccccgcgatcagcaggtcgtatttggcgccctcggcgatgtccttgtacgttgcggcggtgccggcgagatagatgttggagtcccccaacggcgtgttcttgacggcctgtttggcggcgttgcgaatcggctcgatgtgcgaaatgccttcgggggtggccggatcgccctcgtgcgagatgatcatgcgggcggccttgccgtccggcgagaggaacagtttcagtcctcgtttgaattcggggttggtgaaggcctccggcggcaaatagaacgaatcgtcgttcttcgcggcgtcgtacgcctggcccagtgcggtggcggtgtcggtgttcgcccgggtctgggcgttgatcccgaggttggtggcgtagttggacagcgtcagcgcgaggttcttctcctgatcggcgatctggggcggcaacagggtcaccagtttttgctggcccgcgtccagcttgtccaggctggcggtgagcttttcaaactgcgcgctcagctcgtcgataccgtcgagcgcgtcgaagacggatcggaacgcgaagcacgccggaatgtcgaaacagtgcttctcccaatagaaatagctgcgcaccggccggaagaaatcgtcgaagttcgcgatcttgtcccgcaggtcgttgatgatggcgatggtgtcgtgaaagctctgcgtctcatcgtgggtggaggccgcgagctgcttttgcagcgcatactgctggttgagaatgccgatcgtgtctttgaggttgtcggcctgtttgagcagatcctcggcgcgctccttctggtattgcaggttttcgatgctgccgatgctgcccgcgctgatctggaatgccaacgaggtgtgttcgatcggggtacccaggggccgggtcatggactggacctgggcgatgccgggaaggtgcgcgatcgccttggcgacgcgctccaagttgatcatgtcggccggattgcgcatgtcgtgatcggtctcgatcatcaacagctcgggattgagccgggcctgcgagaagtgccgctcggcggccgtgtagccggtgttcgccggggcgctggccggcatgtaggggcgggcgtcgtagttcgtccgatagccgggcagggcgagcaggccgacgagggcaaccccggtggccaccaccaggatcgggcccggccagcgcacgatcgcggtgccgatgcgccgccacccccgcgtcgccatctggcgtttggggtcgaacagcccgaacaggctgcccaccgtgatcaccgcgggggtcaggctgagcgcggccgccagggcgaccccgatgcctatcgcggccggaatccccaggctctgaaagtaattcagccgcgtgaagcgcagacacaacaccgcacccgccaccgtcagccccgaccccagcaccacatgggtggttccgcgatacatggtgtagtaggcggtttcgcgatcctgcccttcgtggcgtgcctcgtggtaacggccgacgaagaagatcgcgtagtcggtgccggcggcgatgacgagcagcgtgagcaggttcgtcgcatacgtcgacagcccgatcaacccgacgctgccaagaaacgccacaatgccccgggcggcggccatttcgacgatcaccgtgaccaacacgaaaaccgctgtgacggagcggtaaacccacagcagcatggccaggatcaccagcacggtgatcacggtgaccttgaagatgcccttgctgcccacctcgaactgatcggtgaccagcggcgccgccccggtcacgtacgccttgacccccggtggcggcggcgtgtgctccacgatgttgcggatggcgtcgacggactcattggccaacgcatcgccctggttgccggcgagatagacctgcacgtaggcggccttgccgtccttgctctgcgagcccgccgcggtcagcggatcgccccagaagttctgtacgtgctcgacgtgtttggtgtcgtgttcgagcttgccgaccaacgcgtcgtagaaccggtgggcgtcgtcgcccagcggcttgtcgccctccaacacgatcatcgccgcactgtcggaatcgtattcgtggaacaccttgccgatgtgctgcatcgcctgaaacgacggcgcggccggggtgttcagggacacgttgtgggccttggccacatcctccaggttcggcacggcgatgttggagatggcggccaccgccacccacaccagcagtatcggtaccgagagacgacgaatcgtctgcgccacaacggatctggtggcctgatccgtggtcatgcggacttcaccagacagaaggtgtaggcgttcacctggttgacgatcctttcgtccttgacgtcaccgtccaccgtgatgcgacagccgagcgaatcactgttgccctgcgccaccaggttgctgaaggccccgggctgggtcgtcaccatggtcaacgaccacggcagggctgcgttgagcacctgccgcggctggacattgatgtccacgtagttgatggtcgccaccgccccccgggttgccgaacacctcgagggtgatgtgcttggggctgaacggctcggtctggtcggagatgccgccggcggccgacgtgttgttgtgcgagccgaagatgccgtgcagccggtaaacgcagaacccggcgacgccgaccaccacgacgacgaccagcaccatccaccctcgcttgaccagcgacgctatcgaaaagcctttcacccgttagcctttcgaattcgggtgacggctcacgccccggggcgagcgcggctgccaacgtcatcagcgggatcgacaggtatcacagtacggtacgggaccgtactgtacaagaggggcgcggcggcagtggcgggcgatgaattccagtgccgccccgggtcgatagctgtatccgcccggccaactgcgaggagtattgatgctgcccaccccgatttcagcgacggacctgaacatctacggcgacgcggagctgccatggagccgggtcctcgaggcgatgcgggccctgccctcccccgagacgccgcagttcctcggcacggtgcgacccgacggcagtccgcacgcggccggcgtcggctcgatcgagcatgccggcaacatctatttcaccagcgggccggcgacgctgaagtcccgcaacctggccgccaatccggcctgcaccctgtcggtgcggctgcccggggtcgacctgatcctgcagggcgacgcgcaccgcaccaccgacgccggtgagctcgacgcggtcaccgcgctgttccgcgacgccggctggccctgcgagcgcgacggcgacgccgtcgtggccccctacggcgcccagagcgccgggccgccgccgtggcatctgtaccgattcgtgctgcgcgccgcggtcggggtcgcgctcaccgaaccgcacggcgcgacgcgctgggcattctccccgtagccgcgccgggtcagcgcgcggtcaggccggggatgaggaacccgtcgaccagcgcctgcacggtgcggcgactgggcggccgggtgggcacgatcgaccggaagatcaggtagccgggcagcaggtcccagagttcgtcggagatggcgtcggcgctgatctcgccgcggtcgacggcctgatgcagcacgtgctcgatcaaagcccggcgctggtccaggaattggtgctgcagcgcgtcgttgagcgccgggtgccgcgacacctcgaacatcaccgcgcggatggtgctggcgtggtggccgacctgctcgcagaccgtctcccccagggccagcaggtcgccgcgcagcgtgccggtgttcggcgggacggccacctggcgcacgccctcgatgaaggcggccagcaccagttcggccttggagggccagcgccggtacacggtggccttgctggcgtgggcggcgccggcgaccgcgtccaccgtcaactggtcatagccgtgttcctgcagcaaccgcagggtcaccgccaggatctcggcctcgcgcggcgaccacggcgaggcctgctcgcagcgatcggccgtctgggtcatagcgcccaccatagatgtgctcggccggtgccgacgaatttcggcgccgcgaacctcgccggatggccacggctgcaaaggtccgtcagcgcagggtcagcagggcccgctcgatgtcggcgagcaggtcgtcggtgtcctcgatgcccaacgagatgcgcgcgaacccgtcggggaccgcgtctccccagcgggcccggcggtccaccgaggtgtgcaaaccgccgaagctggtggaggcgatcagcagctcgctgccgtcgaggagagcgcgcaccgcggcggcgtcggccagttcgacggcgaccaggccaccgaaccggcgcatctgggccctggccaccgcgtgccccgggtgctcggccagcccgggatagcgcaccgcacgcaccgccgggtggcgggccagcagcgtcgccaccgcccgcgcgttctggcactggcgctcgaagcgcagtccggcggttcccaagctgcgcaacagaagccacgcctcgaacccgcccaggatcgccccggcgagcagccgttggcgttccaccgcggccagcaactcgggccggctggtggcgacgtagccggccagcaggtcgctgtgaccggacaacgccttggtggcgctggccaccaccgcgtcggcgcccagcgacagcggctgctgacccaacggcgtggccgcggtgttgtcgaccaccagccgcgctccccgaccgtgacagacgatggccagccggtgcagaccgaccacgtccagcgccggattggtcggcgtctcggccagcaccacgtcggcggtcgcggcggcgtcatagatctgcgcactcgacgcctcgatgaccgtcacacccgcgggcgccaggtcttcggcggcgtggcggcgcacttggtaatagccgtcggccggcaccaccacggtcgacccgggcggggcgagcgcgcgcagcacggcgctgatggccgccatgccggaaccgaacaccagcgcgccgccggcaccctcgagctcggcgagcgccgactccagttgccgccaggtgggatttgagttgcggccatagctgtccacgcccgcggtttcgtcgccggacaggtgataggtggcggccagcaccggctgcggcgccaccggttggcccgaaacagcttgaggatcaacagctttgaggctacgggtggagtcaccgtagttgccgctcatcggctcagtccgccggggtttcgggcgggccctcggccagcagcttgcggaagccgtcctcgtccaggatgggcacgccgagctcgaccgccttgtcgtacttggagcccggcgaatcgccggccaccacgtagtcggtcttcttcgacaccgaaccggcggccttgccgccgcgcgccaggatcgcctccttggcgtcgtcgcgggagaaaccggccagcgacccggtgaccaccaccgtcagcccctccagcgtgcgcggcacgctggcgtcgcgctcgtcggccatccgcacgccggcggcccgccacttgtccacgatcgcgcggtgccagtcgacggtgaaccattcggtgagcgccgccgcgatcgtcgggccgaccccctccaccgcggcgagccgctcggtggacgccgacatgatcgagtccagatcgccgaactcggtcgccagggcgcgcgccgccgtcggccccacgtgccggatcgacagcgccaccaaaacacgccacagcgcaacctttttcgccttctgcaggttctgcagcagccgtgtgccgttcgcggacaacgtgccggccttggtccggaacagctcggtgcgcagcaggtcgtcctcggtgagcgcgaacaagtcgccctcgtcggcgatcaccccggccttgagcagcgcggtggccgcctcgtagcccagcccctcgatgtcgagtgcgccgcggccggcgacgtgaaacacccgctctcgcagctgcgccgggcaggaccgggcgttggggcagcggatgtcggcgtcgccctccttggccggcgccagcggggtgccgcactcgggacacgttgtgggcatgacgaattcgcgttcggtgccgtcgcgcaggtcgacgaccgggcccagcacctcggggatcacgtcgccggccttgcggatcatcacggtgtcgccgatcagcacgcccttgcgcttgacctcggcggcgttgtgcagggtggccagccccaccgtcgacccggccaccttgaccggggtcatgaacgcaaacggggtgacgcgcccggtgcgcccgacgttgacgcggatgtcgaggagcttggtctgcgcctcctggggcgggtacttgtaggcgaccgcccaccgcggcgcgcgcgaggtggcgccgagccggcgctgcaacgcgacgtcgtcgactttgaccaccacaccgtcgatctcgtgttgcaggtcgtagcggtgctcgccccagtagccgatccgctcctgcaccgcggccagcccgcgcacccgcgcggtctgttcggccaccggcagcccccacacgctcagcgcggtgtaggcctcgtgctgggttttcggcgagaacccctcggtgcggccgatgccgtggcagatcatccgcagcttgcgccgcgcggtgacggccgggttcttctggcgcagcgacccggccgcgctgttgcgcggattggcgaacggcgccttgccgtcttcgaccaggctggcgttgagcgcctcgaagtcggcgagcaggaagaacacctcgccgcgcacctcgagcagcgccggaaccgggaagtcgtcgctgggcgagaggcgttcgggcacgtcgtcgatggtgcgtgcgttgagcgtcacgtcctcgccgacccggccgtcgccccgggtggcggcgcgttccagccggccgtcgcggtagaccagcgacagggccaccccgtcgatcttgagctcgcacaggtagtgcgggtccttgccgatctcgttctcgacgcgattgctccaggcgattagctcgtcggtgtcgaagacgtcgtcgaggctcagcatccgctccaggtgcgccgcctcggcgaagtcggtggcgaaacccgccccgccgaccagctgcgtgggcgaatcggccacccgcagctcggggtggcgctcctccagggcgagcagctcgttgaacagcgcgtcgaactcggcgtccgagatgatcggcgcgtccttgatgtagtagcggaactggtgttcgcggaccgtttcggccagctcctgccactgccgccgcacctcgggcggtaccgaatcagcctctgccgagctcaccttggcaggctatccgagccgaccgacgcaaaacccggcaaccttgcgggttgcctattcgatggcgtcggggtcctcggcgaacagttcggccgcccggcgggcgagcccgatcgcggtgcgcgcccactcgggcgtggcgccggccaggccgcacgccggggtgacgccgatccggtcgcgcagagccgagcgggtgaagccgagccgatcggtcaccgcgaccacggcgccggccacctgctcggccgacggccgccgcggcgggacgccgacggcgacgacgcccaacgccaccgcccggcccgactccacgaacgcggccatcccgtcgaggtccgcggcgcccaacgcgctcgcatccaccgacaccgcgctgaacgcgctgtcctgcaacaggttccatggcatatcggggccgcagcagtgcaacagcacctcaccgccgacggtgtggacgcagccgtcgagcaggccgcgcgccagggcctcatcgagaggcggcaccggactgagcgcggtcaccccgggcagcccgccgcccaacgccgccggcagcgacggctcgtcgaactggaccaccaccggcgtctcgaggcggcgggacagccgcgcgcggtgcgcggccacgccctcgcccagcgaggccgccagatcgcgcagcgccccggggtcggtgatcgcccggtgcccgttggccagctcgatctcggcggccagcgtgaccggccccggggcctgcaccttgaccacccggccgtcgttgcgcaggccggcggcctcccaggcctcctccagcgcgtccatgtcctcgtcgagcaggctgatggcgcggcgggtgaccgcgcccggccgggccaccaggcggtaaccgcgcggcacggtgtcgatggccacgtcgaccagcagcgccccggcccggccgagcatgtcggcgcccaccccgcgggcgggcaactcgacgatgtgggccagcgcgcccgccaattccccgacgacgacctcggcggcctcccgcgcgaccgtgccgggccacgatccgacgccgctggccgttgcgaaggggcgggcgaaagcactcaccgggcaaccgtattcgacgtcggccgatccgacggccggcagggggctgggggcccgggcgcggcgcgggtaggttcgagccgaaggggtgcgaaacggtgtcgcagaaggcgaatggtcggtggctgccgctgctgggcgcggtggtgctgctggccgcggcgtgcagccgggtggtggacggggcggcggtgccgggacccggcgccaaccaccgggtggtgcagggcgtcgacgtcgacgccatcctgctggaccagtcgcggatgcgggcgatcaccggcgccggggagcacctgagcatcattccctcgatggacggcaccagtccggtggacatcgaggcgctggcgcagaccgcgccgccggagtgccggttcatctacgccgagacggcaacgttcgggcgcgatctcgaggcgtttcacaagaccaccttccaggacccgcccgacggggcgttgatctccgagggcgcggcggcctatcgcgacgccgacaccgcacggcgcgccttcggctccctggtgggtgcggtcacggactgcgcgaacggctcgggcggtcagctctacgtcggcgactggaacgccgacgccggctcgctgcacctgcggcccggtggctgcgggcgcgactaccggatcctgtcggtggccatgctggaagtcaccttctgcggcttcgcgcaatcggtgtccgacatcgtgatgacgaacatcgccgcgaacgtgccgcgttaggcccggctcagcgcgacgtgccggcgatggtggcgctgccgagcacctcgtcgccgtcggggtcgcgccggtagagcgccagggtctggcccggtgcgacgccgcgcagcggggcgcgcaggcgcaccaccagctcgtcgccgaccagttcggccaccgcgtccgcggtttcaccgtgcgcgcgcacctgaaccgcgcactcgaacggcccggacggagccgtgcccgaggtgaataccactgcgcgcccgagcatttcgcgcacgtcgaggtcggacgcctcccccacccgcacggtcgcggtgtcggcgtcgatcgccgtcacgtagcgcggccgcccgtcggggcccggcccggcgatgccgagccctttgcgctgcccgatggtgaagccgtgcacgccgtcgtgctcggcgagcaccgtgccgtcggcgtcgacgacggcgccgcgtcggaccccgatgcgctcacccaaaaaggcgcgggtgttgccggaggggatgaagcagatgtcgtggctgtccggcttttcggcgacggccagcccgcgccgcgcggcctcttcgcggatctgcggcttgggggtgtcaccgatggggaacgccgcgtgccgcaactgctcggcgctgagcacggccagcacgtaggactggtccttgtccttgtcgacggcgcggcgcagccgcccaccggacagccgggcatagtgcccggtggccaccgcgtcgaacccgagcgcaacggctttggccgacagcgccgagaacttgatcttctggttgcacgtcacgcaggggttgggtgtttcgccgcgggcgtaggccgacaagaactcgtcgatcacgtcggcttggaacttctcggcgaaatcccagacgtagaacgggattccgagcacatcggcgacccggcgcgcgtcggaggcgtcctccttcgagcagcacccccgcgacccggtgcgcagcgtgccgggggcggtggacagcgccaggtgcacgcccaccacgtcgtgtccggcgtcgaccatccgggcggcggcgaccgacgagtcgacgccaccgctcatggcggcaagcactctcacttacgaagcccccgctgcggccagcgcggcccggcgagcgcgttccaccgccccgggcaacacccgcagaacggcgtcgacgtccgcgtcgatgctggtgtgccccaacgacagtcgcaacgagccgcgggcgctggccgggtccacgcccatcgccaccagcacgtgcgacggctgcgccacaccggcggtgcacgccgaaccggttgaacactcgatcccgttggcgtccaacaacatcaacagcgcatcgccctcgcagccgcggaaggtgaagtgcgcgttgccgggaaggcgcaacggatcgcgggcgccgttgagggtgacgtcctcgatgccgcccagcaccccgtcgaccagtcgatcccgcaacgcgcgcagccgggcgctgttggtttccagcccgtcgaccgagatccgggccgccgccgccattccgaccgccccggcgacatcggctgtgcccgaacggatgtcgcgttcctgcccgccgccgtgcgccagcggcacgcacgcgacgtcgcggcgcagcagcagcgcgcccacggccggcgggccgccgaacttgtgcgcggtcacgctcatcgccgacaacccgctggcggtgaagtcgaccggcagctggcccaccgcctggaccgcatcgctgtgcatcgggacaccgaattccgctgcgacagcagccaattcggcgactggctgcacggtgccgacctcgttgttggcccacatcaccgagaccagggcgacgtcgtcgtgacgggtgagcacctcgcgcagtgcggcggggctcaccgagccgtcggcggcggtcggcagccaggtcacctcggcgccttcgtgttcgacgagccagttcaccgagtccagcacggcgtggtgttccacctcgctggtcacgatgcgccggtgccgcggctcggcgtcgcggcgggcccagtagatgcccttgaccgccaggttgtcgctctcggtgccgcccgcggtgaagatcacctccgaggggcgcgcgcccagcttgtcggcgatcagctcgcgggactcctcgatgcgccgccgcgccgcccggccgctggtgtgcagcgaggaggcgttgccgaccgtgccgagcacagccgtcatcgcctcgacggcggcggggtgcatcggggtggtggcggcgtgatccaggtagaccatgacccgacccacgataccggccggccggcgggctcaggccaccagcacgcgcccgtgaccagcgcgccgggccgccgccacgcccaccgcggactggcagcgcccggccagggcgcgccggtcggtcccgggcagctgcagcgactcgacctgcacccgcgccagcgtgcgccgcacggtgagcagccggcggatcgagcccagcagcgtctcgtcgccgacgaaggctcggcgcggtggaggtgctgccgtccacgtgctggtaggtcagccgcagcggctgcaccggccgcccggcgtcgatcgccgcctggaacatggccggatagaaggcgccgcggcccctgtgcgatggtccgcctcctcctccggccgctccccggccggcatcgtcgccggacgtgtgcgacggtccgccgcctcccccggcatcgtcgccgtcgcggccgcaccaggtggtgccctccgggaaggccaccaccgtctggccggcccgcagccggtgggcgacggcgtccaccacgccgggcagccgccgcaagctggaccgctcgatcgggatgatcttcagaatccgggccaccaccccggtcgccggcccgctgaacatgtcggcgcgcgcgacgaacgacccgggcagcaccgcgccgatggcgaagacgtccagccatgacgtgtgcgggctcaccaccagcaccccgcgcagattgcgaatcgggttgcccgacaccgtgattcggacaccgaagcagcgcagcaccagccggcagtagatgcgctgcacgcgggtgcgccccggcagcggcaccgccagcagcggccagcccggtgccagcagcaccgccagcaccagccgcagcgtcacccgcaccaccacccgcagccgccgctcggccgccggccggccggcggccacgcagcgggcgtcacacgaggcccgcggcagccaggagtgcccgccgcccgcgggggcctgcatcaccggccgcccgccagttccgcggccgccgacaccgatctcagtcgcttcaggtaccgggtgtcggcgtcctgcttgcccagcagcacgcagaagtcgccgaccccgaagtcggggtcgtgtgcgggctcgccgcacacctgtgcgcccaaccgcaggtagccgcgcatcagcgccggaaccgacggccgcgcgggcggcgggatgtcgtccagggcggtgccgtcgacgaccaccggccggtgcggccgcacccggtaccgcgccggcgcgccgtggcggctgacgacgaagtcacgcacgccccgcagccggctgcccgggggcgcatcatcggcgtccccgatgggcaccgacacgcatccggtcacgtagtcgtagccgtagcggtccaggtaggccaggatgcccgcccacatcagcagcaccacgccgccgttacggtgcccgtcgcgcaccacggcgcggcccatctccaccagcgacggccgcagcgggtcgaaggcgcggatgtcgaactcggtggcggtgtagagcccgccggccgcgatcgcgcccgcgggcgccagcatccggtagcagcccaccagctcgccggtgtcgtcgtcgcggaccagcaggtggtcgcagaattcgtcgaaccggtcgacgtcgcggccggacccgtcggccgacggcagggcgaagcccggcgtgctggtgaacacctcgtagcggagccgctgcgccgcctcgatcatgacggggtcggccgacagcagcagggagtagcgcggcgcggccgacgacccggtcgccgaaccgctggggtggtcgctgggtatgaggaccgaagcaatgctcatggcacccaacgtggcgcagccgatgagcgagtcggcatcgacgctgtgacgtgtcggtgcacgtcagatgacgaactgtggcgaaaagcgtgaccgccgttacctcgggcccagcagacgcaaaagcccccgacacgccggggagtcgggggcttttgcgtctgctcgcgcggctatcagcccttgcgggccttgatcgcctcggtcagctgcggggcgaccttgaacaggtcgcccaccacgccgtagtcggcgatctcgaagatcggcgcctcttcgtccttgttgaccgcgacgatggtcttggacgtctgcatgcccgcgcggtgctggatcgcgccggagatgcccagcgcgatgtagagctgcggcgacaccgtcttaccggtctggcccacctggaactggcccgggtagtagccggagtcgacggcggcacgcgaggcgccgacggccgcgccgagcgcgtcggccagctcctcgaccaccttgaagttctccgcgctgcccacgccgcggccaccggagaccacgatgctggcctcggtcaactcggggcggtcaccggcgaccgcgggctcgcgggcggtgatcttggtggcgttctcggcggcggccgggacctcgacggtgacctgctcgcccgcgccggcggccggctcggcgtcgacggcaccggcgcgcagcgtgatcaccggggtgtcgccgttggcctgcgcctcgacggtgaacgcgccaccgaagatggagtgcacggccttggcgccctccttgacctcgaccacgtcgaccagcagcccggagccgatccaggcggcgagccggccggcgatctccttgccgtcggcgttggcggccagcagcacggcggccggggcgttcgactcggccagcgacgccagcacgtcgaccaccggggtgatcaggtacttgtcgacgtcgtcggactcggcgacgtagatcttggcggcgccggcctccttcagcccgtcgaccagcggcgcggccgttcccggcgtgccgaccacgacggccgacggctcgcccagcgcccgggcggcggtgatcagttcggaggtgaccttcttcagtgcaccctcggcgtgctccacgagcaccaatacttcagccatggtttatcgctcttctcgtctgtgggatgtgggctcgtcttagatgatcttctggccgaccaggtactgggcgatctggttgccgccctcgccctcgtcggtgaccttctcacccgcggtcttcggcggcttcggcgtcgaggacagcacgctggaaccggcgttggccagcccgacctcgtcgggctcgaccccgatctcggccagcgtcagcaccgtgacctctttcttcttggcggccatgatgcccttgaacgaggggaagcgcggctcgttgatcttctcggtgacgctcaccaccgcgggcagcgtggcctccaggttgaagaccccgtcgtcggtctcccgctcgccggtgaccttgccgttctcgatggacagcttgcgcaggtgggtgagctgtggcaggcccaggtactcggcgatgatggcgggcaccgccccgcccgtgccgtcggtggattcgtttccggcgatcaccagctcggtgccctcgatggtgcccagcgcgcgcgccagcgcccagccggtctgcaccacgtcggagccgtgcatgccgtcgtccttgaggtggacggccttgtcggcacccatggacagcgccttgcggatcgcctcggtggcccgctcggggcccgcggtcagcacggtgaccgagccctcgccgccctcgcgctcgcggatctgcagggcctcttccaccgcgcgttcgttgatctcgtccagcaccgcgtcggctgcctcgcggtcgagcgtccagtcgccgtctgtcagcttgcgctccgaccaggtgtctgggacctgctttatcaggaccacgatgttcgtcatgagtgtggttcgtcctcctcgaaggggtccgcagcgatcgactgccagacctcggtacgcgtttttcgcaacgcacagcggtgttactacccggtaacttcgtgcggtatgccttcacaccatagctggtaggagtgcaggttcctgcagcccgtccgccgctgcgcagcggggccagactttccccggttcgcgaatccgacacttcgcgttagcctgcctatgcaatgagcgcactggttcccgacgttcccccgcacccgcccgccggcaccgcaccggccggcgacgcggtgatgatgctgacgggcgagcgcaccatcccgggcctggacatcgaaaactactggttccgccgccacgaggtggtctaccagcggctcgcccggcattgcgcgggccgcgacgtgctcgaggccggctgcggcgagggatacggcgcggacatgatcgccggcgtcgcccgccgcgtgatcgccgtggactacgacgaggccgccgtggcccacgtccgcggccgctacccccgggtggacgtcatgcaggccaacctcgcgcagctgcccttgccggactcgtcggtcgatgttgtggtcaacttccaggtgatcgagcatctgtgggaccaaacacaattcgtcgtcgagtgcgcgcgggtgctgcgcccgtccgggctgctcttgatgtccacgcccaaccggatcaccttctcgccgggccgcgacaccccgatcaacccgttccacacccgcgaactcaacgccgtcgagctcaccgaactgcttgtcggcggcggattccgcgacgtgtcgatcagcggcctgttccacggcccgcggctgcgcgagatggacgcccggcacggcggctcgatcatcgacgcccagatcgcccgcacggtcgccgacgacccgtggccgccgcagctggcggccgacgtcgccgcggtcaccgtcgacgacttcgagctggtgcccagcggcgccgacgccgcctccggccaccacatcgacgacagcctggacctgatcgcgatcgcggtagcaccgtgaattcctcgcacgaccgggttcccggcctgttcaccctggttttgcacacccacctgccgtggctggcccaccacggccgctggccggtcggcgaggaatggctgtatcaatcctgggcggcggcctacctgccgctgctgagggtgctggacacgctggccggcgaagaccgccggggactgctcacgctcggcgtcacaccggtggtcaacgcgcagctcgacgacccgtattgccttgacggcatgcatcattggctggccaactggcggctgcgcgcgatggaagctgccagtgtgcgctcggcgccccggtccaagtcggccggataccaggcgtgcacaccggaagcgttgcgcgccttgggaattcgcgaatcggccgaggcggaacgagccctggacgatttcgccacgcggtggcggcacggcggcagcccgctgctgcgccgactgctggacgccggcacggtcgagttgctgggcggcccgctggcccacccgttccagccgctgctggcaccgcggctgcgtgagttcgcgctgcgcgaggggctggccgacgcggcgttgcggctcggggcgcgaaaaggccggggccccggcgggatctgggcgcccgaatgcgcctacgcgcccggcctcgagcacgactacgccgcggccggcgtcacccatttcatggtcgacggcccgtcgctgcacggcgacaccgcgctgggccggcccgtcggcgacaccgacgtggtggcgttcgggcgcgacctgcaggtcagctaccgggtgtggtcaccgaagtccggctatcccggccacccggcgtatcgcgacttccacacctacgaccacctcaccggtctcaagccggcccgggtgacgggccgcaacgtgccctcggagagcaaggcgccctacgatccgcagcgcgccgaccacgcggtcgacctgcacgtcgccgacttcgtcgacgtggtgcgcaaccgcctgaccagcgagtcggagcggatcgggcggccggcgcacgtggtggccgcgttcgacaccgagctgttcgggcactggtggtacgagggcccgacgtggttggcgcgggtgctgcgcgccctgcccgaggccggggtccgggtgggcaccctgcacgacgcgatcgccggcggcttcgtcggcgacccggtggacctgccgcccagctcctgggggtcgggcaaggactggcaggtgtgggccggggaccaggtcgccgacctggtccagctcaactccgaggtggtcgacaccgcgctgagcaccgtcgacaaggccctctcacaagccgggtcgcagcccgccgcgctggacgggccggtcccccgcgaccgcgtggcggaccagatcctgcgcgagaccctgctcaccgtctccagcgactggccgttcatggtgagcaaggactcggccgccgactacgcccgctaccgcgcccacctgcacgcacacgccacccgggagatcgcgggcgcgctggcgtccggccggcgcgacaccgcgcagcggctggccgacgggtggaaccgcgccgacgggctgttcggggcgctggatgcgcgcaggctgccgcgatgaggaggcgggccgtcgcatgaagatcctgatggtgtcgtgggagtacccgccggtggtcatcggcgggctgggccggcacgtgcatcacctgtccaccgcgctggccgcggccggccacgacgtcgtcgtgctgtcccgccgccccaccgggaccgactcgcgcacccacccgtcgaccgaccagatcagcgagggcgtccgggtgatcgcggccgcgcaggacccgcacgaattcaccttcggcaccgacatgatggcctggacgttggcgatgggccacgccatgatccgcgccgggctgccccccaaactgcacgacaagaagccgggcggcaaccgcccctggcgtcccgacgtcgtgcacgcgcacgactggctggtggcccatcccgcgatcgcgctcgcccaattctacgacgtgccaatggtttccaccatccacgccaccgaagcgggtcggcattcgggttgggtcagcgggccgatcagccgtcaggtgcacgcgatcgagtcgtggctggtgcgcgaatccgattcgctgatcacctgttcggcgtcgatggccgacgagatcaccgaactgttcggccccgggctggccgagatcacggtgatccgcaacggtatcgagaccgcccgctggccgttcgcgccccgccggccgcgcaccgggccggccgagctgctgtatctgggacggctcgagtacgagaagggcgtgcacgatgtcatcgccgcgctgccgcgcatccggcgcacccacccgggcaccacgctgaccatcgccggcgagggcacgcagcagggctggctggtcgaacaggcgcgaaaacaccgggtgctcaaggcaatccgattcgtcggccacctcgaacactccgagctgctggcgatgctgcaccgcgccgacgccgcggtgctgcccagccactacgagccgttcggcatcgtggcgctggaggcggccgcggccggcactcccctggtcacgtcgaacatcggcggcctgggcgaggcggtgatcgacggccagaccggcgtctcgtgcccgccccgcgacgtgcccgcgctggccgcggcgatccgcaccgtgctcgacgatccggaggccgcgcagcggcgcgcctgcgccgcccgggaacggctcacctcggacttcgactggcacacggtggccgacaagaccgcgcaggtgtacctgtccgccaagcgggcggagcggcagccgcaggcccggctgcccatcgtcgaacacgccttgcccgaccggtagcccgtccctaccgtcgagggatggggctgcactacgcgagcgtcgtggacgccgccatcaccgaggtcttcgactggcacgccaggccgggcgcgttcgagcggctctcgccgccgtggtcgccgatacggctgtcaccgaggccgcctcgctcaaagacgggcgcgccaccctggcgctgcccggcggtctgcgttgggtggcggtgcaccagccggacggctaccacccgccgcgacgtttcgtggacagcatcggcggcgacggcctggccgcgcttccggcgcgaatcgcggtgcgctggcggcatattcacgaattcgaggatgtcggcggcgaccgcacccgggtgatcgaccgggtcgagacgccggtgcccgcgtcgctgctgcgacccatgttcgactaccggcaccgccaactcgccggcgacctggccgcccaccggctggccgccgagcacgggttgcggccactgacggtcgcgatcaccggatcgtcgggtctggtcggttcggcgttgaccgcgttcctgcggaccggcgggcaccgggtcatccggctggtgcggcgcgccgcgcgcgggggcgacgagcggcggtgggaccccgaggatcccgacccggggctgtgcgacggtgtcgacgcggtggtccacctggccggcgcctcgatcgccgggcggttcaccgaccggcatcgagaagccgtccgggacagcaggatcgggcccacccggcggctggccgaactgctgggccgcggccggccccggcccgccgcgctgatctcggcgtcggcgatcggctactacgggtacgaccggggcgacgaaaccctcaccgaggacagcgaccgcggcgacgggttcctggccgatgtggtggccgactgggaacgggcgattacgctggcgctggatgcgggcgtgcgggtggtgcaggtgcgcaccggcatcgtgcagtcaccgcgcggcggcacgctgaagctgatgcgcccgttgttcagcgccggtctcggcggccgactgggcgacgggcggcaatggctgtcctggatcggcatcgacgatctgatcgacgtctaccaccgggcgttgtgggacagcagactcaacggtccggtcaatgccgttgcgccgcaaccggtccgaaacagcgagtacacgaccgcgctggccgcggtgttgcaccggcccgcggtgctgccggtgccgtcgctgggtccgcggctgttgctgggcggtcagggcgcccgcgaactcgcgggcgcgagtcagcgggtagccccggccaagctcgccgcggccgggcaccggtttcgccaccccgacatcgagcgggcgctgcgtcacctgttgggccgcggcggctgacggcttggacgaacgaccgggaccgcaacactacctcctcaccgtgttcggctactggtcggcatctcggccgtcgcggctgtgccggtaggcgcgggcgcgcagatcggccagccaccgcggatgcagggacacgcccggcgccgtgttgacgacgggatcgaacgacacgtcgtcgtcgatcacggcggtcaggctgacgcgggccaaaggcgtgaaatcgcctctgccgcaggcttggtcgagcgacacctcgatgccgccgcgttccagacggcggcggacgtcgtccagcgccaggcgggcgccgccgatgtcgcccgcggtgcgggcccgcagccaccagttggcgtcctgatagcgcaacggcatcagggtggtcagcgtctgggcgttccacgaggtggccggccgcagcgccaccgcgcgcgacagcacgcccgacccggcggagaccagcaggatgtcccacggcgtgcccgccggctgcggtgcgttcacccgcagggccaggccgatgaagtccggcagcgcgcccggtgtgccggtggccttggacagccgggcgacgatgcgcgacggcgggatcggcaggccccggcccgccggggcgacgcgttcgacgacgcctccggcaagcaccccgtcgggatggaagaaccgcttgccgcggatcgcggagccccagccaaacggcgccgtcgccagctcgaaaacgttcaccggccgcggattcccgttctgggtcgacggaaacccgcccgagcgcacgaccttcggccgaccgcaggcacgaaacttacgctgccgcaaacgaaccggtgcgccaatcgatcatgcgtagagcgggcaactgttgctgggccccgggcaagcggccgtcgacgtagacctgagccatgaccgcctgccacgactcgaactggggtgacgaccggaccatgccctcgaacaggcccacgatgacggcgttgccgtcgtcggtcagggcgtagaccggaccgccgacgtcgcgaccgtccaccaccatgtcggcgatggcgaaacgaccgccggtgaccgtgccgacggaaccacagtgctggccggtcgatcggcgcagctgacacaccggcagccccggcacggcgcgcagcccgggcgcggccagcagccggcggcccgtcggcagcaggtccgaggccgtcacatcccttgccagagcgatgacttcgtattccaccggcagcgtcgaggcgtcggcggagtcggtgtcgagctggcgacggccgagcaccacctcgccgatcgggtggtggtcacggtcggtcaccgccgactgcccgccgtcgcactgcccgctggtgatggcgacccgcagtcgcggctccaccagtcccaccatgcagacggcgtggccctgatggatttccatgccgggcgacgcggtgacggccgggtcggcggtcgcgtggccgggcgccgcccagagcagtatcaccgcgagggccgacgcgcccgccaaccgcccgcaccgccggccgagcttttccattgggccgcaccacccctcgtgttcctcaggggatcgaacgcgcacgtcactgaacacgggtataccccgcgggcggaccggcaaactcctggtcggcgctggccgtttagcgaagaagcgctgttcgcactggccggcaaacgaacacttccccgcccgccgggcggccgggccaccacgggcggcgccgggagccggcaaccgcggtaggctgctgctcaggttgagttcacagctacgtgtctaacgggagcggtgttcggacactgttcactccctttctcatcaccaatcgataggcgctttcatggctgttcttcatcccgcacggtccgcggaccgattcgacccggcggactgccggtacatggccgacttcgcccgggcccacctgttcgtctacgcgcgcagcctcggcacggtgttgcgggtggacggcgaggtcgacgcgtcgaatgcgcgggacctcaccgcgaccatccgccgcttcggccggctcaagactccgttggtgctcgacctgagccggctgcgcttcatcagcgtcgagagcttccgcgcgctgctgctgctcaacgacgagctgcgcaaatcgcgggtgcactgctgcgtggtgcccggcgcggccatccgggccctgctgcgcctcgtgcacgacaacgggttggccctcgccgattcggtgccggaggcgttccagaacatcgaagacattgtgcgggcccggcgggagttcttgtccgacctggcccggccccggccggcccgcacccatgcgggcagcagcgcggcatcctgatcgcggcgcgtgaagcgttagcggcgttggcttttcgccgcgccacgggcctcacacggtcacgtggcgggccaagcgcgcgccgattcaccgcttcgtctggcgcaaaccagtcaagttcattaagttaatgtttaagttattgaactagatggtatctgatagcggaccgcgccgagcgggcctgacgtcagggctgtggttttgtccgcgtcatcgagggtatgaccggcggtgttcggcccgggcgggactgggcaggccgtgccgtccgggagggagcgctgggacaccatgggagctttgtcgttttcgcccaccaccacggcggcggcgccggcctggacgcgcatcgacgacttcggcgggtggcgggcacacgttcgggcgatggtgttggacgaggtcgccgacttcgtcggaatgcgacgcgccgacgaactcgaccgggcggggatcgggaccgcgggcgacatcctggttcagttcgtctccggcggcaagtgcctgcggtcgacgttcgtctacctgggctggctgtgtggggcaccgcgcgaccgggcggcgctgcgggccgccgccagtttcgagctgctgcacgccttcgcactgctgcaagacgatgtgatggacggtgcgcaggaacggcggggccgtccggccgcgcatctgcagttcggccgctggcatcaagaccgcggattgtccggctcgccacggcgattcggtgaatcggccgccatcctgttgggcgatctctgcctgatctgggccgaacagatgctgcgcgacagcggactcgaagcgcgccgcctgcaacgcgcgtggccgcgctatgacgccatgcgcgtcgagctcgcggtgggccagttcgccgacctgaccaacgacatccggcagtcaccggggctggacgccgtgctggaggtggcgcgccgcaaatcgggtaactacacggtgcgccggccgctggaaatcggcgcgacgatggccgggtgcgacgaccggacggtggcccggctgagccgctacggcgcggcggtgggtgaagccttccagctgcgcgacgacgtgctgggcgtcttcggctcgccggcggtcaccgggaagccctgcgccgcagatctgttcgagcgcaaggccaccgccgtggtggtgagcgcccaccaactcgccgatccgccggtccggcgtgagctcatcgagctcgccactcgtgacgtgctggacgcggccgcgatcgagaggtggaaagcgctgatcgtcgagaccggagcggtgcggctgatcgagcggatgatcagcgaccgcgtcgcgtcggcacgcgagcagctgtgcggcctgcccgtcgacgaatcggtgcgcgccgcgctggccgagatggcggccgtctgtacggatcgcgccgaatgaccgccaccggcacgggagttcggtgagcatgcgggccatcgagggctccgccgatcacgtcgtggtgatcggggccggtctggccggcctgtccgcggcgctgcacctggccggtcgcgggcgggcggtcacggtcgtggagcgcgaagcatggccgggcggtcgggcgggccggcgcgacatcgacgggtatcggatcgacaccggccccacggtgctcaccatgccggacatcatcgaggacaccttcgccgccgtcggcgacaccctggcccggcgactggagctgtgcacgctggatcccgcgtaccgcgccgtgttcgccgacggcagcagcctcgacatccaccgcgatccggaccggatggccgacgccgtcgccgagttcgccggccgcgagcaggcgacgggctaccggcggctgcgggcatggctgacgcgcctgtaccgcaccgagttcgacggattcatcgccgccaatttcgattcaccgctgtcgctgctcaccccccggctggcgcagctgatcgcgatcggcggtttccgcaactgggaccgcatggtcaagcgctatctcagtgatccgcggctgcagcgcatcttcacctttcaatcgctgtatgccggcgtggccccgcgcgacgccctggcggtgtacgcggtgatcgcctacatggacacggtctcgggcgtggtgtttccgcgcggcggcgtccgggcgctgcccgacgcgctggccgccgccgcctccgacgctggggttcagttccgttatggcacaacggtgaccgcgctcgagaagaccggtgggcgggtcggcgccgtactcaccgaacaggccggacgcatctcctgcgacgcggtggtgctgaccaccgagctgccgcaaacctatgcgctgctgggccgcacaccgcgtcgcgcgctgcggttgcggcactccccctcggcggtggtggcgcatgtgggttgtcccgcggtggcatcgcagaccgcgcaccacaccatcttgttcggcgacgcctgggatcacacgttcgccgacatcatcggcgccggccaactcatgcgggatccgtcgctgctggtcacccggccgacggccagcgacccgacgctggctccgcgaggacgcgacctgctctatgtgctcgccccggcgccgaacctggagtcgggcggcatcgactgggacagcgtcgggcgcggctacgtcgacgacctcatcgcgctcgtcggtcagcggcttcttcccggtttgccaggcagcgcaacggttttggatgtcgtcacacccgcggactgggcgcgccggggcatggccgcgggcagtccgttcgcgctcgcgcacacgttcgcccaaaccggcccgttccgcccggccaacatggtgcgcggcatcgacaacgcggtgctcgccggatcctccacggtgcccggggtcggggtgccgaccaccctgatctccgggcgactcgccgcggaccgcatcaccggcgtcagcaagcgaacgcccgcgcgcatcgacatgaaagccggttcgccatgatgcgcagcgaatgggccgcggccggaatcgaggatccgctgctgcgcgaggggtatcgccgatgccgcgagctcaacgccgcgcacggccgcaccttcttcctggccaccaggttgctcgcacccgaccagcgcccgcccgtgcacgcactgtacggcttcgcccgctacgccgacgacatcctcgacgacctcgacccgcgggtgggcccccgcggtgcgcgcccggcggctgcaacggctgtcggagcgtctcttctccggcggtgcgcacgccgacgatccgttggtggccgcggtcacccacaccgcgcggcgctaccggatcagctcccaactgttcgcggactttttggcctcgatgcgcatggacctgaccgtcaccgactatccggaccgggaagcgctcaaccgctacatgcgcggatccgcggaagccattgggctgcaagtgctcccgatactgggtaccgttacgccggtggacgaggccgcaccctatgcggcggccctgggccgggcgttccagctcaccaacttcctgcgcgacgtcgacgaagatctggcgcgcggccgggtgtacctgccggcggacgaacttgccgccgacggcgtcgaccgggagctgctgatgtggtgccacgagcaccgccgcaccgatccgcgggtgcgccgggcgctgatcgcacagcaccacatcgcccgtcagacataccgattcgccaccgccgggatcgcggtcctgcagcaccgctcacggccgtgcgtggcggccgcggcggcgttgtattcggagatcctggactgcatcgagaaaagcgatttcgcggtcttcgaccaccgggccaccgtgggcacggcgcgacggctgcgggtcggcgcggtggggctgatccgctcgtggcgggcgcgcaacagcggtcggggtattcggtcgggggccgcatgagcgatcggtggcaatacctggtggtgctcgccgcctgtctggtggtcaccgcgccgctggagatcgcgggtgcgggcgtctaccggaggtggcgacggctcgccgcggcggtgctgccggtggccgcggtgttcttgctctgggatgagatcgccgtggccgcgcgggtgtggacgtacgaccacgcctacctgtgcgggctgagcatccccgttcgggtgccgatcgaagagttgctgttctttctcatcatcccggtgtgtgcggtgctgacctacaacgcggtgagcaccatcctggacaaggtgcgccgccgatgaccggcctgggctacaccctgccggccgcactggcggtggtgatcgtgtgcgccgcggagttgacggtgctgcggaccgggctctttcgccggccggcctactggctgtcgatgctcatcgtgctgggattccaggtgccggtggacggctggctgaccaaacgcagctcgcccgtggtgatctacgacgaccggcagatcagcgggttgcgtttcccgttcgacatcccggtggaggattttctgttcggcttcgcgatggtcaccgcggtgctgctgctctgggaacgacgacgtgcgcgccggtgacacgcgccccgccccgggcaacctggcggccgcgttcgacgccggcgccgcgacctacgaccggctggtcggcgccagcccgggctaccatgcgcagctgctgctgtcggcgcgcaggatgcgaataccgcacgacggcaagggcttacgcctgctcgatgccggctgcggaaccggtgcgtcgacggccgcgctgctcgccgtcgcgccggcggccgacatcgtcgccgtcgacgcgtcgcgcggcatgctggaggtggcgctggccaagcggtggccggcctcggtccggttcgtgcacgctcccgtccaacgactggcagaacacgggatcagcgggccgttcgacggcgtgctggccgcctacctgatccgcaacgtcgccgaccgcgacgagcagctacggcggttccgcaccctgctgcggcccggcgcaacccttgcggtgcacgaatattcggtgcgcgactccgccgccgccacgcttgcctggcacgccctctgctggggcatcatcattccggccgggtggtggcgcagcggggataccgcgctgtaccgctacctgtggcgcagcgtgctcgcattcgacggcgccacccggttccgggcccgactggccgacgccggcttcaccgccgtccacagcgagaccatgcccggctgggaagccggcatcgtgcacaccttcctcgcggacgcaccctcatgaccgcgggtgccaccgaccgccgccgtcggatactgcctgcgccaaccggattgccggatgccggtgcgctgccgtcccgcccacgggtggcggtggtgggcggtgggatcgcgggcctgaccgccgccaccgggctcgccgagcgcggcgtcgccgtcgaggtcatcgaacgtgagcactacctcggcggccgggtcggcggctggaccgaacaccacgacggaaccgacctcgcgatgaaccgcggcttccacgcgttcttccggcagtactacaacctgcgcgcgttgctcgtgcgcctcgatccgcgcctgcgaatgctggtgccggtcaacgattacccgctcatcgacgcggcgggacgacgagacagcttccgcggcctgccgcgtaccccgccgctgaacgccatggccttcgccgtgcgcagtcccaccttccggctgcgtgacttcgcccgcatcgacgctcgtgccgccgcgccactggccgcggtgtcggtgcccggaacctaccggcgcctggaccacatcgatgccgcgacgttcctcgaggacatccgattccccgaggccgcacggcatctggcattcgaggtgttctcccgcagcttcttcgccgacccggccaaactgtcggccgccgagttggcgaccatgttccacatctatttcctggggtcggccgagggcctcatcttcgacgttccgagcgccaactacgacagcgcgctgtggcagccgttgcgcagctatctcgaacaacgccacgtccggttccggctgggcactagcgtgggaagcatcgacgcggcgaatcgctttgccgtgcataccgataccgatgaggagctggaggtggacgccgtggtgctggccacagacgtcgccggcctgcagcggatcgtcgccgcctcgcgcggcctggccaacggggagtggcgcgatcggatcgcggggttgcgcaccgcgccgccgttcgccgtccatcggttctggctcgaccgcccggtctcgccgcggcgcccggcgtttctgggcaccgccgggcacaagccgctggacaacatcagcgtgctggaccggtatgaacgcgaagcgcgcgcctgggccggagcgcatcatggttcggtcgtcgaattgcattcctacgccttggattcggcgccgtcgggggcggcggcgctacgcgaactgaggcggatctatcccgagaccgccgccgcgcagatcgtgcacgagacgctgttgcaccgcagcgactgtccgctgttcgccccgggcggctacccgcaccggcccacggtggtgacgcccaccccgggcctgctgctggccggcgacgccgtacggatcgacctgccggtggccctcatggagcgcgccgcaaccacgggctggtgcgcggccaaccatctgctcaagcgctggggattggccgggcacccgctggtcaccgtccccaccgaaggccggtcacgcctgctgcgctggctggccaaccgcgaaggggccacccgatcatgaacatccgcgcactgctgcgacaattgcgaccgtccgtccgcgccaaagactggccgctgcaggtcattccgcgcacaccctgggccgatcagcgtccgacctttcgcgaggcgcaacctgccgtcatcgacgccgcgctgcagcgctgccgccggcaacccaccgggaactggtacgcgttcgccgccagcacgcacgtcgagcgcgggcggccgttgggggcgcgcgtcgccggcgtcgatctcgtcgcctggcgcgacgcccgcggtgcgctgtgcgtcgggccgcgcagttgcccccacctgggggccgacctggccaccgggaccgtgtgtgggggcacgctgatctgtcggtggcacgggctgcccctggacggccgcgcacgcgaattcggttgggcgccactgcccagtcacgacgacggcaccctggcctgggtgcgcctcgatgcggtgggaggcgagacgccgtcaccgcgaccggtgataccgccgaggccggccggccacacgctggcatcggtcgctcacctggtgggcgtgtgcgaacctgccgacatcatcgccaaccggctcgacccctggcacggcgcatggtttcacccctactcgttcacccggctggaggtgctggccacgcccaccgaagacgccaaccgcttcctggtggcggtgaccttccggatgggacggctgggtgtgccggtggtcgcggagttcgattgcccggaggcgcgcaccatcgtgatgcgcatcgtggacggcgaagggaccgggagtgtcgtcgaaacccacgcgaccccaataggttccggcccggacggccgtccccgcaccgcggtgttggaagcggtcatcgcgcattcggaccggcccgggttcgcgcgcgccttgtgggcggcgccgctgctcaccccggtgatgcgctatgcggccggccggctgtggcgggacgatctggcctacgccgaacgccgctacgaggtccgcagccagaaccgttaggacgcgtcgagggaggtattcgccgtcgccgccgggtcatggtgcgtagttgctcagcgggaattccgtgccgcatgccgaagacgacgacggctactaccactgtttccaagagatcgagcagctggtgcgcggccggcttgccgacgggcagcggcaccgtcacgagacggcgttgaaagagcggcggcgaaccggcggccacccggcgcacacctccgccccgcacgattaacgcgagaaaggcgaaaccgccgtagggtaatgtccaccgcctgggcccacaacgctgcgggtttgcccggggtccgaaaacgcccgtgtggttcgcgggtcgccggtggcggtcgccgatacgctggtcagcgtgtcgggccggaaggatgcgggtaagtgaccaagcgcggcgccgctgatcggcgactggatcggaccgaactcgagaagttgatgtcggccgacatgcgtgcgatcaccgcgcagtccgaccgcatcggccggcacttcgctcgccagaacaacgtcagcggcaccgacttccacgcgttgctgcatatcatggtcgccgaaaccgcgggaacgccgttgacgccggcccagctgcgtcagcggatggacgtgtcgccggcggccatcacctacctggtggatcgcatgatcgatgccgggcacatccgccgcgaacccgacccgcaggaccgccgcaagacgctgctgcgctacgagaaaccgggcatggcgctggcgcattcgttcttcaccccgctgggcgccgagctgcgcgacgccctggcccatctgtccgaccgcgacttggcggcagcacatcgggtcttcgccgcgatgatcgaggcgatgtccgccttcgaatcccggctggccgcatcgacttccaaaccgcccgccgctcccggccgcaagcgtgcgacgaccgcgggacgtcgcggcgcgccacgctgagcacggtcgctactgcaccgtcgaccgccacgtcgccggccctaggtgtactgacctgagaggttaggtacgcggctggcgggtggttggccgccaagtgcggtgtggccgcggtggtgattgtaggtgtgcagccaggtggtgaactcttcgcagcgctcagtgtcactgcggtagaggcgggcgtaggcccattcgtctgccaaggtgcggtgaaatctctcgaccttgccgttggtctgtggtcggtagggtcgggtgcggcggtgttcgatatcgcccagggcctgggcaaaaacgcgcgatcggtagcaggacccgttgtcggtcaacactttccgcacgctgatcccacattcggcgaaccaggcattagcgcgtgtccagaactcggcggcggtttctttgatctcatcgtcgagtacctcgctgtaggccagccgggaatatccatcgatggcggtgtggagatagtgatatccccgtattgggttgcggtgcttgctgaacaccccgctgctcttgtccgcgttggagttgtggccgccaatcgcgcgtcccagcatccgccagccgccgccggcagggattttgccgagcttcttgacatcgacgtgcactagatccccgcacccagccggttccatccgccggataatccggccagtagatcggtccagccagcgcagtttggccagcgcgtagcgggtcaatacccgatggaccgtcgagggatgtatccccagcagatacccgatgcgcgctggtccccaccggcggatcacccggactttgatgatgcgccgctcggtgcgcgtgggcgtgcggttggggctgtgatgcggtcgtgagctgcggtcggccattccggcctcgcccagctcgcggtagcgcctggcccagcgctctgcggtggttaccgagacctggaagcgttcggctgctcgccgcagcgaccaaccctcatcaacgacgcaacgggccagccgcagccgaccggtttcagacaatggagcattacggtgggacatgaggacctccgaggtgagtgcgtttcctaagcagctcgcacttcactcggaggttctcgtcatgtcacctcaccacgccgtcaccaacgtccgtggtcagtacacctaggcgaggcggatcggctcgacggcacgcaagcccgccaggtcggcgacaccgcagccgtgcagacacacccgcaacccgtcgatgaacggctccagccaatcgaccacggccgcagaggattcgatcgccgccggcaacagtggccgcgctaccgccaccacgtcggcacccaacgcgatcgccttggccgcgtccatgcccgtccgaataccaccggaggccaccaaggggatacccggcaacagccgccgcacctcgacgatcgcgcgcgcggtgggcacaccccagtccgccaggtccggatagcgtagctcgccgtaccgaacgaactgttcgacgcgcgaccaggaagtgcctccggcacccgccacatcaataccggccaccggcggttgcccttctcccccaacaagttccgcggcggccgcaccgccgatgccgtggccgacctctttgagcagcaccggataatcgagcgcggcggcggcttcgcgcagcctgctcagcgagccggagaagtcggtgtccccgttgtgctgcatcgcctcctgcaacggattggtgtgcacggccaaggcgtccgcacccacccgatcgagcgccttcaccagatgtggaaccgccgtcttcgccagctgcgacaaaccgatgttgccgaacagcaagacatccggggccacatcgcgaaccgcgaagctgtccgcggcgcgttcgcccagcgcggtgtcgagcatgatccgttgcgaccccagcatcatgccgattcccagctgctgagcggctgcggccagattccggttgatcgtcttcgacatctcggcgcccccggtcatggcgccgatgaggatcggcgcccgcaggttcgccccgaagaacgaggtggacacgttgatgtcgcccagactggtctgtgtcagtgcgtggtagggcaatcggtagcggtccaacccggttgtgacgccgtcgaattccaccgggtcgctcagacacacgtcgatgtgccgtcgtttccggtgtgtcatcgcgtccatcggggcccccgccgggtgtccataatgtccatagtgccccttttcgggtgccgccgacgcatcggcgtacgacgcgtcatttcagttgattaatgtttaacaaactgaaaggcttgattttgtggtgtgggaacgcgtggccgccgccgtgaccggtccgcgttcctggctgctggccgcggtcgcggtgctggccggcgtcggcgtgatggctctggtcgggccgaacgcggcggcgggccaggcgccgcagtcactgccgcagcactcgccgtccgcccggatcaccgcgctggccgggcagttccccggcggcgatcggaccccgctgatcgtggtggtcagccgcgccgacggcgccgtgctcggccccgccgatctcggcgcggcccgggcggcccgtgaccgcgcccaggccgccgcgcaacccggcgccgcaccggcgcagccgctgacgccctcgcaagacggcaaggccgccctgggcatcgtgccgctgagcaccaccttgtcgggtctggccctcaacgatgcggtcagcgcgctgcgcacggccgccgcgacggggctggcggcggatttgcaggtgcacgtcaccggcggcccggcgttcggcgccgacatcgccggcgcgttcacgcacgccaacgtcaccctgctcgcggtgaccgcctcggtggtggcgctgctgctgatcgccacctaccgctcccccgtgctgtggctggtcccgctgctggtggtcgccttcgccgaccgggtggccgcggcggtgggcaccgcggtggcgtcgctgaccgggttgagcttcgacggcgccacctccgggatcaccagcgtgctggttttcggcgccggcaccaattacgcgctgttgctgatctcgcgctaccgccaggaactgcgccgccatgccggccatcgtgacgccctgcgccgggccgtgcaccgggcgggaccggccatcgtcgccagcaacgcgaccgtggtgctggcgctgctcaccctgctgctcgcggccacccccagcacccgcagtctgggcgcgctggcggcgtgcggtctggtgatcgccgcggtttcggtgctggtggtcctgcctccgctgttggcggtgtgcggccggcggttgttctggccgttcattccggtggaccggccggcgaccgagtccggggcgtggcgccgggtcgcggaatgggtggccgggcgtcccgcgctggccgcggtggccgcggtcgcggtgctggcggccctgggtggtggattgtgggggacccggatcgggttgtcacagaccgaacagttccgcgtccgggcggattcggtggccggttatcacgtgctggcccagcactttccggccgggttggccaacccgacgctggtcgtcgccgacaccggccacgctgcggccgtgcaccaggcgatcgcggccacccccggtgtggtctcggcgaccgagtccggccgttcgccctccgggttgacgcagtggtcggtggtgatcgacgcgccaccgtcgtcggttcgcgcgttcgatatcgttgccgcgctgcgggattcgacgcgagccgccgactccggtgcgctggtgggcggggccgacgcggcggccctcgatgttcgcgatgccgccacccacgaccgggtgctgttgatccccgcgatcctggccgtcatcctgatcgtcctcgccgtgctcctgcggtcggtgatggcgccgccggtcctgctggtcgcgacgatgctgggcgcgctgggcgcactcggcctgggcggctgggtcagcctgcacctgttcggttttccggcgctggactacaccacgccgctgttcgcattcctgttcctggccgccctcggcgtggactacaccatcttcctggtcacccgcgcccgcgaggaaaccgcgcggcacgggacccggcagggcatggtcgaggcggtggcggccaccggtggtgtgatcaccagcgccggaatcgttttggccgcggtgttctgcgtgctcgcggtgttgccgctgatggtcctgacgcagttgggcatcatcgtcggcctcggcattctgctggacaccttcgtggtgcgcactttggtcatcccggcgttgttcaccctcgtcggcgaccgaatctggtggcccaacaaccccgctcgacacgaacggagcacgccgtgaacaggtcgatactcggcgcaaccagcctggccgtcgccgcggccgccggcgcaaccagcctggccggcgccaaggccgtcccccggtggtatgcgcggctgcgccagcccgcctatcaaccgcccggcgccgcgtttcccctcgtgtggaccacgctgtacgccgacatcgcggccacgtcggcggcggcgctgcggcggttcggcgccgccggccgccgcgacaaggcccgcgcctacgccaccgccctggcgttgtcgccctatccgttgtggtgcggcttcgccaccgtgttgtccacccacatctggcgcctcaaccgttagcccgcaccgccgatgcccgcgctgttgtggttccgccgcgaccttcgcctgcacgatcatccggcgctgtcggccgcggcggacagtgacgaggtgctcgcctgcttcgtgctcgatccgcggctgcagaggtcgtccgggccgcgccggctgcagttcctgggcgactcgctgcgggtgctgcgcgacgagctcgacggtcggctgctggtcacccgcgggcggcccgacatccgaattcccgaaatcgccaaggcaatcggcgcctcgtcggtgcacgtctcggaggacttcacgccgttcgggaagcgccgggacgcgcgggtgcgcgcggcgctggcgtcggtcccgctggtggcgaccggatcgccgtacctcgtcgcgccgggccgcgtcaccaagccggacggctcgccctaccaggtgttcaccccgtttctgcggcggtggcgcgacaccggctggcgaccaccggtcaaaaccggcgccgcatccgcgcgctggctcgacccggcgcggctcggcatcaccgactgcgaaatccccgaccccggcgccacgctcgacctggcggccggcgaggaggcggcgcgaaacaagtggaagtccttcgtggacaacgggttagcgaactacgccgacgatcgccaccggcccgacatcgagggcaccagccggatgtcggcgcacctgaagttcggcaccatccatccgcgcacgctggtcgccgatctcgacctacgcgccgccgcagcgcgagcgtacctgcgggagttggcctttcgcgacttctatgccgacgtgctgcatcaccggccggccagcgcgtggcgcaactggaacagcgccttcgacgccatccgcaccgacaccggcgccgaggccggccgccgcttcgcggcctggaaggccggcgaaaccggttttccgttcgtcgacgccggaatgcgccagctgcgccagaccggattcatgcacaaccgggtgcgcatgaccgttgcctctttcctggtgaaggaccttcacctgccctggcagtggggcgcgcactggtttctgcagcagttggtggacggcgacctggcgaacaaccagcatggctggcaatggtgtgcgggctgcgggaccgacgccgcaccctacttccgggtgttcaaccccgccgcccagggcgaaaaattcgatccctccggcgactacatccgccgctgggtgcccgaattgcggtgcgccgacgacccacacctgcgcaccggcgagcgaccgcccggttacccggcgccgatcgtcgaccacgcgaccgaacgcgccgaagcgctgcgccgctatcggagcatgtgaaccgccgtccgggcacccgacgtcgacgcgggcgacgtcaacttccatttcaaggtggacgagcagccgcaaccaaaaagctagcgggaggccttctttcgttcgatgtcggccagcgcggcggccagctcggcccgctgcgcggccgaactctcccaggacagctgacgattcttgaccaccttggccggtgcgccgaccgcgatcgagtagtccgggatgacaccgcggaccaccgcgtgcgagccgagcacgcagccgcgcccgatggaggtgccgcgcagcaccgtcaccttcacccccacccaggtgtccggcccgatgcggaccggggacttgacgatcccctggtccttaatcgggacgttgatgtcgtccatgcggtggtcgaaatcgcagacgtagcaccagtcggccatcagcaccgaatcgccgagctcgatgtccaggtaggcgttgatcacgttgtcgcggcccagcaccaccttgtcaccgaaccgcagcgagccctcgtgcgcgcggatggtgttcttgtcgccgatgtgcacccagcggccgatctcgagctgcgcgagctcgggcgtggcatggatctccacgcccttgcccagaaacaccatgccgcgggtaatgatgtgcgggttggccagcttgaacttcagcagccgccaataccgcaccaggtaccagggggtgtaggcgcggttgcgcagcacccatttcagcgaggccagggtgaggaacttggcctggcgcgggtcgcgcagattcgatccacgccaacggcgatggagtggagcgccccacatggtcgtcatggccggacagcctatcgaagcagccacgggttaccctcacctgtactcgatcgctgctcatcgaggcgagtcaagccgacggccgcggaaggatttgggaaatcgaggtgcttgcccgacaactcctcagccgtcttcggcgatggtcatcgatgctgctggcggcggtcgtcacggcgggggccggcgcgtgcggcaacaccgactcgtgggtggaagcgtcggccgcgcaaggctggccggcccagtacgcggacgccgccaacagcggctacaccagcaccggcggggccagcaagctcgcgttgcagtggacccgctcggtcaagggcagcctggccgccgggccggcgctgagcgcccgcggttacctgggcctcaacgcccagaccccggccggctgttcgctgatggagtgggagaacaccgacaacggccggcagcggtggtgcgtgcggctggtccagggcggcggcttcgccggtccgctgctcgacggcttcgacaacctctacgtcggccagcccggggcgttcctgtcgtttccggtgacccagtggacccgctggcgccagccggtgatcggcatgcccaccaccccgcggttcctcgggcacggccagttgctggtggtcacgcatctgggacaggtgctggtcttcgactcccatcgcggccaggtggccggcagcccgctggatctggtggacggcgtcgatcccaccgacgcgacgcgcgggctggccgattgcgcgccggcccgcccggattgcccggtgccggccgcccccgccttctcggcggccaccgggatggtggtgctcggcgtctggcagccgggcgcgcccagcgcgggcctggtggggctgaagtatcaccccgggcagtccccgctgctgacccgggagtggaccagcgacgcggtgggcgccggtgtcatcgccagcccggtgctgtccgcggacgggtcgacggtctacgtcaacgggcgcgaccagcggctgtgggcgctgcgcgcggcggacgcgaaggtgaagtggtcggcgccgctgggatttttggcgcagacgccgccggcggtcaccccgcaggggctgatcgtggcgggcggcggcccggacacccggctggcggcgttccgggacgccggcgaccacgccgaccaggtgtggcgccgcgacgacctgatcccgctgtcgtcgtccagcctggcgggtgtcggctacacggtggtcagcgggcccccggccaatggcgcgccggggatgtcggtgctggtcttcgatcccggtgacggccacacgctgaacagctatccgctgccggcggcgaccggctatccgctgggcgtttcggtcggcaccgatcgccgggtggtggccgcgatcagcgacggtcaggtttacggtttcgcaccggcctgagccggccatactgttggcgtgccgatcgacgacccaacgaccagcccccggaccggcgacgtcgccaccaccaacaccgccgacctggtggccacgctggtgttgctggtcgtgcacggcggcctgttcgcggcgacctacgtgctgctgggactgctggtgatgagcaccgacccgtgcggctaccaaaagtgcggcgatcccgcctggatcgaccgggccatgaacctgaacatctgggccggcgccgccctgctggtcatcgacatcgcggtcgcggtggtcttgctggtgcgccgcaagcgggcgtttttcgtcccgatcatcggctgcctggcgcaggtggcgttggcggtcgccgccgcggcgatggagctgcgggccggaccggtctgagccggttagatcgccagcggtgggatcgcgttgcgcggcacctgggcctgcaccggcccgccgaacgccggcagcatctcgccgggggcgaagtagaagatcagctggtcgtcggtgatggcgaagttctggtagtgcgacgggtcatgcccggtggagggcaaaatcgcggcgcccaacggggtttggcgttccaggtcgcgctgcacgatcgggaagatcgcgtccagcggggcggcgttgggcgcaaacagattgtcgaaggtcagcggctgcttggtgcccaggttgtagttgaacgccttgtaccagatcgacgaccgggttcccccgacgtcctggaagaacttgagcacgacgctgcgggtgttgtgcggcggctgcccgccgctgtgctgctcggtggtggcctccaactggtagggctgatcccgcccgccggaactctgcgcgacgttgacgaagccgtcccggttctgggtgatgtagtcggtcagggcctgctcgtcggggtagtcggcgggaaacaccatgttgatggtgtagttgggcccggcggcgcgcagccggcacatctgcccgtcctcgaggctgccgccgagggcggcgcacgacgggggctcggcggcggccggccagcccaacaagaccgccggcgcgagcaacgcagcggctagcagataacgcatcgtggatttgtcctcgcagacgtgccagggcgggggcggcggaaatgggaccgccgccagcgtacccgggcgctaccgggagggttggcagacgaacgccgtcacctgcccggagttccgtgcgccgatccgggtgatcaccaccgacagcgggcgactcccgcgcagccgcatccgtttgcgcagcgcgtcggggtccacccgcaccccgcgcaccaacacctccagcgccccgcagtccgaggccgtcaacgcctgccgaagccgtcgttcgtcgaaggccagctgctcgagcacccccaacccgcgcaccgtcgcgggcagccgatcgccggagaggtaggcgatgtcggggtcgagctgccacagcccgtgccgggcgccgtagtggcgcaccagcccggcccgcaccacggcgccgtccgggtcgacgatccagcgcccgaccgggcgcaccgggcagtcgtcaggatcggcgtcggtgatctgttcgccgcgatcgagcaccgtcgcccgccgccgcaccccggccgccgccagtcccgccgaccacaggcaggcctcccggaccgaaccgcgatacgacgtcacctcgatctccccggcgaagccgagccgtcgcacctgttcgaaatcgattccgggagcacactttacgacgaaatcccggccgcggtagctgtccagcagcgggctgagggcgggctggtagtcatcgatgcgcaaccgccgccgaccgtcaacgcgtcgcgcggggtcgaccatgagcacggcgtcgcgggtgaccgggtgcagcgcgtcggcgcggcacagccaggccgccgagccgatgttgtggcgcgccatcgccagccgcaccggatcgatgtcgctgcccaccgccgtcaccccacgggcgcgcagcgcggccagttcggtgccgatcgaacaggtcacgtcgtgcacaacgaggcccggcccggccagccgcccggcccggtgcacggccaccggcgccgcggtggcctgctgcaacgcctcgtcggtgaacagccagtccgacacgcccagttcgcccagtttctccgaggcgcggcggcgcaacagcacggtctccaccagcagcggggtccgctcgccgaatcgggcgcgggtggcggcgatgtcagcgatccgggtcgcgtcgctcagctcgagttcggcgacggccgccagggcgtccacacccgcgtcggaccgcaggtaggcgacgtcggggaggctgaacactcaggtgggtttgaccccggtcaccatcacgttgtagaaccagcccttcgggaccacccggcgccagatgttggcgtccacccagctcagcgtcttccagccgttgaacgcgaatttcgcccagccccagcccagccgcccgggcggcaccgaggcctcgaaggtgcgcaccggccagccgaacatcgcggcggtgaactcctcgctgacggtgcgcacctcggtggcgccggcgttggccgccatccgctccaggtcgccgggggtgaaggtgtgcaggtcgacgatggcctccagcgcggcggcccgggaggattcgtcgagctcggcctgcgggcgccgccagctgcccagcccgggcagcttggtgacgttggtggcgatccgccaggtcagcgtggacagctcgcgggcgtagacgtcgccggcgctggtcggctcgccggcgaagacgaaccggccgcccgggcgcagcacccggatcacctcccgcagcgacagctcgacgtcggggatgtggtgcagcacggcgtggccgacgaccaggtcgaaggtgtcgtcctcgtaggggatgccctcggcgtcggcgacccggccgtcgatgtccaggcccagcgactgcccgttgcgggtggcgaccttgaccatgcccggcgacaggtcggtcaccgacccgcgccgcgccaccccggactggatcaggttgagcaggaaaaaccccgtgccacaacccaattcgagtgcccggtcgtagggcagctcgcgcagcacgtgttcggggacgatggcgtcgaagcggccgcgcgcgtagtcgatgcagcgctggtcataggagatcgaccacttctcgtcgtaggtctcggcttcccagtcgtggtagagcacctgggccagcttgctgtcgtgccgggcggcttccacctgttcggcggtggcgtgcggcgtcggaacggcgtcggtcgatctggtcatgaagggcaagcctaaccgccgtgcggatccgcccccgcgtcgccgccctgaccagcggagaacacctccacgtagcgccgctgttcggcggcaagccgctcggcgcggggcagctcgaacacggcgtcgacaccggccttggcggcggccagcgcgtgtcgcgggccgtccaggaaccggcgcgcccacgccgcggcggcgtcgtacacgtcgtcgggggccaccatttcgtcgatcagccccagcgccagggcctcctcggcgtcgaagaaccggccgctgaacaccagctccttggccttgctcgcgccggccacccgggtcaggcgggccagcgcgtcgccgccgggcaccaggccggccaggatctcggtcgcgccgaatttgacgttgtcgccgctgatccgccagtcggcggccagcgccagggtgagcccggcgcccaacgcgtagccggtgatcgcggccacggtcggcttggggatggccgccacggcgtcgatggcgtcgcggcggacccgggccgcggtctcggcctcggcgccgcgcagcgtgcgcagctcgggcatgtcgtcgccggcggagaagatctcgtggccgccgaacaggatcaccgcggccacgtcgtcgcgccgcccgagctcgtcggccgccgcgatcacctcgcggtacacctggcggctcaacgcgttggtgggcgggcgcgacaccagcaacatcgccagcccggcgtcccgggagccgtcgctgaccacgacgctgacgaactcgttcaatgccgccaccccagcccgccggcctcccgcgcccggtggtagcggtcggagtcgaagaactcgaacacccagttgtcgccccggatctccacatgcggctgcaccggagcgatctggcgctgcaccgccagcacgtccgcgacggtccgcccggccaacgagtccagctgtgtccacgtcggcggcagcaggaaggtgcggccggccgagaagtcctcgagcgcggcctcgggcgtcgtccagcccgcccggtcggattcggtgttctgcccgtcggcgcgctgaccctgcggcagggccccgacgaagaagtaggtgtcgtagcggcgggtgcgctcggcctccggggtgacccagttggcccacggccgcaacagatccgaacgcagctccagcttttcggtgcgcaggaagtccgcgaacgacagcgtcccgtcggccagcgcgcggcgggcgtcgcggtacaccgaggcgtcgccgacgatgctgtccggcgcaccggccggcccggcgaacagtacccccgactcctcgaacgtctcgcgggccgccgcgcacaccagcgcctcggccaggtcgggttcgatgccgaagcgctgcgcccaccactgcggcggcggtccggcccacgcccccaacccgcccaggtcggcgttgcggtcgcgctcgtcgacgccgccgccgggaaacaccatcaccccggccgcgaactccatccgggagtgccggcgcatcaggaacaccttcaggccggctggggcgtcgcggaccagcatcacggtggctgcgggccgcgggacgagcggggcttcctcgggtgaggtcatagctgcctccggtgggctgcgcgggtgcggacgcgccgcgcgaagtagcgcccgtcgacgacgtcgagcgcgatcgcctggccgaacgcggtggacagattctccgaggtgagcacgtcggtcagcagtccggcggcgaccacccgaccctccgagagcagcatgcagtgactgaaacccggcggtatctcctcgacgtgatgggtgaccagcaccagcgcgggtgcgtcggggtcggcggccaggtcggccagccgcgccaccagctcctcacggccgcccaggtccaggcccgcggcgggctcgtcgagcagcagcagctcggggtcggtcatcagcgcgcgggcgatcagcacccgcttgcgctcgccttcggacagcgtcccgtagcttcggtcggccaggtgctcggcgcccaggctctccagcatgtcgacggcccggcggtagtcgatgtcctcgtagcgctcccgccaccggcccagcaccgcgtagccggccgacacgaccagatcgcgcaccacctcgtcgctgggcacccgctgcgccagcgccgaggacgacagcccgatccgcgaccgcaactccgtcacgtcgacccggcccagccgctcgccgagcacgaaagccacgcccgacgaagggtgttcggccgccgcggcgatccgcagcagcgaggtcttgccggccccgttgggcccgacgatcacccaccgctcgtccagttcgaccgcccagtccagcggcccgaccaagacgttgccgccgcgccgcagcgacacgtcgcgcaactcgatcagcagatcagggtcggctgccgcactgtcgttttcgggcacccgaccatcgtgccgtaccgcgacgcccgcacacctgccgggtcgccgcgattactcgccgcgcttactccggcgggatctccacccggcgcacctcgccgtcgatcgcgtcggcggcctcgatctcgccgcgggtcacccccagcaggaacagcaccgtgtccagatacgggtggctcagcgacgcgtcggcgacctcgcgcagcgccggcttggcgttgaacgcgatgcccagcccggccgcggccagcatgtcgatgtcgttggcgccgtcgcccacggcgacggtctgcgccatgggcaccccggcccgctgcgcgaattcccttagcgccgtggcctttccggcccgatcgatgatgggaccgaccacccggccggtgagtgtgccgtccacgatctccagctcattggccgccacgtagtccagcatcagctcctcggccagcggctcgatgatccggcggaagcccccggacaccacgccgcaggcataccccagccggcgcagcgtgcgcagcgtggtccgggcgccgggcatcagctccagctggccggccacctcgtcgatcaccgtggcgggcaggccggcgagcgtggccacccgctgctgcagcgactgcgcgaagtccagctcgccacgcatcgcggcgtcggtgatcgcggcgacctggccctcggcgcccgccttggccgccagcatctcgatgacctcgccctgcaccagcgtcgagtccacgtcgaacacgatgagccgcttggcccgccgttccagggtgtagtcctcgacggcgacgtcgacgtgctcctcgctggacacccggttcagcgcggtgcgcagcgccccgtcggcccccggcggcaccgagacccgcagctccagcccgatcaccggatagtcggacacgccacggatcaggtcgatgttgacgcccagcgcggccacctcgcgggccaccgcaccgaacgcggccgcggtgatgggccggcccagcacgaagatggtgtgcgtcgagggctcccggatgatcggcacgtcgtcgctgcgttcgatgctgacgtccaggccgaccttgcggatggccgcctccacgtcgtggcgcagcgcgggcccgtcggcgacgtcggcggggcagcacaccagcacccccagcgtcagccggtgccggatcaccacctgttcgacgttgagcagctcgaccccgtgccgcgacagcacctcgaacagggtcgccgtcacgcccggctggtccacgccggtgacggtgatcagcaccgacaccttgggtggtgagttcacgcccggcagccgcccgtcaggccatcagctgcgaacctggacgtcgtccagccgggtgacgtccttgtccgccgggccgtgcgcgcgacccacgtgcgcctcggcgcgcagccgttccaccatgtgcgggtagtgcaactcgaatgctggccgctccgaacggattcggggcagctcggtgaagttgtgccgcggcggcgggcagctggtcgcccactccagcgagttgccgtagccccacgggtcgtcgacggtgacgacctcgccgtagcgccagctcttgaagacgttccagacgaacgggaacatcgacgcgcccaggatgaacgccccgaccgtggaagcgacgttgtagggctggaagccgtcgctgggcaggtagtcggcgtagcggcgcggcatgcccaaatcgcccagccagtgctgcaccaggaaggtggtgtggaacccgatgaacgtcaaccagaagtgcagcttgcccagccgctcgtcgagcaggcggccggtcatcttcgggaaccagaagtaaacccccgcgaaggtggcgaacacgatggtgccgaacaacacgtagtggaagtgcgcgaccacgaaataggtgtcggtgacgtggaagtccagcggcgggctggccagcatcacgccggtcagaccacccagcaggaaggtgagcaggaagccgacgcagaacagcatcggcgtctcaaatgtcaactgccctttccacatcgtgccgatccagttgaagaacttgatcccggtcggcaccgcgatcaggtacgtcatgaacgaaaagaacggcagcagaacggctccggtggcgaacatgtggtgcgcccacaccgcgaccgacagcgccgcgatcgacagcgtcgcgtacaccagcgtggtgtagccgaacaccggcttgcgcgcgaacaccgggatgatctcggtgatgatcccgaagaacggcaacgcgatgatgtacacctcgggatggccgaagaaccagaacaggtgctgccacaacagaactccgccgttggcggcgtcgtagacatgggcgcccagatggcggtcggcggccagcccgaacagcgccgcggtcaggatcgggaaggcgatcaggatcaggatcgaggtcaccaggatgttccaggtgaagatcggcatccggaacatcgtcatgccgggcgcgcgcatgcagaccacggtggtgatcatgttgaccgcacctaggatggtgcccagaccggcgacgatcaggccggtgatccacaggtctcccccggcgccgggcgagtgcacggcgtcagacagcggggtataggcggtccagccgaagtcggcggcgccgcccggcacgatgaagccggacgccgcgatcagcccgccgaacaggaacagccagaacgagaaggcgttgagccgcgggaaggccacgtcgggcgcgccgatctgcagcggcagcaccaggttggcgaaaccgaacaccaccggggtggcgtacagcagcagcatgatcgtgccgtgcatggtgaacagctggttgaactgctcgttcgacaggaactgcagccccggcgcggccagctcggtgcgcatcagcaacgccatcagcccgccgatgaagaagaacgcgaagcaggtgacggtgtacatgatgccgatcatcttgtgatcggtcgtcgtgatcagtttgtagacgaggttccctttgggaccggtgcggtccgggtacggacgaacggcctcgagttctcccaaggggggcgcttcggctgtcaacagcttctccaaacatccggatcggacactggcccaacatcactattccaacgaatcttagccgtcgatcatgacgacgtcagggctggtcctacaaactgtcgtaaacggctgaccggcgcggcgggtccgtcggcgcggcgggagcacgctggccggatgttagcgtctgagccgtgttgttcggcgtgatcaggccggcccggctggccgcggtgacggcggcgctgatggtggcgtgcggcggctgcggatccgacaggcccgccgcgacgacgacgcgttcgctggtcactcccaccacccagatcgccggggccggagtgctgggcaacgaccgccggcccgacgagtcgtgcgcccgcgacgccgccgaggccgatccgggtccggcgaagcggcaggtccacaacgcgcccggcgccgacccggcgccggtgcaggtgtccgccgatccgcagcgcatcgtggtgctcgccggtgaccagctcgacgcgctgtgcgcgctgggtctgcagtcgcgggtggtcggcgccgccctgccggacggcgcctcgggccagcccgcctacctcggcggcgccgtgcgcggcgtgcccggcgtgggcagccgatcgcaccccgacgtgaaggccatcgcggcggcccaccccgatctcatcctgggctcgcaggggctgacgcccgcgctgtacccgcagctggccgcgatcgcccccacggtgttcaccgcggcgccgggcgcggcgtggcgggacaacctgcgcgcagtcggcgctgccaccgcccgcgccggcgcggtcgacgggctgctcagcggcttttcgcaacgggccggcgacgtgggcgcacgccatgacgcctcccatttccaggcgtcgatcgtgcagttgacgaccggcagcatccgggtgttcggcgccaacaacttcccggccagcgtgctgggcgcggtcggggtggaccggccggccgcccagcggttcaccgacaagccctatctcgagatcggcgccaccgacgcggacctggccaagaatccggacctctcggtcgccgacgccgacgtcgtctacctgtcctgcgccacgccggccgcggccgaccgggccgccaccgtcctggacagcggcccgtggcgcaagctgtccgccaatcgcgacaaccgcgtctacgtcgtcaacgacgagatctggcagaccggccagggcctgatcgcggcccgcggcatcgtcgacgacctgcggctggtgaacgccccgatcaactgagccgccggcgggtatcccccacgcgacaacgtgatcttcgccgcgccggttggcgccagaaccattaccttagctaaactttttgggaaagcacggctggaagagggacattcatgagcaccgtttcggcgtacgccgccacgtcggcgaccgaaccattgaccaagaccactatcgagcggcgcgaccccggcccgcgcgacgtggccatcgacatcaagttcgccggcatctgccactccgacatccacaccgcgaaaggtgaatggggccacacgaattacccggtggtggtgggccacgagatcgccggcgtcgtcaccgaggtgggcgcggaggtcaccaagtacaaggtgggcgaccacgtcggcgtgggctgcatggtgaactcctgccggcagtgcagcagctgtacggccgggctggagcagtactgcaagcgcggcgcgaccttcacctacaactcgatcgacagggacggctcggtcacccagggcggctacagccaggcgatcgtggtcgacgaggacttcgtcgtgcgcatccccgactcgctgccgctggacaaggcggccccgctgctgtgcgcgggcatcacgctgttctcgccgctgcggcactggaacgccgggcccggcacccggttggcgatcgtcggcctgggcggcctggggcacatgggcgtcaagctgggtgcggcgatgggcgccgaggtgacggtgctgtcgcagtcgctgaagaagatggaggacgggctgcggctgggcgccaagcactaccacgccaccgccgaccccgacaccttcacgaagctgcgcggcagcttcgacctgatgctcaacaccgtgtcggcgaacctcaagctcaacgactatctgagcctgctcgacgtcgacggcacgctggtcgagctgggcatccccgagcacccgatggaggtgggcgcgttcccgctggcgctggcgcggcgcagcctgtccgggtcgaacatcggcggcatcgccgagacccaggagatgctggacttctgcgccgagcacaacgtgacgccggagatcgagctgatcgagcccgactacatcaacgaggcctacgagcgcgtgctggccagcgacgtgcgctaccgcttcgtcatcgacatctcgaagctatgaggctatgaggctatgagcctatgaggcgacccccggtgtctgacctcgcgccgcgatctcggcggactcggcgaagtcatcaccggggatcacctcgctgacgtcgatgccggccagcggccagcccgcggcagccagcctggcggcgacccggatgatgttctccggcccggcgtcgtaatgcgtcatgccggagatgaattcggcgatctcgtcgcggttgatcacaccgtcggcgatcgccggggatccgtccttggtgatttcgcgcaccacctcggcgatctgctcctcggtcagcggcgtgctgcgcagcagcgccagcagcggcacccggtccggcccggggacaccctcggggtagccggcccgcagccagcgcagcactgagcggcagaagttgacggtctgggaggcggcggtattcgtcaccccaccagtgtcagggcagcggtgtcaccgacgccagcgggccgtgccgccatacccacaattcatgcgccgttcagctgctagaagtcccagtcctcgtcctcggtgacgacggccttgccgatcacgtacgacgaccccgacccggagaagaagtcgtggttctcgtcggcgttgggcgacagcgccgacaggatcgccgggttcacgtcggtctcgtcgcgcgggaacagcgcctcgtagccgaggttcatcagcgccttgttggcgttgtagcgcaggaacttcttgacgtcctcggtcagccccacctcgtcgtagagatcctgcgtgtactccacctcgttgtcgtagagctcgaacagcaattcgtacgtatagtccttgagctcttgacgtttggcgtcgtcgaccagcgccaggccgcgctggtacttgtagccgatgtagtagccgtgcacggcctcgtcgcggatgatcagccggatcatgtcggcggtgttggtcagcttggcccggctcgaccagtacatcggcaggtagaagccggagtagaacaggaagctctccagcagcgtggaggcgaccttgcgcttgagcggctcgtcgcccttgtagtactgcatcacgatctcggccttgcgctgcaggttggggttctcctccgaccagcggaacgcgtcgtcgatctcggcggtcgaacacagcgtggagaagatgttgctgtagctgcgcgcgtgcaccgactccatgaaggcgatgttggtgtagacggcctcctcgtgcggggtcagcgcatcggggatgaggctgaccgcgccgaccgtgccctggatggtgtccagcagcgtcaggccggtgaacacccgcatggtcatctgcttctcgtgggcggtcagggtggcccacgactgcaggtcgttggacaccggcaccttctcgggcagccagaagttgccggtcaggcggtcccacacctcggcgtccttgtcgtcttgcagccggttccagttgatcgccgaaacgcggtcaatcagcttcatgttttcgctcaccagaaccccacttcacgcgccgtagtgccggaggacgtcaggctccaaacactacccctggggtacgacaacgcggtgcaacacaagaagttgtgtttgcgtgtcgccgacgccgttcgatcgtttcccctccagtatgcggcgcgcgcgatgtaccatctggtacatgtttaccgaggacagcgtcgagatcgacgcgccgccgcggttggtctgggacgtcttcaccgacgtcgagcgctggccggagtggacggcgtcggtgacgtcgctgaccggcctggacgggcccgccctggccgtcggccgacgcttcgccatcaagcaacccggcatggccaagctggtctggcaggtcaccgagctcatacccggcgcgtcgtggacctgggtgcagcgctcccccggcgcgcgggtcgccgccacccatcacgtcagcgcgcgacctggaggcggcaccctggtgcgccagcagctggatcagcgcggcgcgctcggcgccctggtgggccggctgatggccaagaagactaagcgctttctggcgctcgaagcccggggcctcaaggcccgggccgagcaactcagccgcgccgatggcgcgcacccctgaccggcagcggcgccgggaactgctcgatgccctgatcgccgagttcgccgccggcggcatcggcgaccgctcgctgcgccgggtggccgaggccgtcggcaccagtcatcgaatgctgctgcaccacttcggatcccgggaaggcctgctgctggcgatcgtcgaggaggtggagcgccggcagatgcgggtgctgaccgaactgccccgcgcgccggccgagggcttcgccgcgatgtgggccgatctgcgccgacccgagctgcgcgaattcgagcgcctcttcttcgagtgctactcgcgcgccgcccagggcgaaaagcctttcgcccgaatgcttcccgacgccgttgacgactggctccggcaagccgaaacccactccggggcgccgttcgacccggcgatggcgcgactcggcctggccgtcatccgcggcctgctgctggatctggtggccaccggcgacgaggccggcgtggacgcggccgcccgggcgttcgtcaacctgttaaacgccggggcgtgagccgatcccgtagaactggtactcctgcggtttgaccgcgcgggtcgcccgccagtactcccaggtgtagccgccccagagcacggtgttcttgccgtgctcgtccagataccaactgctgcagccgccgctgttccacaccgacgggcccagccggcgctgcagctcgtcgttgaacctgtcctgcgcggcccgggtcggcgccagcgcctgggcgcccagcttgtcgcaggtggcgatcgcgtctgcgacgtaacggatttgggattcgatcatgaataccacggagttgtgccccagcccggtgttggggcccagcagaaagaacaggttgggcacgtcggccacggtgatgccgcggtgcgcgccgatgccctcgcggttccagcggtccaccagatcctcgccgtgcagtcccttgatctggacgtaggtgtaggagtcggtgacgtgaaaaccggtggcgtacacgatgacatcgaccgggcggtgcgttccgtcggcggtgacgatgccgtcgggcgtgatccgcgcgatgtgatcggtgaccagttcggtcttggggtcggcgaccgcgccgtaataggtggaggagttcaggattcgcttgcagccgatccggtagtgcggagtcagcttgcgccgcaactccttgtccttgaccgagcggcggatgttgtatttcgcgtaggcctcgatgaccttgagcaggttcggccgcttggtcatgccgaacgccagggcctcctgcccccagtagatggccaggcgcaccagcgcgcgcagccccggcacgttctccatggcggcgcgcacggccggcgggatctccgggttggaccgcggcaccacccacggcggagtgcgttggtagagctgaagttcggcgacctggccgacgatctccggcacgatctggatggcgctggcgccggtgccgatcaccgcgacccgcttgccggtcaggtcgacggtgtggtcccactcggcggaatggaaagcgggaccggcgaattcgtcgcgcccctcgatgtcgggcagcgacgggatgtgcagcgcgccggcgcccgagatcaaaaactgcgcgacgtattcgcgcccgtcggtggtgaacacgtgccagcggtgctcgtcgtcgtcccagtgggcgcgatcgaccagcgagttgaactcgatgtagcggcgcaggccgtacttctcggtgacgcccttgaggtagtcccagatctccggctggtaggagaacgggttcttccagtcgggcttgggctcgaacgagaacgagtagaggtgcgacggaatgtcgcaggcgcagccgggatagctgttgtctcgccaggtgccgccgatgtcgtcggccttttccaggatcacgaagcccacgccctgcttctgcagcgcgatcgccatccccaggccggagaacccggtgccgatgatgacggcgcgggtatgcaccggcttggcggccttggccgccggggtgggcgcggtttcggtgtgtgtcacgacgtcggtcacggtcgttcggtccttctatccaggcctgtctcaggtcggcgctcgctggcatcgtcggccgtagccaccccgctggcgcagatacccggtacccagggtatcggtttggacgagttttatcgatatgccccggcgctgtcaacgccggggcgcggctcagctcaccgcgggctttctcaccacggcgtcgtgaatcggctggtcagggttcatggtgatgcccagtgtctccgcggtgccgatgatcaccgccatcatgatggtgctcaggtgcgcgacgaactgggcccgcgacatcagccgcgggctgtccggttcggggcccagccaccactcggtggccgaggccgccgacccgaaggcggcatgggcggccagctcgacggccgcgtggtccagctccatctcgcgcagctcgttgtcgaacaggtcggccatggccagggtgatctcgcggccctcgttgaggatggtgaccgtcgactggggggtgcccgtcgagcgcccctggatgaacacccgcagcacattgggatgcttgtcgaccagggtgacgtactcctcgacgctgcgccggatcacctcgcgcgccgagtcggtcttcaggtcgatggacgggaagatcgccgtccacagcatgtcgcgcagccgctcgccgatggcctggaacaggtcggacttgtcgtggaaatgccggtagatcttgggcttggcggtgccggcctcttcggcgatctcgcgcacggacagctcgggtccgagccggtcgatggcgcgaaacgcagcgtcgacgatctcgttgcggaccttcttgcggtgctcgcgccagcgttcgctgcgcgcgtcgaccttggcccccggcttggtagccgagtggggcctggcaggtcggggcattctcaccacgtcaagcactgtacccggtggcggcttctgacctgggcagatcggcgcgtccgcacctcgccgaacgtgcgctggttgcgaaattcgagccgaaaagtcgcaacagctacacgttcggcgggagggatcacagcatgcaggacacgcagccctcgacctcggttccctccagcgccatctggcgcaaccggatgtagtagagcgtcttgatgcccttgcgccaggcgtagatctgcgccttgttgacgtcgcgggtggtggcggtgtccttgaagaacagcgtcaggctcagcccctggtcgacgtgctgggtggccgcggcgtaggtgtcgatgatcttctcgtaaccgatctcgtaggcgtcctggtagtactccaggttgtcgttggtcatgtagggcgccgggtagtagacccgcccgatcttgccctccttgcggatctcgaccttcgacacgatcgggtggatcgagctcgtcgagtggttgatgtaggagatcgacccggtcggcggcaccgcctgcaggttctggttgtagatgccgtgcgcctgcaccgactccttcagccgcttccagtcgtcctgggtggggatgcggatgccggcatcggcgaagagttggcgcaccttctcggtcgccggctcccacacctgctcggtgtacttgtcgaagaactcccccgacgcgtacttggagcgctcgaaacccttgaagtgcgtgccgcgttcgatcgcgatgcggttcgacgcgcgcagcgcgtgatagagcaccgtgtagaagtagatgttggtgaagtcgatgccctcttcggagccgtagaagatgccctcgcgggccaggtacccgtgcaggttcatctgcccgagcccgatcgcgtgagaatcgttgttgccctgctcgattgagggcaccgaggtgatgtgcgtctggtcgctaacggcggtcagcgcccggatggccacctcgatggtctgggcgaagtcgggcgagtccatcgtcttggcgatgttcagcgaacccaggttgcacgaaatgtccttgcccactttggcatacgacaggtcgtcgttgaacaacgacggcgtggagacctgcaggatctccgagcacaggttggagtgggtgatcttgccgtcgatgggattggcccggttcaccgtgtcctcgaacatgatgtacgggtagcccgactcgaactgcagctcggccagcgtctggaagaactcccgcgccttgatcttggtcttgcggatgcgggcgtcgtcgaccatctcgtagtacttctcggtcaccgagatgtcggcgaacggcagcccgtagacgcgttccacgtcgtacggcgagaacaggtacatgtcctcgttcttcttggccagctcgaaggtgatgtcggggatcaccacgcccaggctcagcgtcttgatccggatcttctcgtcggcgttctcccgcttggtgtccaggaagcggtagatgtcggggtgatgggcgtgcaggtacaccgcgccggccccctggcgcgccccgagctgattggcgtaggagaacgagtcctccagcagcttcatgatggggatgacgcccgaggactggttctcgatgttcttgatcggcgcgccgtgctcgcgaatgttggtcagcagcaacgcgactccgccgccgcgcttggacagctgcagcgcggagttgatcgaacgcccgatggactccatgttgtcctcgatgcgcagcagaaagcagctcaccggctcgccgcgctgcttcttgccggagttcaaaaacgtcggcgtggccggctggaaacggccctcgatgatctcgtcgaccagcttctcggccagcccggtgtcgccggccgccagcgtgagcgccaccatgaccacgcggtcctcgaagcgctccagatagcgcttcccgtcgaacgtcttcagcgtgtaggaggtgtagtacttgaaggcgccgagaaaggtcgggaagcggaacttcttggcgtaggcgcggtccagcaacgacttgacgaagttgcgcgagtactggtcgagaacctcacgctcgtaatagttttcgcggatcaggtagtcgagtttctcgtcctgattgtgaaagaagacggtgttctggttgacgtgctgcagaaagtactggcgcgcggcgaggacgtccttgtcgaactggatcttgccgtccgcgtcgtacaggttcagcatcgcgttcagcgcatggtagtccgtttcgtcgggcaagccatgagcgccggcggttacaggctctgcagcgacggttggtgacacgtctgttccttccaaaattcagctaagcccgctcggacggcgtccacgtcgtcctgggttcccatcagttcgaagcggtagaggtacggaacgccgcacttgcgcgagaccacgtttcccgcgtaggcgaattcggcgccgaagttgttgttgcccgcggcgatgacgccgcggatcaacgaacggttgtgctcattgttcaaaaaggcgatgacctgtttggggacatagcccccggcgttgaggtcgggagtggcccgcccgccgccgtaggtgggcagcagcaggacgtacgggtggtccacctcgatccgcccgtgcaacggtatccggatggccgggatgcccagcttctgcacgaagcggtgggtgttctccgagaccgaggagaaatagaccaggttgcgtcccgtgctgtccatggcagcgcaacctccttacctgacgtcttgccgctctgttgcctaggcgctcagttccgccccggccagcgccttgatccgatcgggccggaaacccgaccagtggtcgcttccggccaccacgacgggagcctgcaggtatcccagcgccatcacgtagtcacgcgcctcggggtcgagcgtgatgtcgaccttctcgtaggcgatgccgtgcttgtccagcgccttgtaggtggcgctgcactgcacgcatgccggcttggtgtacacggtgatggtcatcgcatgccgctccttcgcggaagagggggaacccaacggactggcaactacttttggactgcttgtttgctaccttcagcgatccggcaggcccccggattcccgtcctgcggcggtcgggtgccgaaggcctgtcttcgacaactcggcgccgatttcgggggttccgccgcgcccgcggggctcggtggtcctgggatctgccggtgctcgaaacactacacctagtggctcactagatgtcgagatacaagatgttctgaatgacaattttgaaattccctggtcgtaaggcctgtgtcggacaaattcggacacccgccccggcgtgtcgcagatcacacgccggggggacgccgtctctgcccatcggtatagcagcgggcaccgacaaggcccggatcacgccgcgaaccgcgccgggcccacccacagccagcaaagccgccagccgaagctggcggcttctgccatgccggtctcacaaccgcgctggtcgcccggtgaccgggttgtcgatttccgccaatcagccgacctcggcggccagcttgccgaccacgtcgcgcacgttcgccgacagttcggcatgctcggcgggcgccttgccggccagcgtcttgaacggcacggacagcttgatcgactcgaccacccgcgccccggcgatcccgaaggacttgcgggtctcgtcgtgcgcccacactcccccgtactggccgaaagaccccccgatgacggccagcggcttgcccttcagcgcgccgtcgccgaacgggcgggacaaccagtcgatcgcgttcttgatgaccgccgggatgctgccgttgtactcgggggtgaccaccagcgcggcgtcggcgtcggccgccgcggcgcgcagcgcggccaccggggccagcggcggcgcgtcgctggtcatcgcgtcgtcgatctcctcgttgtagaacggcagctcgccgagcccctcgaagacggtgacgacgacgtcctcgccggcgacagcgctcgccagctccgcgatctggcggttgatcgacgccgagcgcaggcttcccactaatgccaagattttgattgccacgattcgccagttcccttcggttgttggtgtccatcctcgcacgggccaaccggactatggtccgttttattccggcagcgttaaagtgcaggagtgagcggtgtcgagcagcggggtcaactgcggttctgcgatccgcgggttcccgcgccggaacgcggcgacgccgcccgcaatcgcgcactcctgctggatgcggctcgccgcctcgtcgccgagcgcggggccgacgccgtcacgatggacgacgtcgccgcggccgccggcgtcggcaagggcaccttgttccgccggttcggcagccgggcgggtctgatgatggtgctgctggacgaggacgaacgcgccatccagcaggcgttcctgttcggtccgccgccgctggggcccgatgcgccgccgctggatcggctggtggccttcggccgggagcggttgcgcttcgcccacacccaccacgcactgttgtcggcggccaaccgcgacccgcggacccgctacggcccgccgtccgccgtgctgcgccgccacgtgcgggtgctgctggccgcggcgcacaccaccggcgacctcgacgcccaggccgacgcgctgctggcgctgctcgacgccgactatgtgcaccaccagatcagcgaccacggccacaccctgcagacgttgggcgacgcgtgggaaagcctggcgcgcaagctgtgcggtaactgatgagcccccgctgggtgctgcacgtcgacctcgaccagttcctggcgtcggtcgagttgcggcgccgtcccgaactggccggcctgcccgtcatcgtcggcggcaacggcgacccgaacgaaccgcgcaaggtcgtcacctgcgcctcctacgaggcacgcgaattcggcgtccgcgcgggcatgccgctgcgcgccgccgcccgccgctgccccccagactcgggggtgacgttcctgccgtccgacccggccgcctacgacgccgcgtccgaccaggtgatggggctgctgcgcgacctcgggcatccggtggaggtgtggggctgggacgaggcctacctcgcggtgacggcgacggacccgatcgaggtcgccgaacagatccgcggcgtcatctcctcggaaaccgggctgacctgttcggtcggcatcagcgacaacaagcagcgcgccaagatcgccaccggctttgccaaacccgacggcgtcttcgtgctcaccgacgcgaactggatggcgctgatggccgaccgtccggtcgacgcgctgtggggtgtggggcccaagaccgcgaaaaagcttgcggatcttcagattacgacggtgtggcaactggcccacagtgacgcggaactgttgacggccaccttcgggccgcgcaccgggttgtggctgctgctgctcgccaagggtggcggcgacgaccacgtcagcgcgcaaccgtgggtgccgcgctcgcgcagccacgtcgtcacgtttccccgggacctcaccgatcgcgccgaaatggaaacggcggtaacggatttggccgatcaggcggtggcggaggtgctgacggcgggccgggtggtgacccgggtcgcggtgaccgtgcgcacggccaccttctacacccgcaccaaaattcgcaagctcgacgcgcccagcaccgatcgcgacgtcatcgtggccgcggcgctgcgcgtgctggatctattcgagctcgaccggccggtccggttgctcggggtgcgtctcgagctggtcatgccggactagcgtcgccggcgcgggccgcagcgcgcgggtgaagatcacgttcacctgacgcatcaccacgctgtagggccaccacgccagcctcttgaacgcgtacagcgcccggatgtcgggcgaggtgtagatcaggtaccggttccgggcgaccccggccaggatcttgtcggcggccttttccggcgacaccgcatggccggcgaaccgccgcacccagcgggcgacgtcggggtcgtcgcggtccacgccggcgatctccaccgtgttcaccagcggggtgttcaccgcgccgggcaccaccaccgacaccccgatgcggtgccgggccaggtcgaagcgcagcacctccgacagcccccgcagcccgtacttgctggcgctgtaggcggcgtgccagggcagcgcgaccagcccggccgccgaggacacgttggccagatgcccgccccgcccggcggccaccatgggcgggacgaatgtctcgatgacatggatcggacccatcaggttgatggcgatcatcttgcgccactgttcgtgggtgagccggtcaacggtgccccaggccgacacgccggcgatgttgagcaccacgtccatcggcgggtgggcggcatgaatgtcggcggcgaaggaggccacctggtcgtagtcggcgatgtccagcgcgcgatgctcggggaccgacgcgcccagggcgcgggcgtcctcgaccgtgagccgcaggccgtcgccgtcccggtcggtcagatagagctcggcgccgtgggcggcgagccgcagtgccgtggcgcggccgatgccgctggccgcgccggtgaccaaacaccgctttcccgcgtaataccgcccggatgccttctgcgccatggcggtgacgataccggcggtaccacccgcgctagggacggccggcccacagcgcgtgcagccacaactgctcgagcaccgccacccggcggtcgcgatcgctgtccggcccggtcagcaccgggtcgccggtcagcatcagcgcggtggtgccggccagggtgcggatcagcgtcggcaggtcgtcgctgatcggcctggccgtcccggccttcatctcggcctcgacgatgccgacgatctgggccagcaccacctcgaactgctggtccatcaggttgcggatctcgacgtcggtgtggcgggcctcgttgcaggcggtcatcaccgggtcgttgtgcgcgtagacggccgcggcgctgccgaccatccgcttggcgaactgctcgggcgactcgcccggctggcgcggggcgaagtattgggtgagttcctcgagctcctcggtggcctcggccatcagctgcgccagcaccgcgtacttggagtcgaaatagaagtagaagccggatcgggccaccccggcgcgcaggctgatggtgctgaccgacagctcggcgaacggcttttcctgcagcagttcacgcaccacggccaggatcgcctggcgttgtttgtcgcctcgccgtcgcgcgcccggctccggattggcggggtggctggtcactccccgaccttgcaccacgccacgcaaaaagcaaacttgacagccgtcaagtttttcggagaaggttaggaatcagtgaccgctgtcaccccggaagggcacgcgaaggagcgtcaatgaccgccaccatcagcactccgcagtatctgctggaccaggcgcggcgccggttcaccccgacgctgaacaccatcccggggatgggggcgatcgagaagcgcctgctggcccacgagtggcagaccaaggtgctggccgagccgccggccggcagcggactcaagccggtgctgggcgatgccgggctgccgatcctcgggcacatcatcgagctgttccgcggcggcccggactacgcgttgttcctctaccgcaaccacggcccgctgatctacctggattcgccgatcatgccggcggtcaccgcgctgggacccgacgccacccaggcggtgttctccaaccggaacaaggactactcgcagaagggctggcacccggtaatcgggccgttcttcaaccgcggcctgatgatgctcgacttcgacgagcacatgtaccaccggcgcatcatgcaggaggcgttcacccgcagccggctgaccggctacgtcgagcacatcgaccgggtggccaccgccatcgtcgccgactggcccaccaatgacgcgcggttcctgttccacccggcgatgaaggagctgaccctcgacatcgcgtccctggtgttcatgggacacgagccgggcaccgaccacgacctggtcaccacggtcaatcaggcgttcacgacgaccacccgcgccggcggggcaatcatccgccagcccatcccgccgttcaagtggtggcgcggcctgcgggcccgccagctgctcgaggactacttcagcgagcgggtcaaggagcgccgcaacgccaccggcaacgacatgctcacggtgctgtgccacaccgaggacgacgacggcaacagcttcaccgacgacgacatcgtcaaccacatgatcttcttgatgatggccgcccacgacacctcgacctcgaccaccaccacgatggtctacaacatggccgcgcatccggaatggcaggaacgggcgcgcgaggagtcggcccggctcggcgacgggccgctggacatcgaggcgctggagaagctggaaacgctcgaactgatcatgaacgagtcgctgcgcatggtgacgccgttgccgttcaacatgcgccaggcggtgcgcgacaccgagctgctgggccactacatcccggccgggaccaacatcaccatctggcccggcatgaatcaccggctgcccgaattgtggacggacccagacaaattcgaccctgaacggttcgccgagccgcgcgccgagcacaagaagcaccggtatgctttcgccccgttcggcggtggtgcgcacaagtgcatcggcatggtgttcggtcagctggaggtcaagacggtggtgcaccggctgttgcgccggtaccgcctggagctggcccggccggggtatcagccgcggtgggactacggcggcatgccgatcccgatggacggcatgccgattgtgctgcgtccgctgtgatcgtcctcgaaggctcgccgtcgaggtagggatcaccgatcaccgagagccgtccgaccactggggcgcgaaaagccggttggcgcaggcgatcacggcgcgcagcgccgaccgtgtcggatcgggcgaccagcccatcgcccactcggcgcgcgcgccgttgccgccccggatgaaagtggctgtggccgttgccgatcgcatctgatggaagtgcaggatctcgaggttgatcccgcgctcgtgcagcatcgcggtcagggcggcgatcggcccggcggcggccgccgtcgcggtgccgatctggtcgccgacggcgatcacggcccggtagttgccggcccgcgaccccagtcccgttgcggcgcaatcggagtcggtgcgctcccaggggcccaaccgcagcgggccgccgctgcggccgtaggtcgcgacgaaggcgtcccagctcatcgcctcggcccgttcgcgcaggccgcggggcaacgggacgccgaagcgatcaccgaaccacgcggtggcggactcgggatgcggcagcgggtttcgttcgggaatggtcatgacggtcttctccggtcagcaggaacgaccgacggcagtagcttccgacccacagcggggggtcggtccggatcagaccccgctgcgggtgctggctactacggcacgctcaagaagacgcacgagacacgaggttagtcgcccgcgcgccgcacccgcaaccgcgttgcagacggaccgtacaaaaaaatatcgaaaacgaatctgaaagtttggtttacccgtgtctaacagggggtatgacgccgtcgacagtcaattagacggctgttcaactacccctcaccggaaaggcacgaacatgaaggcgaagagcaccaagaaaaccctcaaagctgccgtcgcggccgtcggggtggccgcggtgttggtacttccgaccggatgcgcaacttccgtggccggcgggggcacgggcagttgcactctcttgtgcgtctagcagctcagtgagctagccgccgggcaaccgccaaacgcggcttccagcggctaactccatttaattcggccgattgtttgaccagtcggatcgattctgcgttggccgacgtggcgccgcaaacgggtttgcaccatgcacttatttgcgttgtgccactcaatcaaagccgcgtcccatcctgggcaaattattaatttagccgcgctgcatgtgcgtcatttcagctacgccgccggagctggaacctgttgtgctgcagcgattaactctgcactcatgctgccatcgagccgctattgaaatcagaatttgggtctttacgcatgtctaataggcgctataacattgcttcgtcgggcaaactacatgccgagtatgccctggatgggaaggatctgaatatgaattcaattggggtaaaacagctccttaaagttgccgcagcggccacaggatttaccgtgatgctgttcgtcccgaccggatgtttggagaccacaggagccgccacaggcgggacgaccggcggcggcctctgcattcccctgctgacctgctgaccaaccaagacccgcggcccgccggatccccttgccggcgggccgcttgccgtcagccggtcggccggaccgccggctcgaaacacaggtacgcctgaatcgtcgtgccggtggaggtggtgtgcgtgcgcaccagatcggagatggcgttcaccaggtacaggccgcggctggccggaccgcagggccccgggtccagccgccccaccagcgggtcgtcgaaccgcccggtgtcgcgcgcctcgcacaccagatacctgtcgtcctgccagaacgccagccggcaggcgcccccggtgtacatcaggctgttggtggccagctcggtggccaccaactgcagatcctcgatgctctcctgggacagcccgacccagcccgcgtagtcgacggcgaacgagcgggccggccgcaggtccgccgacctgcggaccaagtaggtcacggccccgggattggcgggcaacggctggttgcagcgctccagcacctcgcccggggcgtagtccggactgcgttgcagcgcaccggatttgcacagcagcgggtgcgtcgcgcgcgcgtcggccagcacgccgtcgtcgagcgtgctcgcgtcatacaaacacagggccgtggccgggtagccgtccatcgcctcgttgaccagcgcctcgtgctcgatgcaggcgacgaactcctcccggctccggcccggccacgccagctggctgacgatgcgcacccgccggtccgggtgttcgtcgacgaacgcgccctgcatcgccatgaaccggctgggattacgggcggactcggtgatgtcggccatgcggacgccggcgggcggctccccgccggcgtacagttcgtcgcgcagcaacgccatcagggcgggcggcacggccagcagcacggcctcgttccccgccagcccgtcgccgacgaaaccggcgaccacgtccaaaaactcctgctgagagcggtagatcagcgcggcgtgaacgaaaccgtactgtctggtttcgtcatctgccgtcacttccgcgctctcgctttcgatcacttgggccaactccctgctgggccggcccacgccgccccctgttccagtaccccagaccggcccgcgctatgcggcgcaacagatcacatttgcgcgctacagccaccaggaggcggccgcgtccagatgacggcgcagccggtagctggcgacgctcaggtcgccggccgcgaccgcgtcggcgatccgcaggtgcgcgtggtgcaccgcgcgcacgtccgaccaggtcggtagcgcctgtccggtgctcgaccagtgccggcggaacagctcgacgatgatccgcaggaacaaatccagcggggcgttgccggcgagttgtgccaacccgacgtggaagtcgaattcctcggcgatcgcccgccgcacgtcgtcgggggtttgtcgggagtcgtcgggcagcccggagcggcggctggccacaaatgccgccacctgcggctcggccagccgtttgacgaccttggcgacgttgtcgatctcgatggcgtcccggacgcagcgcaggtcttcccggctcgggtcgcggtattgcaggtacagggcgatggtgtcgatgctggcctgcgccgccggctcggcgatcaccagcccgccgcccgggccgcgccgcatgtgggcgatcgagtggtactcgaggaggcgcacggcttcgcggaacaccgcgcggctgacccggtagcgctgcagcagggccgtctcggtgccgaagaccgagcccacccgccagccgtcggcggcgatgtcgtcgccgatggtggcggccagcatttcggccaattttccttgcggcacttcggaattgagcggtcggcgcggcgtccgcccgcggttgcggtcaccggcgtgatgccgttgcagccaggccgtcaccgcctcgacgtggcgctcggacagcgtcttggcccgcgccgggtcgccggccgtgaccgccgcgacgatccgggagtggtgggtgtgcaggtggtcgaccgcctcgagggcctcggtctcggagtccgttcgcgattgcagggcgtagcgggtggtgagccgcatcaggaccttgatgaacagttgcagcaccgggtttttggattgctcggccagcgcgatgtggaactcgtcgcgcggcatcggcaggccgggcctccactgctgctcggcgtgcaacaccgcgcgcagccgggcgatgccggcctcgtcgatccgctcggcggccagcgaggccgccagcggctcgagcaccagccgcgcgttgagcagatcggccagtgtggtgcccaggtattcgaggtagatgacgacggcgcgggtggccggcccggcgtcgggctcgcagatgtacagccccccgttggggccgcggcgcatccgggcgacctggtgatgttcgaccagacgaacggcctcccgcagcaccgagcggctcaccccgaagcgctgttgcagcgccggttcggagcccagcgattcgccgactgcccacccgcgccggacgatctcggcttcgatgtcccgggcgagggccgacgcgagcgttttcgccggaccggttctgggctccgcgttcatcgatcgccctaccggcaggtgagcagcatgcatcccgcgacgggcccgccgccgacggacaccacgcccacctgcgggcggcgcgccacctgccgctcccccgcgtcgccgcgcaactgcaggcacccctcgtgcagcgcccaatagccgtgcatgcgccccgcggagagttgaccgccgtaggtgttcaacggcagctcgccgtcgcgggcgatgcgcgccccgccctccacgaacggtccggcttcgccgtcgccgcagaccccgagggcttccagccaggccagggtgagaaaggtgaacccgtcgtacaactgggcgacgtcgaggtcggcggccgtcaggtcggtgcgcgaccacatctgcgccgccgcgtccgacatcgccatcttcgggtagtcggcgcggtggaaccagccgccggcgccgtcggagccgccgatcgcctccacctgcaccgcgcggtgcgggcagtcgggcgcgtactcgagatgcgagaccaccacggcgatcgagccgtcgatcgggacgtcgcagtccagcagccccagcggggtggacaccagccgagcacccaggtagtcggccatggtcatcggatcgcggtacaccgcaaggggattcagtgcggcgttgcgcctgccgttgagggccacccagcccagctgttccttgcgggtgccgtacagctgcatgtggcggcggcagttcagcgccagccagttggcggcggagtagtcgtgcgcggcgaccagatcgttgacgtcgtccatcgcaccgacggcgggcttgggctcgccctcgggggtctcgaacatccgggccagcggcggggccgccgcgttgggttcctgcttgaccgggacggtgccgccgagcatctggatggtccggtagacgaccacgtggcgggcgcggcgttcggccacggcgcggcaggccgacatcaccggggagagcaacccgccggtgccgaacccggagccgcagtcggcggcgtcgatgcccagctgggcgttgacgtcggcggcgagcgtgtcgcccagggtggcgatgccgtcgatgtcggtcggggccaggccggcgtcggcgacggcggcccggaccgcctccatggtcagctccaggcccggtatgccggtgcggcgtccgatccgggagatcccgatgccggacaggatcgcgtccttctcgaaatgcgccatgcacaccgcccgtcagaccacaccgtcgccgcgtcgaaccaattgagtgtactgtattcgtcgtgtcggacgggccgctgcgcatcgagtactgcgacggctgcgcgcgctgggtgcatccggccagcggccgatgccgcgactgcggcggcgcgttggtggcccgcgaggtctgcgggcgcggcacggtgttcacctacaccgtcaaccatcacccctacaacccggagatccctaccccgtatgtgatcgccatcgtcgagctcgccgagcagagcgatctgcgtgtggccgccaatatcgttgactgcgaaccggattcggtggcctgcgggatgccggtgacgctgctgccggagcgcggcagcggtggcggccccgcggttcgccccggcctgagccgcgagccgacgcggcccggtcgctagttgatcagcgggtcgcgcggcatgccgaggatccgctcggcgatctgattgcgcgtcacctccgaggtgccgccggcgatcgccatgccgcgggcccccatcatcagccggccggacagggcgccgggaccgtcggtcagcgcgacctcggggcccagcagcgccgccatgatcgccgcgccctccaccatgtgttcggccagcttcagcttggtgacgttgccctccgggccgggcccggtgccctcgacgctgcgcgcggcgcgccgcaggttcagcagccgcagcgcggtctcctcggcgaggtaggagccgacgcgaatcttcccgcccgccaaccgatccggccgctgctgggccagctgcaccagttggtcggccaggccttcgtagaacgacccgctgccgccgatgctgacccgctcgttgcccagcgtcgcacgggcgaccgtccacccggagttgggcgttcccaccacgtcctcgtcgggcacgaacaggtcgttgaagaagacctcgttgaagtccgatccgccggtgatctgccgcagcggccgcacctcgacctcgggcgccttcatgtcgacgatcaccgtggtgatgccggcgtgcttgggtgcgtcggggtcggtgcgcacggtggccagcccgcgcgcgcagtagtgcgccccgctggtccacaccttctgcccgttgatcttccagccgccctccacccgggtggcgcgcgtcttgatcgacgccgcgtccgagccggcgtccggctcggagaacagctggcaccagatttcgtctttgcgcagcgccttctccacgaatctttcgatttgccaaggggttccgtgctggatgagggtcaggatcacccagccggtgatgccgtagtcgggccgcttgatgccggccgcgcggaactcctcctcgatgaccaattgctcgacggcgtcggccgcccggccccacggtttgggccagtgcggcatcacgtaaccggtctcgatgagcttgtcgagctgggcgtctttgtccagggcggcgatcgcggcggcgtcggcgcggatcgtggtgcgcaactcctcggcctccggtggcaggtcgaggctgttgtcccggacggtgccggcggcggtgcgttcgaagacgtcggcggccggcgcgtccccgccgaacagggccgcggtcaccaccgcccggcgcaggtgcaggtgcgcgtcgtgttcccaggtgaagccgatgccgccgtgcacctggatgttgagttcggcgttgcgcacatgtgccgggaaggccagcgccgcggcgaccgcggcgatcaggtggaactggtcttcgtcctcgcccgccgcgcgggcggcgtcccacaccgcggcgatcccggactcggcgcccaccaacatgtttgcgcagtgatgcttgaccgcctggaaggtggcgatggtgcggccgaactgctggcgcaccttggcgtaggcgacggccgcgtcgacacagtccgaggccccgcccactgcctcggcggccagcagggtgcgggcccgggccagcgccgagggccgcgcgccggcgagcaggtcggcgtcggacacccgcacgttgtccagccgcacccgcccggaccggcgggtcgggtcgaagttgtccggcacgtcgaccgagacgccgtcgcggtcccgctcgagcaccagcacgtcgtcgcccgcggcgatcagcaacagcccggccagcccggcgcccagcacgatcccggcctcgccgtcggccgccccgtcgcccagccgcacccggctgtccaggccgatacccgcggtgacggttccgtcgatcaagccgggcaacagccgcgacttctgttctgccgtaccgtttttggcgatcaccgccgacgcgatgacggtcggcacgaacgggccgggcgccaccgcgcggccgagctcctcgacgaccacgaccagttcgggcagcccgaagccggagccgccgtactcttcgtcgatgtgcaggccgagccagcccagctcgaccaggttcggccagaacccgggccgcggctcgtcggtggcatccagcagcgaccgcgccgcccagcgcgccttctgcgacgtcagaaacccgcgggccacctcggcgagttcacgatggtcgtcggtcagtgcgatacccatgcgggagccctcctcgccgtaccgggatgggtgcctgccccgcttcgaggggaagcggggcggctgcctaaagagtgtacttaatgcgaggagggttccggcggggggcgcctacttgggcgcgaaccgctgaccggcgtccagccgcaggcactggccgttgagcatcgggttgtccacgatggccagggccagcttcgcgtactcctcgggacggccgaggcgcttggggaaggccgcgtccttggtcagctgcgtcgcgaactcgtcgggaatgccctgggtcaacccggtggcgaacaggctgggggcgatcgccagcacccgcacccccaccgagccgaggtcacgcgccatggtcaggcacatcccggcgatggcggccttggcggcggtgtaggcgacctgcccgatctggccctcgaaggcggcgatggaggcggtgttgatgatgacgccgcgctcctcgtcctcgggctcgttcttggccatgtgcgcggcggccagccggctgatgttgaaggtggcgatgaggttgaggtcgatcaccgactggaaggattcgaggtcgtgcgggccgttcttggtcagggtccgtttggcgatgccgcccccggcggtggtgacgatgacgtgcaggccgcccagcttgtcgaccgcgctctgcagggtctcctcggtgccggcgaagtcggtgacgtcgacggggtagaacgcggcgccgatgccctcggccaccgccttgccgtcggaactctcgcggtcgaggatggcgacgtcggcgccgcgcgccgcgaacagctcggcgctggcgcgtcccattcccgatgcaccgccgacgacgacggctttcttcccgttgatctccatccggacctcccattgtcaggcttgtcagaatccatgcgatttgtaacgttacgtaggcacgctagcgtgtccgctccaggcgcttgtcaccgagccatgccaagctggcgaccgtactgcttttcgacgtggcgacggcgtcggccgacgtcgggggcacgccgtcgcggctgaccaaagtcgcccgcatcgccgacctgctgcgccgggccgcacccaacgccgccctggtcgcgatcgtcgtgtcgtggctgtccggtgagttgcggcagcgccagatcggggtcggctgggcggcgttgcgctcgcgcccgcccgcggccgcacatcccacgctgaccgtcgtcgcggtggacgccgccttcgccgagatcggcgccgtggcgggcaagggcgcccaggcgcgccgcgcggccctgctgaacgcgttgttcgccgcggccaccgagaccgagcagacgtttctgctgcggctgctgggcggcgaactgcgccagggcgcgctggccgggatcatggccgacgccgtcgccagggccgccgggataccggccgcggcggtgcagcgcgccgcgatgctgggcggtgacctgccggcggtggcggcggccgcgctgtccggggaggcgtccgcgctggacgccttcacgctgcgggtgggccggccggtcgcgccgatgctggcccagaccgcggcgggtgtggcccaggcgatcgaacgccacggcgggcaggcgattttcgaggccaagctggacggggcgcgggtgcagatccaccgcgccggcgaccaggtcaccgtctacacccgaagcctcgacgacgtcaccgcccgactgcccgaggtggtgaccgcgacgctggcgctgccggtcgaggccctgatcgccgacggtgaggcgatcgcgctgcggccggacaactcaccgcagcgcttccaggtcaccgcctcacgcttcggccgctcgctcgatgtcgcagcagccgttgcggcgcaaccactttcggtgttcatcttcgacatcctgcactgcgacggcatcgacctgctggacgcgccgaccaccgaccggctggccgcgctggacgccctggtgccgcccgcgcagcgggtcgaccggctgctcaccgccgaccccgacgcggcgggccggttcctggaggcgacgctggccgccgggcacgagggcgtgatggccaaggcgccgggcgcgccgtatcaggcgggccggcgcggggcgggctggctcaaggtcaagccggtgcacacgctggatctagtggtgctcgccgtggagtggggctcggggcggcgccgcggcaagctgtccaacatccacctgggcgcccgcgacccggccaccggcgaattcgtcatggtgggaaagactttcaagggcatgaccgacgcgatgctggactggcagacggcccggttcaccgagctggccgtcggcggcacggacggctacgtggtgcgggtgcgacccgagcaggtggtcgaggtggcggtggacggtgtgcagaaatcctcgcgctaccccggcgggctggcgctgcggttcgcccgggtgctgcgctaccgcgacgacaagggccccgcggaggccgacaccatcgacgccgtccgggcgctgtactgatcacccgctcgacgcgcgccggtgctcttgcgcgcgtagggtttccgccgtggcaatcaccgagcgcgacgacggcgtcagctacgtgcacaccgaccacaacctgccacccgtcgccatcgtcgaccgctccccgatcacggcccggcaccggatcgtgttcgcggtcatcgcgttcgcccggggcgagccggtcaacgcggtgtggttcgtcgtcgcggcgatctgcagctacctgatcggattccggttctatgcccggctgatcgaacgcaagatcgtgcacccgcgcgacgatcacgccacgccggccgaaatcctggacgacggcgccgattacgtgccgaccgatcgccgggtgctgttcggccaccacttcgccgccatcgccggggccgggccgctggtcggcccggtgctggccgcccagatgggctacctgccgtgcaccatctggatcgtcgccggggcggtgttcgccggggcggtgcaggactacctggtcttgtggatctccacccggcggcgcgggcgttcgctgggccagatggcccgcgacgagctgggcgcctccggcgggctggccgcgctgctcggagcgttcgtcatcatggtgatcatcatcgcggtgctggcgctggtggtggtgcggggactggcccaaagcccgtggggcgtgttctccatcgccatgaccatccccatcgcggtgttcatgggctgctacctgcgcttcctgcggccgggccgggtggccgaggtgtcggtcctcggcttcgcgctgctgctgatcgccgtggccaccggcagctgggtcgccgaaacaccttggggcgcatcgtggttgagcctgtcgccggtgacggtgtcgtggttgatcatcggctacggtttcgtggcgtcggtgctgccggtgtggctgctgctggcgccgcgcgattacctgtcgaccttcatgaaggtcggcgccatcgccttgctggcggtcggcatctgcatcgcgcgaccggtcatgcaggcgcccgcggtgtcgcacttcgcctcccgcggcgacgggccggtgttctccggcgcgctgttcccgttcctgttcatcaccatcgcctgcggggcgctgtccggattccacgcgctgatctcgtcggggacgacgcccaagctgctggagaaggaaagccagatgcggctgatcggctacggcggcatgctgaccgagtcgttcgtggccgtcatggcgctgatcagcgcggccgtcctcgaccagcatctctacttcaccctcaacgccccggccgcgcagaccggcggcaccgcggccaccgccgcgcactacgtcaacgggctcggattgcccggcgccccaacgactgtcgaccagctgaaccgggccgcggccgcggtcggcgagaagtccatcgtgtcgcgcaccggcggggcgcccacgctggcggtcggcatggccgaggtgctgtaccgggtgttcggcggcgccgggctcaaggcgttctggtaccacttcgcgatcatgttcgaggcgctgttcatcctcaccgccgtggacgccggcacccgggtcgcgcggttcatgctctccgacaccctgggcaacctcggcggcccgctggcgcggctgcgcaacccgagttggcggcccggtgtctggctgtgcagcctcgcggtggcggcgggctggggcggcatcctgctgatgggggtgaccgacccgctgggcggcatcaacacgctgttcccgctgttcggcatcgccaaccagctgctggcggcgatcgcgctgaccgtcatcaccgtgatcgtcgtcaagaaggggctgctgaagtgggcgtggattcccggggcgccgctgctctgggatctggtggtgacgctgagcgcgtcgtggcagaagatcttctccgccgaccccgccgtcggctactggacccaacacttccaatacctggccgcgaagagcgccggccggacgtcgttcgggtcggcccgcaacgcgcatcaactcgaccaggtcatccgcaataccttcatccagggcagcctgtccatcgcgttcgcggcggccgtggtcgtcgtggtgatcgccggggtgctggccgcgctcggcgcgattcgcgggccggccagccggctgagccggccgctgaccgaggacgagccggtgccgtcggcgttgttcgcgccgtcgggtctgatcgccaccgccgccgagcgggaggtgcaacggcgttgggacgcgcccggcggaaaggtcgtgcccaagccggcgccgcggtcctaaacttgcgcgatgagagtcggaatcgacttcggcacaacccacaccgtcgtcgccgccgtcgaccgcggcaactatccggtcgtcttcttcgacggcatggacgcgtggccgtcgatcatcgccgccaacgccgccggggagctgcgctacggcgcggacgcggccgccgtgcgccacgacccgtcgtggtcggtgctgcgctcgttcaaacgtctgctcaacgacgccgggccgcagacccgggtcaagctggccggccgtgactaccggctggccgaactgctgaccggttttctggcgcggctgaaaaccgatctgcagcagcactccaacgccaccgtggcccccggggagcccatcgaggccgcgatcagcgtgccggccaacgcctccagcgcccagcggctgctgaccctggacgcctacgtggccgccggtttccacgtcgtcgccctgctcaacgagccgtccgcggcgagcctggaatacgcgcatcggtaccgctccaccatcaccgccaaacgggagtacgtgctcgtctacgacctcggcggcggaaccttcgacgcgtcgctgctgaagatgaccgggcactccaacgaggtggtggtcagcgagggcatccagcggctcggcggcgacgacttcgacgaggcgatcgtcgagctggtgcgggccggtgcggacctgcccggcctcgacgccgccggccgcgcgttgctggccgaggaatgcgccgcccgcaaggaggcggtcgggccgcagacccgccgcttcctggttgacctgtcgccgttcgaccggcccccgttctcctgtccggtcgacgacgtgtacgcggcgtgcgccccgctggtcgatccgacgatgcggctgctggagcgggtgctgcgcgacccgagccgcggccgcgcggacgtggactggtcggaggtggccggcatctatgtggtcggcggggccggcggcttcccgctggtgtcccggatgctgcgcgcccggttcggggacaagcgggtcaagcgctcaccgcacccgttcgccgcgaccgccatcgggttggcggtgttcttggacaaggaatcgggttttgcgctgtccgaacgcttttcgcggaatttcggggtgttccgggaggcggaggcgggcgccggggtggtgttcgacccgatcgtgtgcaaggacgtgtcgctgccggccgacgggcagaccccgctggtggtcaagcggcgataccgcgccgcgcacaacatcgggcacttccggttcgtggagtgcagccggctggtcgacgggcgacccgacggcgacatcaccccgtatgacccggtgctgtttccgttcgacccggcgctgcgcgaccgcgacgacctgggccgccagccggtcggccggtggcgggacggacccgacgtcgaggagcgctacgtgatcgcgcccagcggtgcggtggaggtgacgttgacgacgcagccggccggcttcgaacgcaccttccggctggagcggtgcgcatcggcgagctgagccgcggccgctagttgcggaccgcgggcagcacggcctgctcccaggccgcgaagaacccgtccatgtccgggccgatctgctgcacgtagacctcgtcgatgtcggcgtcgatgtagcggcgcaactgggcgatgtgccggtcggggtcgggcccgcaggcgacgctctgggcgacggtgtccggcggcaccagcggcatcagcgcggcgaaatccttggggcggggcaggatttgggacgtctggccgggcagcccctcgttgccccacagccggtgcgcggttttcagcgcggcgtcggcgtcggcgtcccagcacaccttggtgccgccctgcaccggcttgtcgccgccgccggcctcccggaactgtttgaccagctcgccgtcgggcatggagatgctgtatccgtcgccgatccgggcggccagccgcaccgcctgcggcccgaacgccgagccgtagatgggcaccggctgctcgggccgggtgtagatccgggcttcctgcacctcgtagtgcttgccgtggtggctcacctcgccgccctggtgcagcttgcggatgacctcgacggcctcctcgagcatctgaagccggaccccggcggacggccagggatcgcccaggatgtgctcgttgagggcctcgccgctgcccacccccagcacgaaccggccctgcagctgcacggccgcggtggccgccgcctgcgcgatgatcgccgggtgtatccggatggtcgggcaggtgacggcggtgctgaccggcagcgacgtcgcctcggagagcgcgccgatcaccgaccacacgaacgggctctggccctgctcgtcgttccagggatggaagtggtcggagatccacagcgcctcgaacccggcgtcctgcgcccgcttggcctggtcgacgagttccttcggcccgaactgctcgcaggaaagaaagtatccgatcttggtcatggcgccccggctacccgctcggcggtcgcttaagcattaggcagcacccgcgagaacacgccggccaattcgggagaagacagttctcgataaccgagagacgatttacgatcactggtgacctgagcggtccctgacgatcggagttccccatcgacgcctggattctcgacgccgtcgacgacgtgatcgccggcggcggcatgggcaccgcgaccatcatcgagcgggtgtgacgatgccgagcatgctggagctggccgcgccgggcgacggggtgcgggtgctgcggctgaatcgcccgcaccggctcaatgccatcgacgaggcgatgcagaccgaattgcggttggtgctcgacgatttggccgccgaccacgcggtacgcgccgtggtgctgaccggcgccgggcggggcttctgcgcgggcatcgacatgcgtgacttcgggccgtcgatggtcagggccgacgcgccggcgctggagcggatgcggtttcaggagcggatggccgccctcgcggaggcggtgtgggcactgccgcaacccgtcatcgcggcggtcaacgggccctgcgtcggcgcgggactggccctgtgtctggccgccgacatccgaatctgctcggcggcagcgactttcgccaacgcggccatcctgctcgggctgtccggcgccgagatgggcatgagctatcacctgccccgcatcgtcgggaccggcgtcgccgccgactggatgctcaccggccgtaccgtgtcggccgccgaagccgaccggcgcgggctggtgagcgaggtcgtcgagccggaccggctggccgagcgggcggtggagttggcgcggctcatcgccgggcacgcgccgctcggcgcgcagctgaccaagcgcgccctgcaggtcaacaccgacgccgcgagcctggcgtcggcgatggagctggagaaccgcaaccaggtgatcgcgcacgcaaccgacgaggcggcggcgcgccggcagatgtggtcgcggtgaaccgtaacccggagaggacggcagatgtcgtgggacttttccaccgaaccccagtgggcgcggcaactcgaatgggtcgaggatttcgtgcgcgaggagtgcgagccgatcgacctgatcgtcaaggaatctcacgacctcgatgacccggtgcgccaagcgctgatcccgccgctgcagaagatcgtcaaggagcgcggattgtgggccacccacctgggtccgcacctgggcggcccgggctacgggcaggtgaaactcgcgctgctcaacgagatcctgggccgctcggaatgcgcgccgatcgtcttcggctcccaggcacccgattccggcaacagcgagatcctggcgcactacggcacaccggaactcaaggcccgctacctcgagccgctgctggacaaccgcatcgtgtcgtgcttctcgatgaccgaaccgcagggcggggccgacccgaaggtgtttcgcaccaccgcggtgcccgacggcgaccactgggtgatcaacggcgagaagtggttctcgtcgttcgcctcgatggcctcgttcatcatcgtgatggcgatgaccgatccggaagcgccgccgtatcaacgctattcgatgttcgtcgttcccggcgacactcccggcatcaccgtgctgcgcgacgtcgggctgggctatcagcccctcggcggcggacgggaaggatacgtccgctacgaaaacgtccgggtgccggccgatcacatgctgggcccgcgcggcggcgcgttcgtcgtcgcgcaaacccggctgggcggcgggcggattcaccacgccatgcgcaccgtcggcctggtgcgccggatcttcgacatgatctgcgagcgggcggtgtcgcgctacacccagggcgaggtgctggcgaacaagcagctggtgcaggagatggtcgccgactcctggatggagatcgaggcgtttcggctgctgacactgcaaaccgcttggaagatcgaccaattcaacgattaccgggcggtgcgggccgacatctcggcggtgaaggcgatgatgcagagggtgctgcacgacgtgtcggcgcgggcgctgcagctgcacggctcgctgggcaccacgcacgagatgccgttcgtgcagtacctggtggagtccttcgtgctcggcctggccgacggcccgaccgaggtgcacaaggtgacgctggcccggctgctgctcaaagaccgtgcgcccgcgccggatctgtttccctccgagcatttgctgcggctgcgcgcggcggcggaggcgaaattcgccgacaagctggcgggaattccccgtggctagacggctttggtgacgccgacgtaggacagcaccacatcggattcgtcggtcacccggttgagcaccgcataggaccggatgaaggactggcccacgcagccgtcgatcttgacgtggaaattgctgaccatgacccacgggttggggccgcggaattgctttttgaccaccggcaccacgatcaccagaccgggtttgaggcccacgttgagcacgcccgcgatcggcgccacgaccagcggcagcacgtccccgggcaccccggtcaccggtccggtcacgcccggggtgatgccggcggtaccgccgatcgtgacgccgtccgacgtgctcatgtcaatgccgcagccgatctcgtagcccacctcgagcacgccctgcggctgggtcggtcccgacagggagccgacgaagatcccgctggccaggtattcgcgggaggacagcgcggtggtcagcggcgccaccgggacctgctgctcgtcgcgggcgccgagtccaagcgtccagccgtcgggagtcttgaggattgcgggcggattggagggcagcgccccctcggcggccggcgcggcttccggagggggcggcgcggcgtcggggtcggcgcccgtcgtgggcgccgtgggcagcgacagcgccaggcagacggcggccaccagggcgcgacgaacgaccacggcaatcggcctcacgggcgacaccgtacgcaccgggcaattccggtagcgaaatttgctgggcgcccggtcgaagtcgttgtgcgttcgtgactgttatgcgatgtgcgcgcaaatgtagactgggattttcgataagcttcccaggccaacgatccgggcggaaaccgaggaggcggcgatgacgtttcgcagctgcggtcgcggactgctcgccgcggcggcgacggcgattgccctggggtgcgccgccggggcggcgcatgccgaccccaacgtcgatccgcgcccgcagccgccggggatcgacgacgtgtggagcccgttcccgaccacctggaccaacccgtccaacgagggccagccggtgaacgactcgggcgacgtcgggatgatctgcgaaaatctgctggtccgctgccagtaacactcatcggcgccgagccagcagcgccccggcgcgatccaacagcctcggcaaagtcgttgccatggactctaattcggctcgcggcgaggatcggcgccgattgtgcttgacgatcagcgaccaggtggccgccgacttgaaacacgccagcgcgctgaaccaatccagatcgccggcatcgcaacccaattcgtgaaggtagaggtcggcgagttcggcggtcgagggaaccgcaccgtgcggcggcgtcacccgccggtaggtgtccgggtcgcagttgatcaggaaccagcccacgtcgatgcgcgggtcgccgatcgaccagatttcccagtcgatgaccgcgttgatccgcgggccgtcggcgagcaggttgcccagccggaagtcgccgtgtaccacggcgggcggcatcgcgcgcggcgcgcaatccagcagcgcgtcacgcactttcggccagccgggggccagcgccgggtcgacggtccccaacgtgtcggaccagcggtggacttcggccaccggatcggtgaccggttcgccgcccaaccccagttcggtcggcgagatgcggtgcagcgcggccatggtccggcacgcgttgcggtaccggtcggccaggccgggcacggccggccagccgtcgaatagcggttccccacagtcgccttcgacgcgcgacatcacgtacagcggcggcgtgtacggtgcctgcccggcgtcctcccagcacacccggggaaccggaacatcggtcggcgcaagcgctttgatgatgcgggcctgacgcagcacatcgcggtgcgcaaccggtgccacacccggcggagcgaccttgatcaccaccggccggccgtcgcgaatgccggcgaaggtgaggccggacgcgccgccggacagcggggtgacgtcggtgatacccgcgccggccagccggccgcgcaggacgtccaggtccggctcggcgctgctcatgtgaccggcgggccggtgccgggccagccgacctcggcgaggaagggttgggtgtgcgcgatgcgaccggtcaacgtcttcggatcaccggtgcacaaccggaacaccgtctcggtgatcagcgcgatgtcctcggtgtcggtcttggccagatccagggtgccggcgccgggcgtggcgacggggttggacggtgcggcggcgttgacggcgatcccgtcgtcgtacagttcggccgcaaggcttttcgtcaaccggttcagggcggccttggccgtgccgtagatgccgaagccggcggtccggtcgaattcggagaacggcgggccgggcggcaggtcgccgcccaccgaggtcaggttcacgatccagccgcggccgcgctcgcgcatcgcggggatcgccagctggcacaggtgcagcggcccgagcacgtgcatctccatcatcagccgggcgcgccgttgcgggaacccgtccagcggccgcaggaaggtgaccgcggcgttgttgaccaggatgtccggcgcgccgactgtgtcgaccacctcggcgaacagccgctcgcgttcgtcgggttgcgacaggtccgcctgcaccgcaacggctttcccgccggcggccaggatctcgtcgcgggtctggcgcagcgacccctgatatttcgggtcggggtccagggtgcgggcggtcagcgccacggtggcgccgcgtgcggccagccgcccggcgatcgccctgcccagcccccggctgctcccggtgaccagcgccaccatcccgtcgcaccgctgcccgctcatcgtcgtcctcctcggtgacggtcggaaatggcttctccgcatcagagaatgccattatcgccggtgcgggaaaagcggctagccgtcgatcgccgtcgccgcccaggccagcagccgccgccatagtcgatgccggctcgaggccatgttgtggcagtgcgcgctgccggccagcaccacggtggtgatgtcggggctgctgcggtacagggcggcctcggcgcgcggatccggggagacgtcgacgacgccgtacccgagcagcaccgggacgtcgatgcgggcggcgtgctcggccacgatgccggggatcatcgccgtgccgaacacccgcggcaccaccgacaccgcggtgaccgcgtccgccgcgacgatgtcggcgggcacgtcggcaaggtggaaccagccttgcaggtgctcgcgcggccccgcgaaatacggctgcgccagcgcggcgaggatctcggcggccagctcggcgcggccttgcggggtggccgcgcgggcgcggaatgccgggtccaggttcagcggcgcgacgtgctggttggtgcacccgagcatcgccatggcggcgtaaccgccgaacagcgcctgctgggtgagggcgaggtagccgcccagcgaatgcgccaccgccaccgccggcgcctgcacgccggtggttccgggcagcgcgcgcagcgcacagtccagcgcggcgccgatctcggcgaaaccgaaatcggatgccggctgcgaactttcgccggtgcccaacggatcgaccgtcagcacggcgtagccgttgccggtggcgaaatcggcgaagctgtagccgtcatggccggcgatgtcgaggtcccagtactcgcggctgtaggtgccgcccggcaggcagaccagcaccgcggccgccgtgccgccgcgcgccggatagtaggtcgccgccagcgacgcccgctccccgaccgcgctgctgacgtcgaagcggaccgggtgcccggtaccggccataacctgcgcttcctttcctgtcctgtacacacatacctgtacatgcgtgcgcgaggaggcgtcttgacctatctgttcttgatctgcgcgattttggccgaggtggtcgcgaccagcctgctcaagagcacccagggtttcacccggctgtggcccaccgtgatctgtctgctcggctacgccgtgtccttcgcgctgctggccgtgtcgatttcgcgcggcatgcagaccgacgtcgcctacgcgttgtggtcggccatcggcacggcgctgatcgtgctgatcgccgtgctgttccttggctcgccgatatcggtgaccaaggtcgtcggtgtcgggctgatcatcgccggcgtggtgacgctgaacctgaccggggcgcactgaccgggtccggcgccgggccgaaggtgccgtctcgagtggacgattcgccggtgcgccgcaaggatcgacagcacaactcgtggcagggagggaagtgacatcacgattcgccggcctggcgctggcgccggtggccatcgcgctggccatgctgttcgccccgttcgccggggccgacggctacaccgatcagctggtggcgaggttcgacagccagacgcatgtggtggccgacccgggggcacggccaccgctgcagaacccggacgggctgaaccggcagatcctggcgggcccgtggcggtggagttccggcccgccgatctgggtggcggcggtggcgcccgcccagagcggggtgaccacggccgattccatccacgaggccatgctgcgacgagacgcccagttcagcggggtcatcctggtcatcgactcccgcggctaccacgtgcgggcctaccacgtgcccaaggtcgtcgcggacaacgtcgacgaattcatgaaccagtcggcgcaagatcatcgcaacgatccgtacggcgcggccagtgaattcgtcggcaagctgtcgggcgtcagcgtgcccacccgcgcaccggtgtccacctccccgctggtgcaacagcagcgcgacgactgggcctggctgaaggcggcgttcgtcattgccgggatcgcgttggcgacggccggcctgatctggttcgcggtcagtcgaaatcgcaagcaccgcaaggacatcgagaaccgcgagcagatcaagcaggagctgatcaccgccgcgtcgaacgtcggcgacctcgacaacgaagtgctcaccgacggcaacaccgatgtgagcgccgagtcgctgaaggccaatgccagcctgcacgacgcccgaaaagcctacgagaagggcgattacggcgcggcccgcacccacctgcgggtggtggagtccacggtggccaaggccaaccgcaaactgcacccggggcagcgcgaacccgaaggggccggggcggattcgtcggtgcccgcgccggagcgcaagcaggccagcgtgcgcaccaccgaccccgagaccggtcagacggtgacgatcagcaacgccgactaccgccccaccgcgcagcccggctacccgcactacttcggcggcggctaccacaacgggatcttcttccagcccggcttttacccgtacccgttctggggcccgggctggggttgggcgttgggcgacgtgctgctgatggacgcgctgctggacgaccattggggcggcggattcgagcgcggtttcgaggccggccgcgacgcggccttcgcggacgccggcagtcacaatgctgccaactacgacgccgccaactacgaagccgccaactatgacggcgcaaactacgacggcggctatgacgcgggcggcgacatcggcttcgacggcggctgggactcgggagccgggtgggattcgggtggctccgactccggcggcgatatcggcttttgagctctcccggcccaggcgttaggttccttcgatgagcacggacaagatcaaccgcggcatcctgctcgccatggtggcgatcggggcgggcgcctacggcttgctgtacggccacgcgtcggcactcttcaagctgctggtgccggttgcgctgatcgtcctgctcgggctggtcgtccgcgacgtcatcaaggaccgggcggggaacgatgagtgaggccgtctacggtctggcgaccgtcatcgccctggcgctggcgtcgacgttggcgctcgtcgccgcggtgcacgtgcaccggctggagggccgggcgaccgcgccgatcagcgaggaaatcggcagcgccaaggcggttttgcacaaggtccgcaagggcgaacccatgtcgccggcggaggttgactacgccaagcaggtcgtcgccgaccggggctcgctgatgaccctgtgcatccccggcgccctgttcatgctggggtgcttcttcgtcttcggcagcctctaccacctgcacggggcgactccttcggagcgcaccttcctcggcgtgatccccatgttgacctcgacgaacctggccatccagattcgccgcagtgcacggctgaggcggcggctgcggcacctgtcctgaccgaggacgggttcgggttgcggtgttcggaccctttgcacgatgatgtgtcaattgggcacatgagcgtctactattcgacgggcgcgacggcgagagcggggggcagcagcacgatggccggaccgggtcgcaggtgatcgcatgagccctcgctccaccgggcgtgctgtgctggcgcggatctggatgccgctggtggccgtcgtcgcggtgggcgtgggcctgctctgcatgtacaaggtgcaccagttctccgaaccggaaccggtcatcaccgtcaacggtccgcaggcacccgagcagttcaacctcaaacggatcacctacgaggtgttcggctccgccgggcagggcgggaaactcgtctacgtcgacatcgacggccatccgcaccaggtcgacatcaccacgctgccgtggacccacaccgagagcaccacgctgtcggtggcctccggcagcatctcggtgcacgtccacggcggtcaggtggggtgccggatgctggtcaatgacgttgtccgcgacgagcagtcgggcaaccaccaggacgccgacgtccagtgccgggtgaagtcggcatgaccgagcatcgcctcggcgcctcccgggtcaaacgtcccctcatccccaggatggtccgcgccttcgcgataccgatcatcttcttctggggactgctcgccgtcaccacgaatacctttatgccgcaagtggaacgggtcgccgaagagctcgccgggccgatggtcccgcactatgcgccctcgcagcgctcgctgctgcacatcggcgagaagttccacgaatccaactcgaccaacctgaccatggtggtgttcgaggccaaccggccgctgggagactccgaccacctctactacgacgacctgatgcgccgcctgcagcgcgacaccaaacacgtgcagtacgtgatggacctgtggggcaagccgttcaccgcggccggggcgcaaagcgtcgacggcaggtgcacctacgtgctgctgcggctggccggcgacatcggccagatccaggccaaccagtcggtggacgcggtccgcgacatcatcaaaaacgacactcccccaccgggtctcaaggtttacgtcagcggcgcggcgccgctggcctccgatacgctatccatcgccaacgccagcctgaacaacgtcaccatcgtcacgatcatcctcatcgtggtgatgctgctgctggtgtaccgcacgccgtccaccctgctggtgcccctgctcggtgtcctcatcgaaatgcttgtcgccaaagggattacctccaccctcgggcatctgggctacatcgagttgtcgtcgttcgcggtgaacatcgtcatcgcgttgaccctgggggccggcaccgactacggcatcttcctgatgggtcgttaccacgaggcgcggcaagccggtgaaagcagggaagacagcttctatatcgcctaccggggtgtggcgcccatcatcatcgggtcggggctgacgatcgccggggcgtgttactgcctgacgttcgcgcggctgaactatttccacaccatggggcccgcggtggcgatcaccatgctgttcaccatcgccgcggcgatgacgctgggtccggcgctgctgaccgtcggcagcctgttcgggatgttcgacccgcggaccgacagcaaagggcgtctgtaccggcgcatcggggccagcgtggtgcgctggccggtgcccatcctggtggccagttccgcgatcgtcatggtcggggcgatcttcgtgcccacctaccggcagaactacgacgaccggcagtaccagccgcgaaatgccccggcgaatctgggttttcaggccgccgatcggcacttcccgaaaagcaagctgttctccgagatgctgatgatcgagaccgatcacgacatgcgcaactcggccgacttcatctcgctggaccgggtcgccaaggctctgatccggctgcacggggtggcgatggtgcagggcatgacccggccgctgggccgcgcgctcgagcacgccagcattccctacctgttcaccacgcagggtagcggcaacggacagcagcttccgttcaaccgggaacagaactccaacaccgacgcgcaggccgagatccaggcgcactctgttgcggtgctgcgcaaggagatcggctttttccagaaggtgtccgacgagctgcaccagaccgtgctcaccgtggaggatctgcaacgggtcagcgacgagatgaacgaggaagtctcgaacctcgacgacttcttccgtcccatcaagagctacttctattgggagaagcactgtttcgacattcccctgtgctgggcgttccgatcgctgtgggacaccatcgatcacatcgaccacctggccgaagacatcaaccaggccaggatctcgctcaccgaggtggacaaggcgttcccgcagatcatcgcccagctcaaggccaccgccgacgacaccgaggcgttgcagttgaagttggtcaacagctacgggtcggcggatctgcagtccatccagaccgatcagacctacgacgacctgatcaacgtcggtaacgacttcgaccggtcccgcagcgacgactacttctacatcccgcacgagggtttcgacaacgacgacgtgaagaccggcatgaagctgatgatgtcgccggacggcaaggcggcccgcttcatcgtcacccacgagggcgacgcgatgggtcccgaaggggtggaacacgtcgaacagttccccgaagcgatcaagacgatcctgaaagagacgtcgctggcgggcgcccggatctacatcggcggttcgggctccaacgacaaggacatcaagcagtacgcgatgtcggatctgctgatcgcggcgatcgcggcgttcgtgctgatcttcttgatcatgttgttcatcacccgaagtctggtggccgcgttggtgattcccggcaccgtggccttctcctacgccggggcgttcggcctgtccatcctgttctggcagcacctcatcggcctgcatctgcactggctggtgctgccgttgacgttcatcatcctggtggccgtcggttcggactacaacctgctgctgatcaacagggtcaaggaggagctgcacggcggcatccacaccggcctgatccgcgcgctgggcagcaccggcggcgtggtgacgtcggcgggcctggtgttcgccttcaccatgctggccatgctcaccagcgagctcagaaccatcggtcaggtcggctccaccgtgtgtatcggcctgctgctcgacacgctgatcgtgcgctcgttcgtggtgccgtccatcctgcggatcctcgggccgtggttctggtggcccaccctggtgcgttcccggccgctgccccagcgatagccgcgcgggcgctacctgaagatccgatgagagagacggccgggcccacagcggccgcgggcataatcgtggcgtgacggcgccgggcgcggcgaggccgcagaagcgggccggatcgctacgacccggcgaactggcgcaggcctcggtgatgggcgcgctgtgcgcggcgatcgccatcatcgcggtcgttcttccgcacggcggcgggctggggctgctcggtagcgtgccgaccggcctgctcgcctaccgctaccggatccgggtgctgatcaccgcgacggtcgccgccggcgtgatcggctttttggtcgtcgggttgagcggtttggcggcgatcgcgttgtgcgcctacaccggcgggctggccggaatcgtcaaacggcaccgccgcggcacacccaccgtgctggcggtgtcattggtggcggccggcgtcgtcggcgcgggcatggtcatcgcgctcaccgtgttgacccggttgcgccagttggcctttcatgccatcggcgcggcggtggacggcgccgcgtcggtggtggcgcgagtgccgccgctgcacgcggccgccgtgcggttcgccgagttcttcgccgcggcgttgcagcactggcagtggatggtgctcgggtacgcgctcgtcgcgatcgtgggcgcctcgctggtcggttggtgggcgttgtcgcgggtgctggagcggctgcgcgggattcccgatgtgcacaagctggacgcgccggcacgcaacggcccgacccggcccgtcccggtgcgactggaccgggtgcggctgcgttacccgcacgccgaccgcgacgcgctgcgcgccgtcagcctggacgtgcaagcgggtgaacacgtcgcggtgaccggcgccaacggcgcggggaaaaccaccctgatgctggtcctggccggccgcgaaccgacgtcgggcacgatcgaacgccccgggtcggtgggcctgggtgagctcggcgggaccgccgtcgtcatgcagcatccggagagccaggtgctgggcacccgggtcgccgacgacgtggtctggggtctgccgcccggcaccaccaccgacgtgggccggctgctcggcgaagtcgggctggcggggctggccgaccgcgacaccggcagcctgtccggcggcgaactgcagcgcctggcggtggccgcggcgctggcccgggagccggcgctgctgatcgccgacgaggtcaccagcatggtggaccggcagggccgggagcagctgctgaccgtgttgtccggactgaccgagcggcaccgcaccgccctggtgcacatcacccactacaacgacgaggccgaatacgccgaccgcaccatcaatctcggtgatacgcaaggcgataccgccctgatccgaacggcgaccgcgcccgcgccgacgtgcccggcgggccgggggcgccgggcgccggtgctcgaactcgccggcgtcgggcacgaatacgccagcggcacgccgtggtcccgaaccgcgctacgcgacgtcagcttcaccgtgcacgagggcgacgggctgctgatccacggcggcaacggctcgggcaagtccaccctggcgtggatcatggccggactgacggtgccgaccacggggacctgtctgctcgacggccgtcccgccgccgaacaggtcggagcggtggcgctgcagttccaggccgcccggctgcagttgatgcgcagccgcgtcgacctggaagtggcctcggcagcgggcttttcgtccgacgaccgtgaccgggtcagcgcagcgctggccgcggtcggcctggatgccgggctggccgagcggcgcatcgaccagctcagcggcggccagatgcggcgcgtggtgctggccggtctgctggcgcggtcgccccgggtgttgattctcgacgaaccgctggcggggctggacgccgccagtcagcgcggcctggtcgagctgctggccgagcggcgccgcgagaccgggctgaccgtggtggtcatctcgcatgacttcgccgggctcgagcagctgtgcccgcgcatcctgcacctgcgcgacggctctctggatgcgaatcctgttgcggcccggccagatccggtgcccgttgccccgccgactaaacgtccggcggcgcgccgccggcccgtggtgctgctgcgccccgtcccgggcagctcgcccatccacgagctgtgggccggaaccaaactgctggtggtgttcgccatgtcgttgctgctcacggtgtttcccggatgggtggccgtcgggctggcgaccgcgctggcggcagcgggactgcggctggcccacatcccgcgcggtgtgctgccctcggtgccgcgctggctgtggatcttcctgggcgtcgtcggcgtcaccgcggcgctggccggcggggccccgacgattcgcctgggcacggcgtcgctcgggctgggcgggctgctggacttcctgcgcgcgaccgcgctgaccgtggtgctgctcggcctgggcgcactggtgtcatggaccaccaacgtcgcccagatcgccccggccgtagcgactttgggcaggccgttgcgagtcctgcggatcccggtcgacgactggtcggtcgccttggcgctcgcgctgcgcaccttcccgatgctcatcgacgagttccgggtgctctacgccgctcggcggttacggccccgccggccggcgcagacccgctgggcccgactgcgccggccggcgaccgacctgatcgacgtggtcgtcgccgtcatcaccgtgacgctgcggcgcgccgacgagatgggcgacgcgatcaccgcgcggggcggcaccgggcagatctcggcggccccgtcgcgtccgaaacgcaatgactggatagcgctttcgatcgcgtcggcggtgtgcgcggccgcggtggcggccgagctggcgttgctggccggccactagagcgccgcttttagaaccgggccagcgccggcacatccgccagcgcgcagtccgggatgccctcggccgcgcgcagcaggaagttgagcttttcgatgcgttcgcccgagcgcggtgcgccgttcttctgcaacggcgcacccagccccaccgccagatccatcaccacgtcgtcgatgacgccgcccgaccggccggacggaatcgccagaaggccgttctgcgaggcatattcgaagcagtccagcgcctcggcgatggtgccgacctggttgggcatgaggatgaacccgtcgacggccgacgtctcgacggcgcgccgcaaccggtcgcggttggtcacgatcaaatcgtccccgacgatgatcgaacggttgaccgtctgcaccgctttggtgaacccggcccagtcgtcgccgtccagcagatcctcgatgaacagcatcgggaactcctgcgacagggcgcgagcgtagtcgatcaacgcctccgcggtcacccggccgccgttgaaagcgtaagtggcggaaccgttgtcgcacacctcgctggatgcgcagtcgagtgcgaacgccatgacgtcggcgcagccggcgcgctcgaccgcctcggccagcagttccaggacggcgtgcgggtcaccggacggcgcgatatagccgtaggacgacgccaacagcggtgtgcggcccagatgttcggcgagcacctcgccgagcacctcgaacaggctcacccccttctcgaccgccgcctggatcgactccgcccgatacggcacgacgaggaactcgctgaaactctgctcgacgtccccgtagcggccgccgttgatcatgttgaagctgggcatcggcacggtggtcggtggtgtcagcccgagcagggcgccgacgtaggtgtaggtgggtgtgcccgctgccgcggcggccgcgcgcagcagcgcgatcgacgtggagtagatcgcgttgccgcccagccggtgtttgtcgggcgtgtcgtcgagttcgatcatgacccggtccagcgaccgcgggtcgtccagttcggcgccggtcagcgcgggggcgatttcgtctctgaccgcggcgacggcgcggtgcacgctgcggccgcggtatcgggtggggtccccgtcccgcaggacgaacgcctcgtgcgccccgacggaggtgccggtcggcgccgcgccgcggccgacatggccggtgtcggtggtgatttcgacctcgaccagcggccgggccttgcagtccagcagttggcgggcgacgacggaagcgatccgcaccatcgacctcccggaccctgtcgaggcctatcgagagcgccagcctaagacaaatccgctgagagctcgctgagaactccccgcctagggggtctcctcctcctggacaccgaaggtgttgaccgccagcgccagcagcaggtagccgccgatggtgaagatcaggtccatgcactgccgctgcgtgaacagctcgcacagccggtcccaggtctgccggctcagggtgctgtcaccggtgagctcgtcgacggcccggaccacggccgcatcggtcgggtcggcgcagcggccccgtcggatgtcgtcgatgtcggattcgctcaggccggcgcgccgcgcgatggggaggtgatgtgaccacaggtagccgcacttgctgcggtgtaccacccgaagcagcgcgacttcgcgtatccggggcgacagcgtcgaccgggtgagcaagtacgcgttgaacggcaggtaggccgcggtgaggtcggggtggcggaccagggtcgacaaaacattgcccgccccaacgggattggcgcgctcggcggggatcagcgaggccagcgccgcgcgggtgtcctcgtcccactcgtcggcgggcagcggtgtcaggcgctgcggatgccggtcggacgcggccatgctattggatcggctcgtcaccgcgcacggtggtgcgcagcatctctcgcgacgagtccgggtcgtagggcgccgcccggtgcagcaccccacggttgtcccagatgacggtgtcgccgatcgaccagccgtggcggtagacccgttcgggcaccgtggcgcgctgcagcagttcctcgagcagggcgcgtccctcgtcgacgtccatgcccacgacgtaatccgcggaggcacccagcaccagcgatttgcgcccgctgcgatgcgtccacaccagcgggtgttcatgcgtgcgccgagaccgccagcgcgccatgagttccggtgacggatcgggatagacccggcgctgggaggcctccagcgagtgcaccacccgcaatgcgccgaaccgccgtttctcgtcgtcggtcagtgcgtcgtacgcagcgtaggaattcgcgaattcggtttcgccgccccgctcggcgacccggaccgccgacagcacggtggccttctgcggacactcgtcgcccagcggtgtgcagccgtcgatgtgccagtcgaaggtcgccttcaggtaggccgcggaggcgttcttggacttgtccagcgtgatcgggtagatgccgggcaccgggtggtggccgtcggaggagtgatcgacctcgccgaggcggccgcagaaggcgacctgcgccgccgggtcgagatacaagccgcggaagaccagaaccccgttgtcttccaaggcatccagcaccgcctcacccaccgagtcgtcgtgtgccagggcggccggatccaggccggtgacttcggcgccgaccgagtcggtgagtttggtgatggtgagcagactcatggccgctcctttccgcagcagggttggacggtctcggccgccgggtcagggcaccgggccgccggtccggatcatgaccgcgtcggcggcgtcgaccggggcgggttgatgcatgatctccaccgccatggccaccatgatcagcgagtagatcatgtgcaacaggttgacgacgtcgtcgggcaggctatcgaggggaaacttgtcgcagtagtcgatcgcctcctcgaggcgggggaagaacgcgtcgtagaagtcgcgcagctgcggcatcgacgcgttgaccctggcattccaccgctcggtttcggttggcaggcaccacgtttgggcatagccctccagctcggcgaaggcgctgggcagcatgggcgccatggtcacacccccaccgtttcgcgttcgcggcgatacgcgtcgacccagtccacgaccaccttgtgcagatggcgcaccaggatctcctggtcgttgagtggaaagtcgtcgaccacaccgtattccagcgccgcctgggtcccgccgagcatgccggcgtcctgcagcgcgaactccttgagcaccaccgcggcgacctcgtgctcgatgcgctcccgcacgctgcgcgccgggtggaagtaggtatacgcctcgaaccggtgggtgttgtgcgaggtgggccagtaccggtacagcagataccagccgccgtagatcaggatctccaggttggggaagatctggaaattgctgatgccccactgctcgatcccgcccgggttgagcccggccggcagctcgccgatgtcgggcgtccgccacggccccaccaggccgctgcgggtggcccgctcgatcggatacatgtattccggtggcatcagccagcggcgccgcccggccgtggaaaccagccggtgcggcccgtcgagttggaagtgcccgcaggtgaatacggcgttgctgtcgcgcacctcgggaggcacctgttgggagtgtagggcgggcacgtgatagtactcctggaaggcgtcggcgaagatcttccagttgctgttgttgtgtgccacccagtcgtaccgctcggtcagcttgtcgaacggatagccgtccagcccggtgatcatcgggccgaggaactcgcgcaggctctggcgaggttgggggtcgaagttgatgaagacgaagccgttccacacgtcgcagtgcaccggccgcaacccgtactcggccggatcgaggtcgaagaattccgattcctgctggacgaatttcagcgcacccgtcaggtcgtaccgccaaccgtggtacttgcaggtgaattggcggcaggtgccgcgggtctcttcaccgggaaagtcgttccacaccaatttgtttccgcggtggcggcacacgttgtagaaggcgcggatgcgctcgtccctgcccttcaccacgatcaccgaggtgcgggccgcctcgatctccttggtgaggtagctgcccacccggggcagctcctccacccgggcgacgttgagccaggcccgtttgaagatggcctcccgctcgagttcgtaaaactccggcgacgtcgaatccttgaaagagaccggccccgttcccaattcggggtagtgctcggtccacgagccttccggtggcctacctgatctggtcatcgaatcctcactgtcacatcactgctccgccgttgacacccaagacctggccggtgatgtaccgcgcctcgtcagacgtcaaaaaccccaccgccgcggcgatatccgccccggtgcccaggtagcccagcgggatgttcgccgcgatctgctcgttggagggcaggtaaccgtccgcctggccctgatgctgcatcggcgtctcgatgcccgacggcggaatgttgttgaccgtgatgccgtgcggcgcgtattcgcgggccagcgatttcgtcaacgtgatcaccgcccccttggacgccgcatagtgggcggcgaacggcgacccgcgctgagcactcgacgaggagatcatcacgatccgcccccagttcgccgccaccatgtccggcagcgcgacctgacagcagtgaaacgtcccggtgagattgacatcgatgatccgcgaccaggattcggcggtgatgtccaggaacggcgagaacccgaacatcccggcgctggtcaccaggacggtcaccggccccagctcgctgcgcaccttcgcgaaggcctgctcgacggcggcccggtcggtgacgtcggcgcccaccgccagcgcggtcgcgccgtcggtgcgcaggtcgtcggtgacgcgttgcgccgcatgctcgttgacgtcgagcacggcgattttcatgccgcgccgacccagctcgtggcaggtcgcctcgcccatgcccgacgcgccgccggtcaccaccgccaccctcattcgtagaccacccgcaccgtcgggctggtgggcagcgcctgacaggtcagcacccagccgtcgtcgacctcctccggatcgagcgcgtcgttgttgatcatccgggcactcccctgcgtcaggcgtgccatacacgttccgcacgaaccgatttcgcacgacgagggcgcccgcagccccgccatgcgggcggtctgcagcaacgtgttgcccgcttggtacggggcggtcgtggtggccccgtccaacacgatggtgacctcgccgggctgcacctggccctcggccggcgccgcggcgccgacgtcggtgacgtcgaagtgctcgacgtgcacccgctcggccgcgatgcccgcgtcgcgcagcgcggtgcacaccgcgtccatgaactcattcggcccgcacacatagaagtcggcgtcgcccgcggtcgcgatgaacgccgaaatgtcctcctgcgtggcgaacccgcgttcgtcgtcgagatggtggtgcagcgtgaagcgctcggcatgtcgtcgttgcaggtccgccaggtcctcgtcgaagatcaccgcgtcgcggcttcggttggcgtagaacaaccgcgcgcggcgggtgccggccgtcagtgctgtgcgcagcagcgagaacaccggtgtgatgccgcttccgccggcgaacgcgaccagctgccggtcggtgtcggtcagcacgaaccggccccgcggcggcaaggcgtacaaccggccaccgggtccggcggtgtcggtaccgcccggttcggggtcggtcaccgtcgtcggaccgtcgtgcgtcgcggtgcgctgttcggccatccccgtgagagtatcaactacttgcgattgatctcaagtactagatacagccctggtggcggccggtcagccgtcgacgtgatcggtgaacaactcatggccggtgcccttttcgaccacgcggcccagcagttcgcgcagcgtctgctgctcctgctcggtcagcacgccgaacacctcctgatgcgcggcgatcgcgtcgttgacgacggtttcggcgaccttgcggccctctccggtcaggtaggcctgcaggatgcgcgcgtgctgggggtcctgttttctttccaccagcccgcggcgttccagtgcggtgagcgcgagctggacaccctgcgggctgatcagcaggcggcgcgccagctcggcgccggacaggccgggctcgttggccagctggcgcagcacaccgatctgggcggtgctcacgccgtgttcccgcatcgcctcgttgatggtggtcagcgaatagtagaaagcctgcttgagcaaccacaggatgttgtcggtgagttccatgcctgcctcctgctaggccgcaggggttttgtagatctgtccattcttcatgacgaagcggacgtcaagggtggcggcgatgtcgtcgaacgggttgccgggcaccgcgatgatgtcggcgaggtagccgggcgccagcctgcccagctcgtcgtcggcctcgatcagctcggcggccaccacggtcgccgcccggatcgcctgggcgggggtcatgccccgctgcaccagcgcgcccagttccttggcgttctggccgtgcgggatggccggcgcatcggtgccgcaggcgatccggacgccggcctcgatcgccttgggcagcatggcctttgcccgcgggaacacctcgagcgccttcttgcgcagttccggcgcgatgcggtcgatggccatggcctcggtcaggtaggtggtcgacaccaggaacgtgccgtgatcgaccatcatctggatggtctcgtcgctggccaaaaagccgtgttcgatgcagtcgatgcccgcgcggatgcaggcctggattgcgctgtcccccaccgcatgtgcggccacccggacaccggcccggtgggcctcgtcggcgatcgcggcgaattcggcgtcggagtactgctgcgccccgggcgcggtgctgtgcgacatcaccccgccggaggcggacaccttgatcagcttggcgccgtgccggatctggtaccgcacgcaggcgatcacgtcgggcaccccgttggcgatgccctcggccaccgacagcggcatgatcccgggggccagccgctgaaacaccgtcgggtccagatgcccgccgtacggggtgacggcatggccggccggatagatccggggcccggcgtgccagcccgcgtcgacggcgcgttgcagcgcgacgtcgagcagatatcccccggtcttgaccatcagcccgaggttgcgcacggtggtgaacccggcctccaaggtggtgcgcgcgttgaccgccccgcgcagggtgcggtaggcggggtcgtcctgcacgccgtgcatcggcgacggcagaccctccggcccacccggcccgccgatgagcaggttgagttccatgtccatcaggccgggcagcagcgtggtgtccccgaggtcgacggtggtcgccgaatccggcagcggcccttcgggattcatcgccgagatgcgttcgtcgtcgaccacgatcaccgccggtgcgtggatctttccggtcaccacgtccgcccatcgggccgcccgcagcacggtggtcatggcacgggctcggatacgcagtccagggtcgaggcgcccgaatcggggacgcgaggctgtttccagcactccaccgggaaggacaccatgatcatcgaatagagcaggtgcatcaggttcagcacatcgtcgggcaggtcgtcgagggagaacttgtcgcagaacgccagcgcctcctcggcccgcggggtgatcgcgtcgtagaaggccttcatctccgtcatggagctggccagcctcttggcgtagcgttcgggctcgctgggcaggcaccagtcggcgaacggttcgaggtcggcgaactcggcgggcagcatcgacatcgtgttcacactcccgcggtggacatccggcgatagtcgtcgatccacgccgcggtctccttgtgcaggtgacgcagcaggatctcctggtcgttgagcacgaacttgtcgaccacccgcgattcgagcatggtctgggtggcctccagggtgttggcgtcctgcagcccgtattccttgaacgacaccgccgccagttcctgggccacccgctcgcgcggggtgcgcggcaccgggaagtacagcgtgccctcgaagacgtggctgtgatacgacgtcggccagtagtggtaggtcaggtaccaaccctggccccagaacaggatgacgaagttggggaacagctggaacgaatccaggccccacggatcgcatttcgcggggttgagcccgtcgggcatcggccccagatcgggcttgtcccacggcccgaacagtccgctgcggcagatgtcctcgatcggcttgcgcatctccggcgacatctcccaggcccgcacccccgaggtgctgaccagccggtgcggaccgtccagccggtagtgcggcgcctcgaaaccggcctcggcggcggctttcgagtaggcggtcggcgactggttcgcgtgcagcacgggcgcgtgatagaactcctggaacgcgtccatgtagagcttccagttcgccttgacctccgaccggtaacaccagcgcgacgtcatcttgtcgaacgggtagccctcgagggcggtgatcatcggccccaggaactcccgcagcgactgttccggtgtcttggcgaagttgacgaagacgaaaccctcccacacgtcgcagtgcaccggcaccagcccgtagcggctcttgtccaggtcgaagaactcctcctcctgctgcacgaaggtgaggttgccgtccaggtcgtagcgccaggcatggtatttgcaggtgaactgccggcacacgccccgcgtttcctccagcggcatgtcgttccacaccagcttgttgccccggtgccggcacacgttgtggaacgccttgatctctccggatccgttgcggaccaagatgattgaggtgttgacgaccttcagttcccgggtgaggtagctgcccttgcgtggaagttgttccacccgagccacattgagccaggcccgtttgaagatggcctcacgctccagctcgtacacctcggggttgatcgagtcctcgtaggacaccggcgcggtgcccagctcggggtaatgctgtgtccagctgccctccggcggtttgggaaatcgcgccatgctcgctccttcagcagtacgacctcaccggaaccccgggcgccgcccgcgcgaaacaaccagctgcgcaccggtttcaccggtcccgcggagctccgtcacgggcgacggtatatcctcgacccgtcattagcaagtagttgatattggcccgggaggcgcggatgggccacgacgccggagtgcgaaccgacggacagggccggcgcgccgacgtcatccgcgtcatctcgccacacaccgagcagcccgtcgccgaggtcgatgcggcgacaccctccgacgtcgacgcggcggtggccgcggcgcgagcggcgttcgacgccggaccgtggagccgcggcgggccgtcacaccgcatcgccgcgatccgccggctggccgacatctacgaccggcgccgcgccgagatggccgacaccatcaccgccgagatcggcgccccgatcagcttcgcccggcgtgcccaggtgggcctgcccgccttcatgatccgcgcgttctgcgacctggccgagcgccatccctggcaggagaccaggcccgggttcttcgggagcgacgtctacgtgcgcagggaacccgtcggggtcgtcgcggcgatcgtgccgtggaacatgccgcagttcctcatcgtcaccaaactcatcccggccctgctggccggctgcaccgtcgtgctcaagccggcacccgaaagtcctttggacgcactgcttttagccgagatgatctccgaggccgacctgccgcccggcgcggtcagcgtgctgcccggcgacgccgcgctgggcgcctacctcgccgggcaccgcggggtggacaaggtgtccttcaccggctcgacggctgccgggcgcgccgtcgccgcggcctgcgcggccaacctcaccaaggtcagtctggaactgggcggcaagtccgccgcactggtgctcgacgatgcgccgccggacaaggtggccgccggggtgcgcgcggccagcctgtccaacagcggccagatctgcatgcgctgacccgggtgctggttccccaagcgcgccatgacgattgcgtcgacgcgctcgccgcccagatgagcggcctgcgggtcggcgaccccgccgacccggacaccgacctcggcccgctggtgtcgcgccgccagcagcagcgggtccgcgactacatccggatcggccagcaggagggggcgcggttggtggtcggcggtgcggatatgcccgacgggctcgaccgcggctggtatgtccggcccaccctgttcgccgccgccggcaacgccatgcgcatcgcacgcgaagagatcttcggtccggtcatcaccgtcatcccataccgcgacgacgacgaggcggtggcgatcgccaacgactccgattacggcctggccgggtcggtgtggagtgacgacaccgaccgcgcgctggcgctggccacccggattcacaccggcaccgtcggcgtcaaccagggctacaccatggacccgttcgcgccgttcggcggtgtcaaggccagcggctacggccgcgagctggggcccgaggggctcgacggctacctcgacacgaaatcgatcgcggtcgcggcgagcggctagcgagcctcgctcaccacgtggacggcgacgtaaccgatcgggatgccggtccaggtggcgatgcactcccgggcggccacctcgaccgtggcccggctggcggcgcgggtgaccctgcccaactcggggatccggatcatccatccgtcggcgtcacgagtgacttcgatgtcgaagcactggccgaccatcgggcacttcaggcggggagcgacccgctgtcggcgggcactgcgcagtgcttgtcggcgcagcaatgtgggctgaacaggcatggctgctttcctgagtcgcggacgaaccgccggaaagagtaatgctcttcgcgttgaaaacctaatcggcggtctcgcggtatagtgatgtaagtcacatatcggcgcgctctgttgcaggcgtcacaccggaggagatttcatggttggcgtggatcgctctcgtaaggccgtcatcgccccccgtgccggtgcggctgtcaattcacatcgcgtgctcgtcgccttcctgaccgtcacggtcctgatcagtgcaatcgtgggcgccatcgcggccgcggccatggggcaacccaccgccgcgctgctcatcgcgctggtggccggcgggtggttctcggccgcagtgctctgctagccgtcgtctgactccgtcgcggccgtcgtcgagattgccgtcggactcagtcctcttggtagctccagctgcgcagtcgctccgcgatctcgtccagactggtcaatgcaccggtagcgactccgatcacgaagtcgaagcgctcatcctccggcgcctcaatccagtgcgcattgatggccaggaaagtccggcaggccgtccaagcgagtcgcttgttgccgtccaccagcgcgtgattccgggccagggagtgcagcagtgcggcggccttcacgtgcagatccgggtaggcatcccggccgaacgccgaggcgcgaggccgtgccagagccgattcaagcaagccgtagtccgcgaccacgacattggtcccgacggccgcgcgggcaatgtctagcaagtcttcgaggttcaggaactcggtcacgcgtccttaagacgctccaaaaccccggcctcctcgcggacgacccattgcagcgccgcggcaaccttagtcttgtgcgctcgtcgggcgatgtactcgtcgatggccgataacgcaacagcctgcatcgaccgcccttcggccgtggcctgccggcgcagcgcttctgcctgctgctcgctggggcgcaaggtcattcccatgaggatcgatgataccagagtgataccaccgcgggcgcgcgcaaaatcggcacagacgagtgcgaaaaagctaatgccggaatcaaactgagtggagctaaggggactcgaacccctgacccccacactgccagtgtggtgcgctaccagctgcgccatagccccgagaagtcgtgcccatcgaagctacaccaccggtaaccgtccttcaaagttgctgttcacaccggctcgacgtccgactccgccgccatcagatcggcctccagctccgtcgccgtccgcgtttccggcgccatcacccagccgacggcggcgatcagcaggaccaccccgctgatgaaaaagccccagccgtagccgatctgctcggccgcccagcccaccgccatggacccgacgatggcgcccaggtccgacatcatctgcacggtggccaccggcaggccggcgcgcgcctcgttgccgaggatgtcggcgacggcggcctgcagcggcgacatgtagatcccggtgaccacgccgaccacgccggccgccaccaggaacaccggcagcgacgcgacaaaacccagccagaccgtcgccgccccggacgtcaccagcccgacgatcaacaacgttcgccgccccatccgatccgacaggtagccactgggcaccaccgccagcgcgttgccgccggcgaacgcggcgagcaccacgccgatggtgccgataccccgaccaatgacgtcggagacgaacagcgggacgagtgccatgcgcagcccgaaggccgaccagccggtcgcgaaattggacagcagcgccgaccggtacgcgcgcacccgcagcgcttcgcgcatcgtgaccgtcgatcgcgtcgggggtcgcggtgcggccagcgcggaattgcgcaggccgaggaacagcaccagcgccacacccaacatcgcgacgccgtacacgacgaacggggcggtcaacccccaccccgccgccaggccgccgaccgccggaccgccgaccgcgcccaccatgaacgaggtggtgaacagtcccgcgatccggccacgcgcgtcggcagggctgatgtggatcatcagccccagcgccgagacgtagaacatcgtcgacccgacgccgctgaacacccggtacagcatcaactgccaatacgcctgggaaaaggcgcacgcggcggtggacaccgccacgatcagcaaacccccgatatagattcgccgctcccccaatcgttcggtgagcagcccgctgatcggcgcaaaacacaaccggctcaacgaaaagacggtgaccaggaaagtcaccgccttgatgctcaccccgaagctgcgtgcaaaggtcggcagcgccggcgagatgaccccgtagcccaaggcgaccatgacgttcgcccagctcaggatccagacttcgcgcggcagcggaccaggacgcggcgcacgctcccccaagcgcgcaggacggagggaaaaagtcacccgatgactttattaaccacctcgcgcgcggtttcctgcacctcggccaaatgctgcggcccgtggaaggattcggcataaatcttgtagacgtcctcggtgccggacggccgcgcggcaaaccaggcattggccgtcgtcaccttcaatccacccagcggggcgtcattgcccggcgccgcggtcagcttcgcggtgatcggctccccggccaactcggtcgcggtcacctgctcggcggagagcttcgacaaccgggccttctggtcgcggtcggcgggcgcgtcgacccgcgcgtagcacggcgtcccgtactgcgcggtgagccgctgataacgctgggacggactcgatccggtgaccgccaggatctccgaggccagcaaggccaggatgatgccgtccttgtcggtggtccacaccgagccgtcgcgccgcaggaacgacgccccggccgactcctcgccgccgaatccgagggtgccgccgatcagtccgtcgacgaaccacttgaagccgacgggcacttcgatcagcttgcggccgaggccggccaccacccggtcgatcatcgacgagctcaccgcggtcttgccgacggcgatgccgcccggccaggacggccgctgggtgtagaggtattcgatggccacggccaggtagtggttcgggttcagcaggcccccgtcgggggtgacgatgccgtgccggtcggagtcggcgtcgttgccggtggcgatctggaagcggccgggctcggcggtcaccgtccggatcaggcccgccatcgcatccggcgagctgcagtccatccggatcttgccgtcgtggtcgagcgtcatgaaccgccacgtcgcgtcgaccagcggattgaccacggtcaggtccaggttgtgccgctcggcgatctcgccccagtagtccacgctcgccccgcccagcgggtcggcgccgatccgcacgccggccgaccggatggcgtcgatgtcgaccacgttgggcaggtcgtccacgtagttgccgaggtagtcgtggcgttgcgcggcccgccgggcccgggccagcggcacccgcttgacgccggcgccgtcgcgcagaatctcgttggcgcgcttggcaattgcgttggtgacgtccgagtcggcgggcccgccgttgggcgggttgtatttgaagccgccatccgagggcggattgtgcgagggcgtgacgacgatgccgtcggccagcgcctcggtgcggccgcggttgtagctcaggatggcgtggctgaccgccggggtgggcgtatagcggtcgcgggagtcgatcatgacgacgacgtcgttcgcggccagcacctccagcgccgatacccaggccggctccgacaggccgtgcgtgtcccggccgatgaacaacgggccggaaatgccgtgcgcggcgcggtactcgacgatggcctgggtgatcgccaggatgtgcgcctcgttgaacgccccggccagcgccgaacctcgatgacccgacgtgccgaacgccacctgctgggcgacgtcgccgggatcgggctgaatcgagtaataggccgtcaccaggtggggcaggtcgacaaggtcttcgggttgggccggctgaccggcgcgagagttggccaccatgatttccaattctgcccgtctccgtgtcgccccggcggcgccggtgttgcaagcccccatacgctgcatagcgcagcggcgaacgaagggaattcacgccagtggcgcaacacgactaccgcgagttggccgcggtgttcgccggcggggcgctgggttcgctggcccgcgccgcgctgagcgcgctggcggcgggcgacccggcgagctggccgtggccgacgttcacggtcaacatcgtcggcgccttcctggtgggttacttcaccacccggctgctggagcgattgccgacgtcgagctaccggcgcccgctgctgggcaccggattctgtggcggactcaccacgttctccacgatgcaggtcgagacgctgaccatgcttgaacaccaccactggggcctggcggccggctacaccctgaccagcatcgcggccgggttgttggccgtgcacctggccaccaaactggtgcgccgggtccgggtgcgccgatgacgacggtcgcggtctgggtcggcgtcgcgctcatcggcggcgtcggatcggtgctgcgattcgtcgtcgacggtgcggtggcgcgccgggcgtcgcggccgtttccgctcggcaccctcgtcgtgaacctcagcggcgcagcgcttctcggcttcctgggcggcctggcgctgagcagggaggcggcgctgttggccggcaccgcgttcgtcggcgcctacaccaccttttcgacctggatgctggagacacagcgcctgggcgaggagcgtcagctgcgcgcggcgctggccaacatcgtggtcagcgtcgtgctcggtggggcggcggcgttcatcggacagcagctggcccagttggtgtgagcgcgcgccgtcaggcgtcgcggcgccggggcacgtcgtcgggggtccgtggcagcacgtagagcgccatgcgccggttcgccatgtcatgctcgccgagaaacgtgcacccgctgcgttcacagaacttgcgcgccaacacattacggtggtcgggatcgaacatgatccgccggcagcgcggatcgagcgaaaacaggctgaccaccagatgcggcagcagatagctgacgtggccgcgctcgatgtggtccagatccgccaccgcgacgtgcaaccccagatcatgcgggtggtgctcatatcgagtggcgatggaatcctttgccgcccggtacaattcgagatacgcgcggtctaccccgtccagcgtggcgatcagcgggcgagagaactccccgtccagctgggcccgcagataacgccgccaccgggccagcggccagttggactcccaggcctgcaccagatgcgggcggctcatccactcgcacaccgtctccgcgtcggcatcggggtcgacgacccgcaacccgtagggctgcggcaatgccggaacgggcggcgccgggacaccgcgaatctcctcgggaacattggtcaactcccgcggcagaatgggctcgacgccgctcatccgcccgaccgttgcccgcgctcagccgcttttcagcagctcggccagcacgaccgcctggctgatgtccaggtcgcgagtcgcggtgaccagggtgaccgagccgcgcttggcgagcgtgcgcagctcgtcgagcgccgggttgccccgcagttcgctcttgtatcgcgacgtgaattcgtcgaaccgctccggctcgtggtggtaccactcgcgcagctgcttggacggcgcgacgtccttgcaccagatgcccacccgcggatcgtccttgcgcacgccgcgcggccagatccgatcgaccagcacgcgctgtccctcgtcgggaccgaccttgtcatagacccgcgccacctggatccgcctgccggcgctcacccatccaggctagcgacgggcgggcgtcagcggaacctgctatgatcgaacatgtgttcgaatcactgatggcggtcgacccggcggccggcgaatcggcgctgatagagcgcatctcggagttggagatgctcaagtgcgccgccgccgcggcccaggcccgggcggcggccgccctggacgcggcgcgccgagcggccgaagcggccgccggggtgcccgccgcgcgccgcggacgcggggtggccagcgaggtcgcgctggcgcggcgggattcgccggcgcgcggcggtcggcatctgggcttcgccaaggccctggtgcacgaaatgccgcacacgctggcggcgctggagtgcggggcgctctccgaatggcgggccacactgatcgtgcgcgagagcgcctgcctggacgccgaggaccgtcgcgccctggatgcggagctgtgcgccgacccggcgggcctgagcggcatgggcgacgcgcggggtggccgcggccgccaaggcgatcgcctaccggctcgatccgcatgccgtcgtggagcgggcggccaaggcggagaacgaccgcacggtcaccatccggcccgcgcccgacacgatgacgtacctgaccgcgttattgcccgtggcccaaggtgtttcggtgtatgccgcgctgcgccgcgaggccgacacccgcggcgacgggcgcccgcgcggacaggtcatggccgacaccctggtggaaagggtcaccggccgccgcgcgacggtgcccaccccggtcgcggtcaacctggtgctgtccgacgaaacgctgctcggcggtgcggatgcgccgggcgagatcagtggctacggcccgattcccgcggcggtcgcccgccgcatggtcgccaacgcggccgccgacccgaggtcgcgggccaccctgcgccggctctacgcgcacccgcgggccggggcgctggtggccatggagtcgcgggcgcgcctgttcccgcaggggctggcgcggttcatcgggctacgcgatcagcgctgccgcaccccgtactgcgacgcgccgatccggcaccgcgaccacgcacagccgtgggccgacggcggcgcgaccagcgcgggcaacggcctggggctgtgcgagcactgcaactacgtcaaggaaacgcccggctggacggtgagcgccggcgttgacgaaacccacacccacacagcgcttttcacgacgcccaccggccagacctaccggtcgacggccccgccgcgggctcccgcgatcacgatgagcacggtcgaagtccgcgtcaccgtcgcgttcgcacgacatgccgcctgacgcctcagtagtggtaggtgtccgacggcgcgggtgagtggtcgcgttcttcctcgtcgatgtccagcgcctcgatgccgtacgcgcgagccagctcgaggatcttggtggcccgggcgatgcggggcaggtcggaaccgttgcggatctctcccccgtcacgctcgaactcggcgaaaaactctttcgcccaagctatttcgtcctgcgacggcgacaggccctcgttgacgacggaacattggtccggggtcaggcagatcttgccggtcatcccgaattgggtggacaccgcggtggcctcgatcagcttcagcggattggagccgatggtcggcccgtcgatcgcactgggcaggtcggcggccttggaggcaatggtgaagcgggaacgggtgtaggccagcgtggccgggtcctccccgaaaccggtgtcgcggcggaagtcaccgatgccgaaggcgagccggaaggtgcccttggtggcggcgatctcggtgatgcgctccaggccccgggccgtttcgaccagggcgacgatcggcacgtcgggcagccgcttcgccgtctcggtgacgtgatcgaccgattcgaccatcgccagcatgaccccgccgactggtgtgccggccagggcggtcaggtcgtccgcccaccagggcgtgccgaaaccgttgatgcgcacccagtcgacgttgccggcgcgcagccagctcaccacgttgtcgcgggcggcgttcttgtccttgggcgcgacggcgtcctcgatgtcgaagaccacgatgtcagcgcgggagttcaccgcggactggaaccggtcgggatgcgtgccgttgaccagtagccaactccgggccaggaccgggtcgatgcgggagccgatgtcgtcgggctcggcggcgctgctgttgacctgttcgtacatttcggctgatctgtcgtctctgtgtgttccggacgggcgtgttgtccctaaccgtagcgagtatcccggacccgtggtttcggttaccccgcccagtcgccactcgaggtcacttatggcagcgcaccacgagccgccaagaccgccgccaaggatgaaaccggctgtgcaccaacgcaatacgcgccaccgtttagcgactcggccggcgggtatgcctgggccagccgcacgcagcccggacgtgcgcatcccactctgccgacacaggaggtatcggcgatggccgacatgattgtcaaatcgcccgacgaagtcgtcgcgttcctgaaagcacagcacaacctcatcgaggacatgttcgaccaggtgctgcacgcgaccgaccccaaagcgcgcgaagagcccttcgcgacgctgcgccaattgctggcggtgcatgaaaccgccgaggaaatgctcgtgcatccgccggcacgcaaggaggccgatgccggcgacgcggtcgtcgacgcccgcttgcacgaagagcacagcgccaaggaactgctgtcggcgatcgaaaagctggacagcaccacggaccagttcctcgacgaggtgacgaagttgcgagaagccgtgctcgaacacgccacccgggaggaaaacgaggaattcccggccctgcagcgcctcgacagcgacgacctcaagcggatgggcaccgcggtgcgcgccgccgaggccatcgccccgacccacccggatcccggtgtggaatcggcgacgctgaatttcgcggtcggcccgttcgcctcgatgctcgatcgcgcccgcgacctgatcggccgggccatcggttagcccggggccggcccgagtttccgtaccctcggtgagatgagcgtcgcaccggagaccaccgtcgccctgcaggaccggtttttccgcgaattaccggaactggcggtccgctggcaggccgagaccttccccgagctgcggctgctggtgctcaacgaacccctggccacccagcttggcctcgacaccggctggttgcgcggtcccgacgggctgcggttcctgaccggaaacctggtgcccaccggcgccgccccggtcgcccaggcctactccgggcatcagttcggcggcttcgtcccccggctcggcgacgggcgcgccctgctgctcggtgagctggtcgacaacaagggtcggctgcgtgacatccacctcaagggatccggtgcgacgccgttcgcccggggtggcgacgggctggccgcggtgggcccgatgctgcgcgaatacgtcgtcagcgaggcgatgcacgcgctgggcgtgccgaccacccgatcgctggccgtggtcggcaccgggcgcccggtgtaccgggaggccacgctgccgggcgcggttctggcccgagtggccagcagtcacctgcgggtgggcagcttccaatacgccgccgcgaccggcaacagggacctgctgcgccggctggccgaccacgcgatcgcccgccaccatcccggcgccgcggacgccgagcagccctacctggccctgttcgaagccgtcgtcgcggcccaggcgtcgctgatcgcccagtggatgctgatcgggttcgtgcacggcgtgatgaacaccgacaacatgaccatctccggggaaacgatcgactacgggccgtgcgcgttcatggaggcctacgaccccgacacggtgttcagctccatcgatttctggggccgctacgcctacggcaaccagccggtcatcgccggatggaacctcgcccgcttcgccgagaccctgctgccgctgttctcggagaacaccgaggaggcgatcgcgctcgccgagcggtcgttcggcgtcttccagacccgttatgacgcggtgtgggccaccgggatgcgggccaaactcggcctgcccgcgcaggtcgacgccgaattcgcggcggcgttgatcgacgaactgctggccctgctcaaggccaaccacgtcgactacacgtccttcttccgccagctcggccgggcggcgcgcggcgacgacaggtcggccgccgaaccggcccgcgaaatgttcatggacctgcccggcttcgacgcgtggttggcgcgctggcgggcgctgggtcccgacgccgacgcgatggatcgcgtcaacccgatctacattccgcgcaaccatctggtcgaggaggcgctcgccgcggcgaccgacggcgacctcgacccgctcgaccaactgctcgccgcggtgacggcgccctacaccgaacgcccgggcttcgagcgctacgccagccccgcccccgaggacttcgggaagtaccaaaccttctgcggcacttgaggttacgttagccggttgcttcggccacgacccgggctggccggcgcttggccgggcgtaccgcgccccacaacccggtggcgatcccgacggcggccccgcccaggccgatgatcttctgcgacgcctgcagctggtcgtgcacgctcagcccgccgaccaggtcggacacgtccgcgccggcggaggccaggaaccagccgcgggtgttcttgccgcgcagcgccgacccggcgagcagcgcaccgatcaacgcgtcgcgataacccatggaccgcaacaacagtcgcgcggtgggcgtcggctcctcgggatcgccccacaacttgttggcgcgcagcggatcgacgaggaaggagacgccggaggccagccggatggtgcccgcaaggaggccgaatcggtcgatggacatggtgtgtcagcctaggagcaaacggtgccgtcgcgcacgtgttcggagcgaaagtcggctacggcgtacggcacgcgtcggcgatttgcagcgacgccggccacaacgccgtggccaccccgaaggccgcgacatcggcgccggccggccacaccgcctcgatccgcgcctggattcggtgggtctgatcggcgtgaaaaacggtccacgcgaagccgatacacaggtaggggatcgccagccacaccgccaactcgatgagcgcgccgacgctgatctggtgtcgcagcacgcgccgcacggggtccatcgcattgtcgatccgcgccatgaccgcactccccgctaccgcagcaccagcttcgaagcgtaatcgacgacggcgtcgagatcaccgcccaaatgaccggccagccactgctgggcaagctcggccatggcgccggtgtacatggccgcggccacctcggcggccaccggatcggagcgcggattcagacgccagccctcgctcagcaccccctggcgcaacatgtcctgggtggcgcggcgccgggctgccagcaccgggttggtgcgggcatcggtgaacagcacccggccgcggcgcggatcggccgaggagaagcccagcaccgccgcgatgccggcccgggtccgggcgcgcagcgaatccccggcctgctcgatggcggccgcgatcacttcttcgagttgctcgctgacccggtcgtagaccgcgccgagcaggtcgtcggtatcgcggaagctctcgtagaagtaccgggtgttcaaaccgcactcccggcacaccgagcgcaccgagacggccgcctctcccccgctgccgaacagccgatacgcggcctcgaccagcagcgcacgtcgctcggcgcggcggtccttgagcggtacaccggcccaccggctggggctggacatccctacagcctaagtcgacatcgccccggtcttgtcacacctgtaaccagaaacatattctggtcacggccgtgaccaaagtttgagggagtgcgctgtgttcctgccacaccagatcatcgggcagctgatcaacaagcagttggacgacaacatgcggcggtatttcttccgcggcatggagttcgcggcgcccgtcggcgatccgggctggttcggtccggacagcgccgtgtggcgggtgcattcgcacctgccggccttgatcttcggcctgcagtgtgcggccttcatggaaaccctcgacccgtcgatctactggatgggcatgcatcactcgcgactgatcaagcgggacagcaatggcaacccggtgtcccacgtgccggtcatcgatcccgagggtgcggcgacccggctgggccactcggtggcgttcttcatcggcaccgcctacgggtcgcccgaaaccgccgaacggctggcgaaatccgtgcgggcgatgcaccacaccatcaagggcactcgcccggacggggcccgctacgacgccgacgatcccgaatggctgcgctggaactacgcgacggtcgtctggggcatcgccaccgcgcacgagctgtatcacccaatgccgttgcgcggcaaggcactcgaccgctattacggcgagttcgtccgcgtcgggcacgcgctgggaggcaccgatctgcccgccaccaaggccgagacactcgagtgcctggaatcctacttgccgaaactggctgtcacgcatggcaaagcgatgggcacgggccccaacgtggccatgccgcaggccgccgtcgactgggccatccgcgacaccatgccgaaatgggccaagcagatgttgcagcaccgcgactgcaacatcatcgagcgcaccgcccgtcgcagtgcggtgtgggcgatcatcaacggcatccatgccgcgtcgggcccggccccggagttccggcaggctcaagcccgggtcaggggtggcaccaccgtcccgcacacggtgccgagctacgtgctgggcaccgaccaggtgcgcagccgcgccgaggtcgagcgcagcttccaatcggtgtgagcgccggtagctagcccggcccgacccgctgccccagatgctggggacagtaggcactggccgcgatcatggtgaactgagcggcgccgtccaccgtgaaccccggattgctcgacgacacgttcttgatgacctcgacctgagggctgccctggtccatcagctcgcacgcccgtttgcccacttcaatggcggtcgccgggttctggtaggtgatgccggcctggttgagcgcggccaggaagctggcgtcggatcccgtggtgccggccggatcggcgtgcgccggcgcggccatcccggccagcgcggcgaagccggcgagcagcgcaagcattcgcatcgcttcatcctcgtacagacgggccgccgacgcatcccggcccccggctcgggtgtggtacacagtcgtatgcccgcgctgctgacccccggccagacgtgctggcgcacggcgcgcgccgatcggttcgccgccatcatcgacgcggccgactacttccggcacgtcaaggcggcgatgctgcgcgcccgccatcgaatcatgctggtcggctgggacttcgactcccgcgtgaccttcgaacgcggcgacaagacactgcccggcccaaaccagttgggcgccttccttttctggatggtgcgcaaacgcccggccctgcagatccacctgctgaagtccaacctgcgcctgcttccggcacttgacggcctgtggttcgggctcaccccggtgtcgctgctgaaccagatcagcagcaggcgaatgcacttcgccatcgacggcgcccacccggtcggctcggtgcatcatcagaagatcgtcgtcgtcgacgacgcggtggcgttctgcggcggtatcgatctgaccctcgaccggtgggacacccgcgcgcacgagcacaccagccggcgccgccgcacagccgggcgcggctacgggccgcggcacgacgtcggggtggcggtcgacggcgcggcggcacgggccctcggcgagcaagcccgcacccggtggcagaccgccaccaagcaatcgctgtcaccggtcaccgccaaacacagcgcgtggcccagcaagctgcggccgaccctgcgcaacgtcgacgtcggaatcgcgctcacgctgccggatctcgacgatcggcccgaggtgcgccaggtcgaggcgctcaacctggccgccatcgcggcagcccgcgacaccatctatgtggaaaaccaatacctggcgtcgcgaaccattgcccaggcactggcgcagcggctgcgcgaggaacacggcccgcagatcgtcatcgtgctcgcgcgcaaaggcaacaacccgctggaacgcggaaccatggacagcgcgcgccaccgcctgatccgactgctgtgggacgccgacgagcaccatcgcctcggtgtctactggccggtgaccgacggcggtgcgccgatctacatccactcgaaggtgctggcggtcgacgatcggctgttgcgcatcggctcgtcgaatttcaacaaccggtcgatggggttcgacagcgaatgcgacgtggccatcgaggcgcgcggctcgcagcacgacgacgtgcggcgcgaaatcacctcggtgcgaaacgaattggtggccgagcatctcggtgtaccggtcgccaccctgcaagaggcgatcgccgatcgcgggtcgctgctggccgcggtcgaggaacttcgcggcgacggcaagacattgcggccgttcaccgagcgcaccgtggccaacgaggccggcccgctggccgaaaacgagctgatggaccccgaccacgttccccggtcgctgacgcgcagcgtgcagcggctcatcaccggccggcggggctgacccgcggcgattcgggtgggggtcgggccgaacccggcctactgtggacagcagcgccggcggactaaggacgagcaacatgagcatcgacgacgaatccgtgaccacgctggaggacctcaggggcgatctggcgcaacggtacaagcggacgccgaccggcgggagttcggtggacagcgcgatcgtcggggccgatatggccgcactcgaccgcgacggctacgtcatctgggagaacctgctcagcaccgagcagtgcgcgcagattcgcgagaccgtgcggccctggctcgggcacaccgggcgcaactcgttcgagggccggcgcacccagcgcgtctacagcgtgctgagccgcacccgaatgtgtgatcggctggtcgaccatccccgggtgctcgcggtgctcgaccggttgctgatgcccaactatctgctttcggcgttgcaggccatcaacattcagcccggcgaggccgcgcagctggcgcaccacgacgacggcttctacccggttccgcggccgcgggccccgctggcggcggccaccatctgggcgatcgacgacttcaccgccgacaacggcgccaccgtgctctacccgggcagccaccgctggggcaagcgccggccgggcccggacgacgaggcgatacccgtcgtgatgcccgcgggttcgtgcgtcttgttcgtcgggacgttgtggcacggcggcggcgccaacaccaccgaccgcgatcgcctcgccgtcaccgcccagtactgccaaccgtggctgcggccgatggaggccttcaccctgtcggtgccgcgggacatcgcacggacggtctccgatgacattcgccgcatgctgggctacagcatccacccgccgttcgtcggcgcggtcgacggcctgcatccattgcggctgcttgaaatggagccggacgcatagcttttgggtcttcagcgctacggcggggcggcgccgtaaaggtgtagggcccgggcggcggcggtggccacgtcaccgcgcagattcgagatcggcgggctgccccgcaggtggatcgagttggacagcaggatcacgtaggtgtccgagcccgggtccatccacagcgtggttccggtgaatccggtgttgccgaagctgccgatgggaaagacgcgtccccgcggcctggagtagccggtgtcgatgtcccagccgaacccgaacaggttctgccccttgatcgccggatagttcggcgtgcctgaccgggcggcacggttggccgcttccagttgtcgggggtcatggcccggttgctgcggggtcgtcatcagctcgacagtgccctgctgcagtggaaagtcactcgggcgcccggccagccgatccagcagggcctgcgcatagacgccgacgtcgtgcgccgtggagaacacgccggcgttgccggccacgccgcccatccggcgggccgtcgggtcgtgcaccgtaccccgcagcagggcatagtaatccgggttcttgctcgggtcgtccctgctttcctcgtcacgtgcagtcggcgcgatgcgcggcaaaagtgttgtgcgccaagtccattcggggcactccgtcgtcggctcgccgttcggcgcccaggcgatcgcggctccccggatgatatgcgggccgcacgccttggccggcggaagataccgggtgtcgtgcatgtcgagcggcccgaacacgtggtgctgcacgtagtcgtcctcgtcctcgccggtgatcttctcgagcagcgcgccgagcagcaggtaattgatgtcggagtagcggaactccccggcgggtgccgactgcagcggcgtggtgagcgcgcgatggatgccctctgccttgtcgggtccggccagccctcacggatcccgcaggctgacgtcgatgccctctcccgacgtgttcgtcagcagcatgcgaatcgtcaccttcgtgcgctggggatcgttcgtggtgttgaagtcgggcagatacttctgcacgggatcgtcgaacgcgaccttgccctgttcgtaaagctgcatcaccgccaccgcggtggccaggcacttggtcagcgacgccaggtcgaagatcgtgtcctcggtcatcggctccgcgggtgcgggcgccccgtccagcccgggttcgccggcgagcttgcgcgaaccgtacgcctggtggaagaccaccttgccaccgtggccgaccatcaccacggcgcccggcagcccccgcgcggcgatcgcgtcgttcaccagcttggagatggttgtgaaatcttctgcgggagaagtcgattcgggaaccagcgacgcatgtggcgtcatcgacgccggcggggcctcgctcggcgaggtatgcaccacacggccggtcgaggaagccgccaccagggtgagcaagatggttgccaggacgaggacatttcgcaccgatgggtgaccgggcatgaggcaagcgtaggtcgcggtgggcgcggcagcacagggcggaaacaagcgcgcgggcgcaccgtcgctgctgcccggcgggcgctgggcggcggtgctggcgggcgcggtcatgctggcgcagtgcaccgcgtcgtcggccgccgccgacccgacggtccggccggtgaccgccgccgaactgggcgcgagctggcacccgggctgcccggtggaacccgggcaactgcgacgggtcgacgtcgaccacatcggtttcgacggccaaacccaccggggcgagctgatcgtgcaccaagacctggcgccgcaggtggtcacgatcttcgctcggctgtaccggctgggctttcccatcgagaagatccgcacggtcgatcactaccgcgacgccgacgacgagctgtccatggaggacgacaacacctcggcgttcaactgccggggcattccgggcagcgaccgctggtcggagcatgcctacggccgggcgatcgacctcaacccgcgtctcaacccgtgcctgtaccccaccggcgccttccaaccgcagaacgcccggggactttctggaccgcgaccgcaccgacccgggcctgctgcacgacggcgacccggccgtgcgcgccttcaccgacagcgggtggcgctggggtggacagtggacggcgcccgtcgactaccagcatttcgagcggccctgaagcagcctcggtagcctgggttcgatatgtcgcgctccattgacgtctcgaccgagtcgcccgccagcgtcgagcagatccacgcggcgttcggtcgcgaggactattggctggcacggatcgctcccgccgccaccaccacgttggactcgctggtggtcgacggcgacggcacggtgacggtgcgcgtcacccagcacctcggtcgtcagttgttgccgggcgcggtggccaaattcgttcgcggtgacgtcaagatcgtgcagaccgagacgtggcgacgggacggtgacggccaggtgcgcggccaggtcgacgtctcggcgtccggcggattggggtcgggtcgcgcggaaagctggctggagccggccgaagacgggggctcgcgattgcgttccgccgtgcgcgtcgaggtcaaaatccctttggtgggccgcaaactcgagaagaccatcggcgccgatctggccaagggcattcccgagatgctgcgcttcaccaccacctggatcgacgagaacgcatgacgccccggcaatgagatttgcgctcgcgaccatgggaacccgcggggatgtcgagccgttcgccacgatcggccgggagctgcagcgccggggtcacgagatacggatggcggtgccgcccaactacattcgcttcgtcgagtcggcggggctttccgcggttccccacggcccggaccaggtcaagcagaacgaggacatcgtccgcaaatacggcactgcgccgaacccgatgtttctggcgtgggtgatttcggaggatctcaagcggctctggccctcgttgggcaccgcgctgatgtcgctggccgacggggccgacttgctgttgactgacacgagcgagcacggcctggccgccaatgtcgctgagtactacgacattccggcggccacactgcactattaccccagcggtggggccgcgcagttgacccaggaagccgaatccgcccagcgccgggcgctgggcctgtcggggccgaccgcaccggcggcgcgacggccgatggagctgcaggcatacgacgaattcttctttcccgggctggcggccgaatgggcccaatgcggggtccgacgccctttcgtcggtgcgctgacgctggagttgccgaccgaggccgacgacgaggtgctgtcctggatcgctgcggggacgccgccgatctacttcggcttcggcagcagcgcgcgggtcgcatcgccaggtgatgtgatcgcaatgatcaccaccgcgtgcgccgagctgggcgagcgggcgctgatttgcagcggcgtcagcgatctcacccagatccggaccggcgaccacgtcaaggcggtgagcgcggtgaaccactccaccgtgtttcccgcgtgccgcgcggtcgtccaccacggcggtcccggcaccacgttcgcggggatccgggcgggagtgcccagcctggtgctcgccgtctcggtcgaccaaccgctgtgggccgcggtgatcaatcagctggaagtcggcatcggacggcatttctcggagacgaccccggattcgctggtggcggatctgcggtcggtcctcgatccccgttacgtcacccgtacccgtgcggtggccgcgcggatgagaacacccgccgaaagcgcgtcggcagcggccgatgtcttggaagacgcagcgcgccaaggttcttgcggctgaccgctcagcgatcgagggggcgaagctgcgcctcggagatgctccgataggaggggaactcgaagtcggggaaggcgcagatgtcaccgcgaccacggacctgttccaaccagtaatgctggtcggcgggcgacgcgcaggcgtagagcttcatgtacgtcgccgcgaacgggaacaagacaccgttgccgacagcctgccagacggccgcggcgacgccgggggtttcgacgccccggtaatcgtccagcacgaccacgccccggtcggccgtgtgtctcacagccagctcgatgtcatgggcgacgcacgggtaggcgtgacagccgtcgatgtgggccaggcgcacggcgcgatctgccaggtcgagctgcgatgattcgcagacctcaatcatcggccggcgagtgtggaagcggtcccagttggccaggaactgctgttggtccaaccccgagtattggtcgcgtgagctcggcgacccgtgggtgtggtccaccaccgcttcgaacaaatcgcagatcaccagttcttcgtcgtcgcggagaccgtagcccatcaggatggccgacttgccttggtaggtgccgatttccagcatgtcgccgctgatcccctcggccgtctggcgagcgagcagatgactgaagagctcgacgtcggcctcgaagaaccagccgtcgaccttgtccaccttctcggcataggcggtccacaggggatccgtcatgacccgctcctgcgcatgaactcctccgcggcgatcggcaggccgagcatatcgatatcgactcgccggccgacccgcggtgcgaagtggtgcgtgaggacaccgtgtgcggtgcgcagccgcttccggatgagacgcgctgtcgcgaagcacctgccgacggatccgtcatggcgaatcagccaggccggcaacgtgattcgaggagctcagatatttggtccacccattcctaagacgccatcgtgcgcgacgggaaagtatttttggatgcgatctcggacggactcaagccactgatgcgttgtcggaaaatcgaccgttcggctgtcgctcatgatttcgtcaagcgaaacaccttgcctaatggcaaaacggggaagatattgccacttcccggaacgatcgtacaaaccgatcacattcgcagcatccaatggcgcgatctttccgtccatgcacatccacgtcgccgcacgcgtctagctggaacccaagctggatcaacagaagttccacaacggaaggaccccactcagaaactcttctctcattttcgtccatcggtcgcacgtacccaacttgctggtagcgagtgtcagaggggttcaccaatgtcggggagcaaggaaatatcttctggctgaccatatctgcgaaataactccgccgtctcccggacatttctttttgcccattcgctattcaaggcgcttagcacctggtactcgtatttgaagcgttccgcgcgatcacccaccgatttggccgcttggcccgtcaccacgctctgggtgtaccagtacagcaggtcgtcgagattgcccacgcggtcgaagccaagttgtccgcgttcgtagaaggtgaagtgataagaaccatcattggcgacataaacgttcaggccgtcgttggttcgcaagccgacgagcataggacggacgcctagcttttctgatagctggtcgatctcagtttgaagttgcgcagatctatcgtccaaggcgcggtccgtatctcgcgtaagtttcaccagcctcagtgtcccggaaaccgacggcccgcgaaccaccatggacggtgcccttgatgcacgcgtcggcgggcgcagtgttcaagcggtggagctgccgggaatcgaacccgggtcctacggcattccctcaaggcttctccgtgcgcagttcgctatgcctctactcggatctcctggtcacgcgaacaagccaggatgacgatcccagtcgctgttggtgtcccgatgagtcccgcgaccgaactcatcggtggatccctctagctgacgccaggctccgggtcgagggcgttcccgggctgacggactagctgtcgcttaggcagcgagagcgtagtcgcgctgatgtgaatcggcgcttatctatttgcaacgacgcttacggtggtcagttgcctgcaccggcacgcttcccttgattcgatgcgcgaagtcgaaacctttcagcccctcgcatccccgccgactttcggcaggactatcaatggtacatggctatcaaccagcggcaacggcattatgttccccgccgggcggcgatcagatcacgaaattgaggcgcgccacgacatggctggccaggcctttgtctccgccgagttcgacggtttggtcgcgcgcggggcacatcgggcgcccgccggcgagccgggtgaactgcagcccgtcgcaccggatcgtcgcggtcgcctgctcgccggcgaaatcgtcgaccaccgtggcgcggccgtcgacgctgacccggataacgcgggccagcggaccggtgagctcgaactccacgcgggcgccctgcggggccttggccagcttgcccacgacgtaacccatggtggcggcgatctcgtcgacggccagcgacgccgccgggccggcgagatccgcgtccgagggcggccgccccaacgccacgcggatgtcctgctcgtgcatccagcagtcgaacacccggatccgcatgaaccggccgtggctgtccgggctggtgggcgtcatcgtcaccgcgtcccactcctcgtcggacatgctcgtcaaggccgcgcgccgatcatcggtgatcgcgcggaaactttccagcacgtcggcgtcggcgtgcgcgctcagatgacgcacccagcactcgttcatcgcgccgatgtcgttgcgcacatgctccagcgccgagacgtcgacgtcgggttcgggtgcggcgatgccggcgaggaaggactcggtgccgatcatgtgcgacaccacggccttgacgtcccagcccggcagcggactcggcgcgcgccattgggtctcggacaagccggccaacagcgcatcgatgtcgtcccagacggcgaaaaggccggccagcacggcggacttgtcgaccttggtgacgagacgatcggccatggtcaccgatcgtaggccgcgggactcgccgccgacaccggccgtcgggccgacgcgttagaccgacaccaaccgtcaggccgacgcgatcatcgccaccgaccccatggccagcaccatgccgatgccctgccagcgggtcacccgctcacgcagcaccaccatcgccaacaccaccgtcgcggcgggatacaacgagatcaggatgctggccaaggacagcagccaggtgtgcagcgcggccagcatggtgatgttggcgaagatgtccagcacggccaccgccaccgccaaccgcaacggccggccgcgcggcatcttcaggttctggctcgttccggccatcgcgaacaccaccaggctggcggccacccgtgcgaagaccagcggccagagtttgcaggcgtgcggcgcctgatgcaggaacaccaggttcaggcccatcgccgaacccgcaactactgtgagccaggccacttttggggtgaaccgatacggcgtcccctcggcgggggcctcgcggctgaccagcatcaccgcggccagcgccagcacgacgcccaccagggccgcctggcccggccgctcccccaacgccatcccgaccgcgacgggcaccgcggcgttgagcaccgccgccagcggtgagaccaccgagatcggcccggatcccagcgcggcgaagaacgcccacatgccgaacgccatgccgatgccatacaggccaccccacagcagggcaccgggatgaatgggcccgccgacgaagatggccagcgcgcccagcagcaacgtctcgatcgggtaggcgaccagcatcacgcgcagcgcggctacccgccgagctgcgacgccgcccacgaaatcgctgacgccgtacgtgacggccgacagctgggcgtaagcggccccgatcagatcatcccctttgttcggcgtcccagttgacgaacgacttcgcgctgtgcgtcgcgctgggccaggtcctggcgtttgtcgtaagccttcttgccgcgcgcgagagcgagctctaccttcactttgccctcggagaagtacagcgacagcggcatcaaggcgaggttaccatcccggatcttgccgaccagtctgtcgatttgttgcctatgtaacaacaactttcggttccggcgtgggtcgtgattggtccagctaccgtgttgatactccgggatgtacaagttgcgcaaccagacttcaccgtcgtcgatcgttgcgaacgcgtcagctaacgacgcttggccctcccgcaggcttttgacctcggttccttgcaacgccaccccggcctcgtacgtttcgatgatcgaatagttgtgccgcgctttgcgattggtggcaatgatctgtttgctgccacctttgccgcccgccgctttggcccggccggaacccttggccacagctaccgccggatgtagaggcgcagggtggcgtaggcggtcaggccggcgatcgacacgccgagcacgaacagccacggcgagatgtagaggatgtcggcatagtcgaccttggcgatcaaatgtgcttggtagaactggctcagcgcgttgtccaggaaccaggcccgcaccagaatcaggccgaccaccgcgatggccacaccgatggccgcggccagcatcgcctccaccaggaacggcagctgggtgtaccagcggctcgcgccgaccagccgcatgatcccgatctcggtgcgccgggtgtgcgccgcgacctggaccatgttggcaatgagcaggatcgcgccgacggcctgcaccagcgcgaccgcgaacgcggcgttacgcagcccgtccagcaccgcgaacagccggtcgatcagatccttctcgttgagcaggctgcgcaccccgggctggccctgcatcgcggcgtcgaattccgcgtgctgctcggggttgttcagtttgacgataaacgacgcgggaaacgagtccttgccggcgacgtccttgaactccgggaacttcttgatggcgtcgttgtaggcgtcctgccggttgacgaaccgcaccgatttgacgtcttgacgggcatcgatcttgtcccgcaacgccttacacggcgcggatccacaggtcgcgtcgttggtggagatgtcgtcagtcaggaacacctgcgtctcgacgcggtcgaggtagatctcccgggaattgtcggccaaccggaccaccagcaggccgccgccgaacaggccgatcgagatcgccgtcgtcaggatcatcgcggccgtcatggtgacgttgcggcgaagcccggtcaggacctcattgagcaggaagccgaagcgcacttaccggtccatcccgtagatgccgcgctgctcgtcgcgaaccagcctgcccaacgacagctcgacgacgcgctggcgcatcgagtcgacgatgtgatggtcgtgcgtcgccatcagcaccgtcgtcccggtgcggttgatccgctccaacaaatccatgatgtccttactggtgtcggggtcgaggttgccggtcggctcgtcggccagcagcaccagcggccggttgacgaacgcgcgggcgatcgcgacccgctgctgctcgccaccggacagctcgtggggcagccgattggccttgccggacaggccgacggtctcgagcacctcgggcaccacccggttgatcgcgtcggtgcgtttgccgatcacttccagcgcgaacgcgacgttctcgtacacggtcttttgctgcagcagccggaagtcctggaacacggtgccgatcacctggcgcagcttcggaatgtggcggccgcgcagcttgttgacgtggaacttcgatacccggatgtcgccggtggtcgggttctcctcgccgagcagcagccgcatgaacgtcgacttacccgaacccgacgggccgatcaggaagacgaattcacccttgtcgatcttgacgttgacgtcctccagcgccgggcgcgccgacgctttgtatttcttggtgacgtggtccagggtgatcatcacggcacgccagtgtagcggtgaatttcgctggcaagcgaaagtcaactggccggtggtggcgacgtcggcgtaggacccggcccgggctgaggttgctccggagcgggcgtggacggcgtggtactgggcgggcagaacggcgccggaaggatgcacggcagcttcggcaactggaacggcggcgtcgttgttgtcgttgtggtggtcgtcaccggcggtggcgggggcggtggtggcggcgtgctggtcggggtcggcgtgtaggtgacggtggccggcggctgctgcagccggctgcgcggcacccaggtgtagttggggtcgggcacgaagcccggcggcaccacctgctgggccggcggcttgggcgccggttccgggcggtaggtgtcgtagacccaccacaccagcaggaaggcgacgatcaggacgaacgtcgaggtgcgcatccgcccgccgaagacgtactgcggccagcggtgttcggcctccgtgtcatcgtcgctgccgcgcttttccaggatgttcagggtgaacttcaacgcttctgcaccgcaccttggacgtcatcgtcggattgctgttcggcggcctgggcggccggcacgctggcgtcttccaccagccccacccgcgcgtcggccgcggtgacgatgccggcacgggccagcgcccgaatcaccagcacgcgcagctgccggcccacctcgaactgcttaccgggcaacgtgcgcgccaccaaccgcagggtgacggtgtcgacctcgatgctttccacacccatcaccgtcggcgagtccaacagcagctggcccagcaccgggttgtccatcgcgcggtcgcattcctggtgcagcacctcgttcacccggttcaggtcggcgctggtcgacaccgggatgtccaccaccgcgcgcgcccagtccttggacaggttgaccaccttgacgatctgcccgttggggatggtcagcacctcgccgtccggggatcgcagccgggtgacccgcaatgtcacgttctcgacggtgccgctggcctcggtggcggcgacgacggtcagggtgaccaggtccccgaagccgtactgccgctcggcgaggatgaagaagccggacagcagatccttcaccaactgctgggcgccgaaacccagcgcggcaccgaccacggttgccggcgcgaccagcccgcccaccgagaactgcaggatgctggcgatctgcagcatcacccagatgccgatgatcacgaccgacacccaggagatcaccgacgccacggcctgacggtgcttggaggcttccgagcgcaccagcgcgtcgctctcgacgaagccggtggtgggctggcggctcacctgcagggccacccagttgacgaaccgggccgccagcacggccgcgatcagcaccatgacgatccgcagacccctggtgatgatccactcaccgagttccccccgccagaagtcatgccagcggtgcgccgctgtcgtcatggctccggcgagaacgcttgtgttattcgtcatcttttctgttgcgccaacggattcccgcttccaggaagccgtcgatgtctccgtccaggacggccgcgggattgccaacctcgtactcggttcgcagatccttgaccatctgataggggtgcagcacgtaggagcgcatctggttgccccacgaactgccaccctcgccctttaacgcgtccagctcagcgcgttcttcggatcgcttgcgctccaacaactttgcctgaagcacccgcatcgccgagatcttgttctgcaactgcgatttttcgttctggcaagtcacgacgatacccgttgggatgtgcgttaaacgtaccgcggagtcggtggtgttcaccgattggccgcccggcccgctggagcggtaaacgtcaacgcgcacatcgccttccgggatgtcgatgtggtcggtggtctccaccaccggcagcacctcgacttcggcgaacgacgtctgacgccggctctggttgtcgaacgggctgatgcgcaccagccggtgggtgccctgctccaccgacagcgtgccgtaggcgaacggggcgtgcacggcgaacgtcgcgctcttgatgcccgcctcttcggcgtaggacgtgtcgaacacctcgacgggatacttgtgctgctcggcccaccggatgtacatgcgcatcagcatctcggcccagtcggcggcgtccaccccgcccgcgccggaccggatggtgaccagcgcctcgcgctcgtcgtactcgcccgacagcagggtgcgcacctcggtggcctcgatgtcggcccgcagcgccttgagctcggcgtcggcctccgccagcgcctcggccgcgccctcgccatcctccgcggccagctcgtagagcaccggcagatcgtccaaccgcgcgcgcagctcctcgatgcggcgcagctcgccctgggcgtgggacaactcgctggtcacccgctgggcgcgggcctggtcatcccacagctgcggatcggacgcctcgtgctcgagcttctcgatgcgggcgcgcagaccgtccacatcgagcacccgctccaccgtggtaagggtggagtcgagggcggcgatgtcggcttgacggtcgggttccacagccgacaacgttaccggggaccgccaagcggccccgccaccggcgagtgctgaggtcacgaccagcggtcatgcgtttagagtcgagtcacgatcatgtgcgcccgcgttgcgcgcccgccaatcctggcagcccccggcgcgcgaaccgggcccgaatagaaggtcgagaatgcgcccataccacgttgcaatcgtcggctccggaccgtccggcttcttcgccgcggcctcgctgctgaaggcggccgacgggtccgagcaccccgacgtcgccgtcgacatgctcgaaatgctgcccaccccgtgggggctggtgcgctccggggtggcgcccgatcatcccaagatcaagtcgatcagcaagcagttcgagaagacggccgccgatccccgcttccgtttcttcggcaacgtctcggtcggcgaacacgtgcaggccagcgagctcgccgagcgctacgacgcggtcatctacgccgtcggggcgcagtccgaccgggcgctgaacatccccggcgaggacctgccgggcagcatcgccgccgtcgatttcgtgggctggtacaacgcgcaccccaacttcgaggaggccacccccgacctgtccggttcgcgggcggtggtcgtgggcaacggcaacgtcgcactcgacgtcgcccgcatcctggtcaccgaccccgacgtgctgggcctgaccgacatcgccgaccacgccctggagtcgctgcggccgtgcggggtcgacgaggtggtggtgatcggccggcgcgggccgctgcagaccgccttcaccacgctcgagctgcgtgagctcggcgagctggacaacgtcgacgtgatcgtcgacccggcccagctggagggcgtgaccgacgaggacgcggccgcggccggcaagacggccaagcagaacatcagcgtgctgcgcgattacgcgaaacgctcgccgcgtcccgggcaccgccggatcgtgctgcggttcatgacctcgccgatcgagatcaagggcgacggccgggtggaaagcatcgtgctgggccgcaacgagttggtcaccgacgagaccgggcgggtgtcggcccgcgacaccggcgagcgcgaggaactgccggtccaactggtggtgcgctcggtcggctaccgcggcgtgcccacccccgggctgccgttcgacgagaagacggcgaccatccccaacaccggcggccgggtcgagggcagccgcaacgagtacgtggtggggtggatcaagcgcgggccgaccggcgtcatcggcaccaataagaaggactcccaggacaccgtggacacgctgctcgccgacctggccaacgccggcccggacgggctggccgactttccggacgaccacgccgaccggctggccgactggctggcgtcacgtcagccgaagctggtcaccaccgcgcattgggagctcatcgacgcgcacgagcgggcggccggcgaggcgcgcgggcgcccccgcgtcaagctgcccagtttggccaagttgctgcgggtcagccacggctgagcggccgtcgtcgccgccgagaggacgaacggctctactgattcgcggtgattctccgtagctttgagggcgtgggtagcgacgagccggtgcaggtgctttccgaggacgagaactggcggctgttgggcagcgtcgcgctgggccggctggtcaccaacttcgccggcgaggccgagatcttcccggtcaacttcgtcgtgcaggaccgcaccgtgctgttccgcaccgccgagggcaccaagctgttctcggcagtggccaatcacgcggtggtcttcgaggtggacgaccacaacctcgtcgagggctggagcgtcatcgtccgtggtcgtgcgcggctgctgaagaccgacaccgacattcaacgggccgagcgcgcgcagctgttgccgtggaccgcgacgctcaagccgcactatgtgcggatcaccccgaccgaggtcaccggtcgtcgcttccggttcggtccggagcccgatcgtcacgaacccgttgcgtgacaagcaattcgggtgaatcggcaccggtcagccggcggtgcatggcccacgcgatgcgggcggcctgaatcttggcccgatcggccgccggtccgcgatacatttcgtcgacggtgttgtgccacaaggtgagccagcgtcggaagtgacgatccgacagtggcgtgcgccggtggatgtcacggtgcgcctgcagcgcgctgccccggtagcgtcccgcccggaacagcaccgtctcccagaagtcgcacatcgtcgggacatggtcgtccagcccggtcgcccgcaatcgggcgaacggctcggccagcacctcgtcgtccagcgcccggccgtagaaccggcgcagcagcgcctccacgtcggcgcggtcgcgcagatccggcatcgtcagtccgctcaccaaccccctcgatccgtcccgctcacaagttgccgcagcgcaccgccagcacggaatggccggcgtggcagagggcctcggcccggtaggcgtcggtgaccagcagccggcccgcccggtggtcggcgcgcaggtgctgctccacgccgccggtcagcaccgccgactcggcctgcacgtcgggatacaaccgcatccaccgcgccagcctgcgctccaattccactcgggcagaagggtttcccaccgcgcacaaccccaccccgcgcagccgcgcctcctcgaaggcgtgccgcagcaccgtgccgttgtccacttcggcgaccacgccgctcacccgggccgccgccggcaggctgggcgcctgctggaccaccgcgacggggcacagcgccgagcggaccaacgacgtcgcgatcgcgggcccgccgtggcaggcatggttgagcccgatctgcccgacgcacagcatgaccgccgaccgggactgctcgagcagcttgaaagcggtattgccccaaaggatttcggtctccaccttgaccggttgagcgaaggcgtcgacggcgcgatgcgcatcggccagcgcggcccgggcggcggcgagccgggtgtcgggcccgtgcccaccgggcgcgccgtgcggatcgatcacgtagaccaggcgcagcggaatgtcgcggccgaccgcctcgtcgatcgcccagaccgccgcgtgcatcgccgcccgcgatccgtcgacgcccaccacgatcgccggggccggatacgcagtgctcatcgcgacttccttcacagggcggttcgtggggcgtttcgccacaccgttcgcattcaggctattgcgcgtaaaccgctctcccccagaggcgttggtccccaaacaggtgccataagaccctagggaaccccgacacgcgccgaattcactgttgccatcgcaccaccggccatcgaatattggttgcggacgtaaccaggttcgatatgcgagacagcgacaccaccgcggcccctagacgaaagagacctcgcgcatgaccgctcccgagacctccgctcaacagacgtcgtcgcagccgctggtttcaaggggctggatccaaggtgtcgccctggtcatgattttcggcttcctggtgatgggcatcctggcctatcgcacctactcggcgtcgatgccgatgccggacaaggtggtcagcgagtccgggcggctgctgttcaccggcgcggacatcacccgcggccaggagctttaccaggcacgcgggctgatggaatacgggtcggtgctgggccacggcgcctacctggggcccgactacaccgccgaatatctgcggacggcaacgcaggatgtcgccgaccaactgcgggcgcagggcgtcgccgacccgcgcgagcgggtggtcaccgagttccgcaccaaccgctatcaccccgacaccaagacgctggtgttcaccgaccggcaggccgcggcgttcgaccacatccaggatcgctacggcgcctacttcggtgagaactcgacgaaatacggctgctgccgcacctgatcaccgacaaggcgcaaatccgcgacctgacggcgttcttcgcctggacggcgtgggccgcggcggccgaacggcccggccacaagtacacctacaccaacaactggcccgccgagccgcgagtcgacaacgggcccacggcagcggtgatcgtctggtcggcgctgtcgctggtggcgctgctgggcggcatcggggtgatgttcgcggtgtacgggcggtggagccagaaggtgggctggcacagcgccgagacgtccaccctgtccttccgccagcccggcgacgtgggcctgacgccggcccaacgcgcctgcgtctggttctttgcgatcgtgtcggtgctgtttttggcccaaacgctgctgggcgcggcggccgagcactaccgggccgacctgtccaacttcttcggcctggatctggcccgggtgctgccctacaacctggcccgcacctggcatctgcagctgtcgctgttctggaccgcggccgccttcctggccggcggcatcttcctggtgcccttcatcgcgcgccgcgagcccaagcgccaggcgctgctggcctacatcctgctgggggcggtcgcggtggtggtgttcggctcgctgatctgtgaggcgctgtccatctacggtgtcatcccggccggcgggctgttctcccagcagtgggagtacctcgacctgccgcggctgtggcagatcctgctgatcgccggcatgttcatgtggatcgccatcatctggcgcggcatccgcggccggctcaagggcgagtcgaagatgaacatgccgtggctgttcttcttctccgggctggccatcccggccttctacacggtgggcctgctggccggcagcgacgcccactacaccgtggccgacttctggcggttctgggtggtgcacctgtgggtggaggacttcctcgagctgttcaccaccgtgatggtggcctacatgttcgttctgctcggcgtggtgcgcgagaagatcgcgctgggcgtgatcttcctcgacgtcatcctgtattccgccggaggcgtcatcggcaccatgcaccacctgtacttctccggcaccccggtggaacacatggcgctgggcgcgttcttctcggccgccgaggtcattccgctgaccttcctgacggtcgaggcgtgggcgttcctgcaactcggcgcgcgccagcagtccggcgacgccaacccgttcccgcaccgctgggcggtcatgttcctggtcgcggtcggcttctggaacttcttgggggcgggcatcttcggcttcctgatcaatcttccggtggtgtcctactaccagatcggcaccgccctgaccgccaaccacgggcacgcggccatgatgggcgtgtacggcatgctcgccgtcggcctggccatgttcgccttccgctacgtgatcccggccgacaagtggccggagaagctggcgcgaatctcgttctggtgcatgaacatcgggctggcgtggatggtgttcgccacgctgctgccgttgggcgtgctgcagctctaccactcggtcaacgacggctacttcgaggcccgctcgctgggctacatcaccaagcccggcaacgcggtcctggaatggctccggctgcccggtgatgtcatcctgatcgccggcggcgtgctgccgttcgtctggatcgcctggaccgcgctgcgtaacttccggtccggcaccacggttcaggagctgcccgagcacccgctttacaccgagtccccggtcatgtccgaggccggcgccgctgcggcgaaggattgaccggtgggtgcaccggccaccacggtctggttgatcgccgggtattcgctggccttgctggtcgtcggctgggggttcgacgtcatggcgcgccgggcctcggcgcacgccgcccgctggcgcacgggccgattcacctaccggcccgaccacgacgcgtggatctgcccgcaggatcattggctgtggccgacgtccttcgacccgaagcaccgggtgatgcgctaccgcgccctgccggtggtgtgtaacagctgcccggtgaaagcggagtgcaccacctccgagcacggccgcgagatcagccgcgaggtcgacccctggccgcattcggatgccggccggttccatcgcgggatcgcttgctgcgtagccggattggggatcgtgttgccgctggccaccttggtcaccaaccactcggcggcggacgcgctggtgttgacggccaccgtgctgctggtcgcgctgctcggcctgccgctggcgcgtcacctgtggaacaccccctccaacgcgccgcaacacctgccgcaccgcaccgcgatcgaggaccaggtggccgcggcgatcgaccggtactccacccgctggggcggctggaagagcaaggaggacaacgcaacatgaccaccttggtgatcgcgctgatcggcgccgggatcgtggtgctcgtcgtcctgggtttctggtcgctggtggtgctgcgcgaatacgaacgcggcgtggtgttccggatggggcatgtccgcccgctctacggtcccggattgcggtttctgattccgctgctggacaagatgattcgggtcgaccagcggctggtgacactgaccatcccaccgcaggaggtgatcacccgcgacaacgtgccggcccgggtcaacgcggtggtgatgttccaggtgaccgatccacgcaaggcgattctggcggtggagaactacgcggtcgccacctcgcagatcgcccagaccacgctgcgttcgctgctcggccgggccgacctggacacgctgctggcgcaccgcgaggacctcaacaacgacctgcgcaccatcatcgacaagcagaccgaaccatggggcgtgcaggtgcacgtggtggagatcaaggacgtggagatccccgagtcgatgcaacgggcgatggctcgcgaggccgaagccgaacgcgaacggcgcgccaaggtcatcaacgcgcgcggcgagctgcaggcgtccgaggagctgcgcgaggccgccgagaccctgtcgaagagcccggcgtcgctgcagctgcgttatctgcagacgctgctggagttgggcgccgaccagaactcgacggtcgtcttcccgctgccggtcgacatcatcaccccctttctgcgcaacccggggctgctacagggcgtggtcgacaacgtcggccgtcccgggtgaccgctgcccgcttacctcttaggcgcacgccaaataacaagcgtgccaaacactttgggtatcagtggggcgccgggcgggtcgggcggtaggttaacggacagtgaatgtagggtgaattcaggctgaattcaccccgggtggtcgtggggaaatggggaaaacgccgcacgcgtcgtccgcacctgcgacgtttgaagggcccgagaccgaaagcctgctgcgatgccctgtgcgcatgccccgccgacccgataagcgccacgccgcccgttaagccgcgtggcgccatcgcgccgggctgccccatcaccgacgcggggtgagctttgccgggcggcaaagccgacacggacgcggcccactattcgagatcaacgccgatgcggcgagcgccggcgctaccggcgtttgccgacacaccgcactgtgaggggacacaacacgatggattgggcttttctaccaccagaaatcaactcggcccggatgtacaccggcgccggcgcggcctcgctgctggcggccgcgggcagctgggacgcgctgtcggccgagctgacggccaccgccgacgggtacgaatcggtgctctccggcctgggcctgcaatggcacggaccggccgccgacgcgatggcgttcgcggcggcccgctacctgacctggctgcgcgcgaccgccgagcagaccaaacagaccgccatgcaggcgcgcaccgccgcggcggcctacgagcaggcctacgcgatgacggtgccgccgccggtgatcgccgccaaccgcactctgctggcgtcgctggtggcgaccaacatcatgggccagaacaccgcggccatcgcggacaccgaggcgcagtacgccgacttctgggcccaggacaccgccgccatggccggctactcggcgtcgtcgacggcggcaacgcagctgccgcggttcgcctcggcgaacaattccaccaacgagtccggggtgaccgcccagaacgccgcggtgaccgccgccaacgccaacgccgccgcgaacaaggctgtgacacagtcgttttcgccgctcgccgacaacccgccggggacgacgatcaacaactactacgtggacgcatcgtcgaccagcgcggccaacagtaacgccttccgggtcctcgacgtcatccagggcaccgggctgggcttcagcgccccctacaacatggaacagttcgtgtccgggatcatcggggccgagaacaacctgggcatgctggccaaacccggtgcggccgcggccaatatcgccccggcgctcgccgctcccgcgctgcgcggcgccaccgccggcctcggcggcggcctgggcgggggcctggggaacgtcaccgcaaccctgtcgcacgccggcacgatcgggccgatgtcggtgccggcaacctggtccgctcccaccagcacgcatgtctcgccgttggcgccggccggcttcaccacgctgccgggcaccgaggagccgatggcgtcgggatatcccggctaccccggcatgcccggcggtggcgccgcgcgatccgccggcgcgggtgtcccgccccgctacggcgtgcggctcaccgtgatgccgcgcccgccggccgccggctgactcggccaccagcagaccccgtcgtcgcacccagttcgtgcgccgctcctcaacgctcatcgaccgctcaccgacgcttatagagatgtagggcaatggatttcggcttccttccgccagaggtgaactctgcccggatgtatgctggccccgggtcgggttcgctgttggccgccgcggggagctgggactcgttggcggcggagttgagcatcacggccgcggtgtacgaatcggtgctcgccggcctgacgggcctgtattggcacgggcccgcgtcccgggcgatggcggccggcgccgccccctacgtgggctggctgcacacgaccgccgaacgggcacagcagaccgcgacgcaggcccgcgccgccgcggcggcctacgaactggcgcatgccatgacggtgccccccgccgccgtcgcggccaaccgcacccagctggcggcgctggtggcgacgaacttcttcggccagaacaccgcggccatcgcggccaccgaagcgcaatacgccgaatactgggcccaggacgccgccgcgatgtatgcctactcggccagttcggctgcggcagcccagttttcgccgttcccctcaccccgccgcaccaccgacccgggcggggtgacggcccaacaggccgccgtcgccgcggccgagaccggcagcaccggcacggattcgggggcgcaggtgatccccccgacagccggggcctcggaaatcccgctcgatttccggatcctggacaccatcctgggagcccagaccacgttcaggtcgatcttcaccaccgaggggatcccggccggaatcatccaggccgacaagaacttgggcattctgcccaatctcgcgacggttccggccgcactcccccggacacccgcgctgagcgcctcgccgtccgggctgggcagaatcgacgcggtgctggcccgggccgcacggatcggcccgatgtcggtgcccgccggctggaccgccgcgacgggcaatcccgttgccgcagcgccggtcaccggctggtccgagccgagcgcggccgacgcgcgtcccggtgtgaccgcgcccggtcttcccgggataccgggcgccacgctcagacgcgcggcgctagtggtgccccgctacggcgtgcggatcacggtcatggcccgcccgcccgccgccggctgaacctcagccgcccggctgggacggctcgggcggcgccggcggggcgaacctccaattgtccggattcttcgacgaatacagcaccgggaacagctgaccgatggtcggccattgattcacgtcgacggccatccgctgatacacggcgtgttcgttgacggtgggaccgttgatcacgccggcgatggtgacgtactgctcgccggtggcctcgggccgcgggctgacgccggtcaccagcagggtgccgctcagcagctcgccgcggggcccgcgcggaacgaaccgctggacgaggaacaccgccaacacggccaccaacaacaccagcagtccgaattcccacacccggccatggtaggactgctcacatgaatcgcaccggcggcgatgcgtcgcccggcgaaccaagggagcggcgcgggtgagcaacgacgatctggcgctggcgttgctgctggccgaccgggcggatgcggtgacctcggcccggttcggcgcgctggacctgcgcatcgacaccaaaccggacctgacgccggtcaccgacgccgatcgcgccgccgaggccgagctgcgcgcggtgctggcgcggcagcgcccgaacgacagcatcgtcggcgaagagttcggcggagacaccgtcttcaccgggcggcaatggatcatcgacccgatcgacggcaccaagaacttcgtccgcggggtgccggtgtgggccaccctgatcgcgttgctgcacgacggcgttcccgtcgtcggcgcggtgagcgccccggcgctggcccgccggtggtgggccgcgcacggccggggagcgttcgtcgcggtcaacggggccgccgcccgtcggctatcggtttcctctgtggcacaactggattcggccagtctttcgttctccagcctgtccgggtgggcgcagctgggcctgcgggatcgattcctggcgctgacggatgcggtgtggcgggtgcgcgccttcggcgacttcctgtcctactgcctggtggccgaaggggccgtcgacatcgccgccgaaccggaggtgtcggtgtgggacctggccgccctcgacatcctcgtgcgcgaggccggcgggacgctgaccgggttggacggcaccccagggccgcatcgcggcagcgcggtggccagcaatggactgctacagcgacaggtgctcgagcgcctcgcactgtgaattagttaacaagtgttctccatgatcttactccggagtaagatcggctctatccgcactgcccatcaacctgaggctgctgaaaatgaccgattccggttccaccaagacccccgcccgcgtcaaacggcgtgaccgccagtccggcgtcgggctgcaaccgcacaaacgcacgggcatcgacatcgccatcgcgctgctcaccccgttggtcgggcaggagttcctggacaaataccatctgcgcgacccgctcaaccggggcctgcggtacggcaccaagaccatcttctccaccggcgccgccacgtcccggcagttcaagcgggtacagaacctgcgcggcgggccgacccggctcaagtccagcggcaaggactacttcgacctgacccccgacgacgagcagaagatgatcgtcgagacgctcgacgaattcgccgccgaggtgctgcggcccgccgcccacgacgccgacgaggcggcgacctacccgcgcgacctgatcgccaaggccgccgagctgggcatcaccgcgatcaacatccccgaggacttcgacggcatcgccgcgcaccgctccagcgtgaccaacgtgctggtcgccgaggcgctggcgtacggcgacatgggcctggcgctgccgctgctggccccgggcggcgtggcctccgcgctgacccattggggcagcgccgagcagcaggccacctatctgccggagttcgccggcgagaacgtgccacaggcctgcgtggccatcgccgaaccgcaaccgctgttcgaccccacccggctgaagaccaccgcggtgcgcaccccgagcggataccgcctcgacggggtgaagtccctggtgcccgccgccgccgacgccgagctgttcatcgtcggcgcgcagctggacggcaagccggccctgttcatcgtcgaatcctcgacgaaaggccttaccgtgaaagcggatccgagcatgggaatccgggcggcggagctgggccacgtcgaactgtccggggtgacggtgccgctgggtgcccggctcggcgaggacgaggccaccgacgacgactactccgaggcgatcgccctgtcccggctgggctgggcggcgctgaccgtcgggacgtcgcacgcggtgctcgactatgtggtgccctacgtgaaggaacgcgaggccttcggcgagccgatcgcgcgccggcaggcggtcgccttcatgtgcgccaacatcgccatcgagttggacgggctgcggctgatcacctggcgcggcgcggcgcgcgccgaacagggcctgccgttcgcccgcgaggcggcgctggccaaacggctcggcgccgacaagggcatgcagatcggctccgacggcgtccagctgctcggcggccacggctacaccaaggagcacccggtcgaacgctggtaccgcgacctgcgggccatcggcgtcgccgagggcgtcgtggtcatctgagtcgttaatgcaagaaccgagctgaaagttcaatcatggcaatcaatctggaacttccccgcaagatgcaggcggtgaccacgaagacgcatcagggcgccgcggagttgatgcgcccgatcgcgcgcaagtacgacctgaaggaacacgcctacccggtcgagctggacacgctgatcagcctgttcgaaggggcttcggagtcaatcgaattcgccggggcgaacgcgctgggcggcgaggacgaagaacgggacaagaaccacaacggcgccaacatggccgcgctgctgcagacgctggaagccagctggggcgacctcgcgatgatgctctcggtgccctaccaggggttgggcaacgcggccatctccgcggtcgccaacgacgagcagctgcagcggctgggcaaggtgtgggcggcgatggccatcaccgagcccggcttcggatcggactcggcggcggtgtcgacgaccgccaccctggacggcgacgagtacgtgatcaacggcgagaagatcttcgtcaccgccggctcgcgggccacccacatcgtggtgtgggcgacgctggacaagtcgaagggccgcccggcgatcaagtcattcatcgtgccgcgcgaccatcccggcgtcaccgtcgagcggctcgagaaaaagctcggcatcaagggctccgacaccgcggccgtccggttcgacaacgtccgcatccccaaggaaaacctgctcggcaacccggaaatcgaagagggcaaaggcttttcgggggtgatggagaccttcgacaacacccggcccatcgttgccgccatggccgtcggggtggcccgcgccgcgctggaggagatccgcaagatcctcaccgacgccggcgtggagatctcctacgacaaacccgcgcacgtccagagcgcggccgcggccgagttcctgcggatggaagccgactgggagtcggcctatctgctgtcgctgcgagcggcgtggcaggccgacaacgagatccccaactccaaagaagcgtccatgagcaaggccaaggcgggccggatggccaccgacgtcaccctcaagaccgtcgaattggcgggcaccgcaggctattccgagcagtcactgctggagaagtgggcgcgtgactccaagatcctggacatcttcgagggcacccagcagatccagcagctggtggtggcgcgccgcctgctgggcctgtcgtcggccgaactcaagtagcggccgggctatcggcgttgcgcgccgagcgtgcaaccaccgcgagacatcggccgttttctcgccgcgagtacacgttcggcgacagtcaagcgcgccggcgaatcctccggccgggccgtggtgcgggtcgtcgacggtttttgagccggcagtacgctgttcgaccatgcgtgctgcacgagtgactcgactggacggtccggacgcgatcgaggtgacggacgtcgacgaaccgaccggcgacggcgtcttcgtcgacgtgcacgcggccggggtggccttcccggacgccctgctcacccgcggcctctaccagtaccggccggagttgccgttcgtgctcggcgccgagatcgccggcgtggtgcggtccgcgcccgagggcgcgcacgtgcgttccggcgaccgggtcgtcggcctcaccatgctgtccggcggcatggccgaggtggcggtgctggcccccgaccgggtgttcaagctgcccgacaaggtcagcttcgaggccggcgccggcctgctgttcaacgacctgacggtgtacttcgcgctgaccgtgcggggccggctgcagcgcggcgagacggtgctggtgcacggcgcggccggcggtatcggcacctcggcgctgcgactggcgccggcgctgggcgccgcccgcaccatcgccgtggtcagcacgacggacaaggccgacatcgccacggcggccggcgcgacggacgtcgtgctggccgacggcttcaaggacgccgtgaaggagctgacccacggccgcggcgtcgacatcgtcgtcgacccggtcggcggcgaccggttcaccgattcgctgcgctcgctggcccccggcgggcggctgctggtggtcggcttcaccggcggcgagatccccacggtcaaggtaaaccggttgctactcaacaacatcgacgtggtcggcgtcggctggggcgcctggacgggcacccatcccggcgcgctggccgagcagtgggcggggctcgagcgactgctcacctccggtgagctggccccgcccgagccggtggtctatccgctcgacgaggccgcggcggccgtggcctcgctggagaaccgcaccgccaagggcaaggtcgtgttgcgcgtgcgcggttaggcgctcggcgccggcggcacccgggcgggccttgtgcccgcccaaaagaaaaagtaatgtcactttcagtttttgccgccgagcttggccccaccggaggagccaccatggaatcctttattcacctgcgcaaaggccggacaccgggccggctgcacgccgacctcgacgggctcaaggacgacgagctgggccgcggcggcttcaccggccgcaccgccaacatgtaccgccgccacgaccccaccgcctaccgcgtgcagggcccgctgcgacccatcgacgtgttgacctccgaactcaaaccgagcgacgccagcgacgccaacggcgggccgttgctgatgttcgccaaccccgactgccgcatctcgctgtcgcgccgtagcgagccgatgccgttctacgtccgccacgtcgacggcgacctgctgtgcttcgtccacggcggcgccgggttgctgcacaccgagttcgggcccatgccctaccgccaaggcgactgggtgtatctgcccaaggcgacgacgtggcgccagcttccggatgccgagaccacgctgctgatgatcgaggccaccgacgagttccgcgtcccgccgcccgggccgctgggccggcacttcccgttcgacccgtcgcaggccaccatccccgagccgcaagcactcgatgacgatcccgcccacgacgagtacgaggtccggctggtgcatgagggcggcccgacaacgctgttctaccaacacaatccgctcgacgtcgagggctggcgcggtgacaacttcgcgttcaccttcaacatcgccgactacaacgtggtgacctccgacagcgtccacctaccgccgacggtgcacctgttcatgcaggccaccggcgtgtacgtgatgaactttctgcccaaaccggccgagggcgtgcccggcaccgaacgcaccccctggtatcaccgcaacgtcgactacgacgagatcgccttcttccacggcggctcgctctacggcatcccgatgccgcccgggctgatttcccatgcgccgcaaggggttcaccacggcgcaccggagaaggcgcgggagcgggcccgccgcaagttcgacgagtacgcccgggtcgactggcaggtgatcgccgtcgacacccgccgccggctgacgccgtcggcggaggtactggcccacgacctaggacagcactgatgaaacacgaatacgaccgcatcccctatctggttgccttccagaacaattcgggcgtccgggatgtctacggcgggctggccgagatcaccgtgctggagagctacctgctcaagccgaagaacaagccgagcgacaccgtgctggtgttcatgcacccgatcggcggcggcgcctacctgccgatgatcaacgcgctggcccgcgccggccaccacgtcatctactgcaacagccggttccgcggcaccgactcggccctgctgatggagaaggtggtcgaggatctcggcgagtgcatcaaggacgccaagaagcgactcggctacaccaaggtagtgctggccggatggagcggcggcggctcgctgtcggtgttctaccagcagcaggcgcagaatccgaccatcacgtccagcccgtccggcgacggcccggacctgaccaagctcgacctgacccccgccgacggcatcatgctgctcgccgcgcacatcagcaggcacggcacgctgaccgagtggctggacgcgtccatcctcgacgaatccgaccccactaagcgcgatcccgagctggacctgtacgactccgacaacccgaaccaaccgccctacagccaggagttcctggaccgctaccggcaggcccagatcgagcgcaaccgccgcatcaccgcgtgggtcaaagccaagctggccgagttgaaggccgcgggccgccccgacgacgaattcgggttcgtcgtgcacggcaccatggccgacccgcgctggctggacccgaccgtcgatcccaacgaacgcaccccgggaacgtgctacctgggggatcctcgagtggtgaacatgagccccgtcgggttggcgcggttctgcacgctgcgcggctggctgtcgcagtggagctacgacgacgcccgcggcgacgcgctggcctgcgggcccgacatcgccatcccggcgctggtgatcggtaacctggccgatgacgcctgcacccccagccacacccggcggctgttccaggcgatcggacaccacgacaaggagatgcacgaaatcccgggcgccacacactattacgcgggaccggaccagcgcgacgcgctgcgctcggcggtcggcatcgtcaccgactggctggtccggcacgacttcgcggagaaggcatgagcgctgcgggtgcggccggaccgctggacggcatccgggtgctcgagctgggcaccctgatcgccggcccgttcgccggccggctgctgggcgacatgggcgccgacgtgatcaaggtggagctcccccgggcgcccgacccgctgcgcacctggggccaggccgaggtcgacgggcaccacgtgttctggacggtgcacgcccgcaacaaacgagcgatcaccctcgacctgcgccacccgcgcggccgcgagctgttctgcgagctcgtcgagaagtccgacatcgtggtggagaacttccgtccgggcacgctggagaagtggaacctgggctatgacgtgctgtgcgaacgcaaccccggcatcatcctggtccgggtgtccggctacgggcagaccggacccgacgccgccaaggccgggtacgcctcggtcgccgaggcggccagcggactgcgccacctcaacggctttcccggcggcccgccgccccggctggcgctgtcgctcggcgacagcctggccggcatgttcggcgcccagggcgcgctggccgcgctgtaccgccgcagcgtcaccggccgcggccaggtggtcgacgtcgcactgaccgaatcctgtttggccgtacaggaatccacgatcccggattacgacgtcggcggggtggtgcgcggtccgtcgggcacccggctcgagggcatcgccccgtccaacatctaccgcagcgccgacggctcgtgggtggtgatcgccgccaaccaggacaccgtgttcgcccggctgtgcaaggcgatgggccgcgccgagctggccaccgacgaacggttcgccacccacgtcgcgcgcggccgcaaccaggacgaactcgacgggatcatcggcgagtgggccgcacagcgccagccggacgagatcatcgaaaccctttccgccgcaggcgtgatcgccgggccgatcaacacggtcgccgaggtcgtcaacgacccgcagctgcgggcccgcgacatgctggtcgagcattacgacgagcggctgcggcgcaacgtgctgggcccgggcatcgtgccggtgctctcggaatcgccgggccggctgcgcaacgcgggtccggcgcggccgggccagcacaacgacgaggtgtaccgcgggctgctgggcaagaccgccgaggaactcgaggagctgcgggcacaggaggtgctgtgaacacacatgtggccatccgcgaggtggcgctgcgcgacggcctgcagatcgaggcgccgatcccgttgtccgccaagctcgaactgctggccgcggtggcggccaccggcgtgcgcgaggtcgaggccaccgcgttcgtctccccgtccaaggtgccgtcgatggccgacgccgccgagctggccgcccacctggccgactaccccgacatcgaattctccgccctggtcgccagtcccaacggcgccaggcgggcggtggccgccgggttgcgcgccatcgaatacgtggtggccgccgacgacacgttcagcgcggccaacgtcgggcgcaccagcgccgaggccaccgaacagatcggcgacatcgtcgccatcgcccacgacggcccgggcccgccggtcaccgtcgaagtcgtcatcgccaccgcgtgggactcaccgttcgaaggccccactcccccgcagcgggtgctcgacatcgccgccgcggcccgcgaccgcggggccgaccggctgtcgatcgccgacaccatcggcacggcgacccccggccgggtgagttcgctgatcgcgcaactgcttccggtgatcggtgacatgccgctgggcggtcatttccacaacacccgcggctgcgggctggccagcgcgtacgcggcggtcggcgccggggtcacccggctggacgcgtcggtcggcgggctgggtggctgcccgttcgcgcccggggccaccggcaacatcgccaccgaggacctggtgtacctgctcaccgacagcggattcgacgtggacgtcgacctgcaggccgccagcgccgccgccggtgtcgcgaaaacacttgtggggcatgatcttcccagtgccctgctgcgcgccggggaccggcggagaagttgagagcggggcccctgatgcctgccgaactgctgaccgccaagggccgccagaccaggcaggccatcgagcaggccgcgcgcaagctgttcgccgagcggggttttcacggcaccacgctggccgacatcacgtcggcggccgggaaatccccggcggtgttctaccggtatttcgccgacaaggaagacctgctggccgcgctcgcggagtccttcctgcacgaggtggtcacgccctcggggctcagcgtccacctgccggactcccccgacgacgacgccttcttcaccgcggtggtcaccggttactggaacatgttcaagcagaacatcggcatcatgatcgcggtggcccagctggccgccacccagcagcggttcgcggcggtgcagaacgaattccggcgcttcggcatcgatctggtggcggcgtcggtgcgccgcgcccaggagcagggttacggcgccgagctgcacccccagcacaccgcggcggccatcgcgctgctgttcgagaacttcaccaccgtgttcgtcggcccgtccggtctgggtatcgagatcagcgacgaggacgccatcgccaccctctcgacgatctggaagaaaaccctctacggcgtgtaaggagacagctgtggatttcaccctgcccgaacaccttccgggcgtgctcgccgagatggacgcgttcatcgaggacgagatcaagccgctggagcgcgagcacatccagtatttcgaccagcgccgcgagcatgcccgcaccgattgggacaacgacgggatccccacccgcgaatgggaggacctgctggccgagatgcgccggcgggccgaccgggcgggctggctgcggtacggattgcccgcgtcgctggggggtcgcgacggcagcaacgtcgacatggcggtcattcgggaacacctggcgcacaagggtcttggcctgcacaacgacctgcagaacgagtcgtcgatcgtcgggaacttcccgcaggtgatcatgatggagcggttcggcaccgacgaacagcgccgggagtggtcgcaggcgctgatcaccggggaacgttccatggcgttcggcctgaccgagccgcagcacggctcggacgccacctggcttcagacccgcgccgaacgcgacggtgacggctgggtgatcaacggcgccaagcgattcaacaccggcgtgcaccgcgccacccacgacctgatcttcgcccgcacctccggtgagcccggggccgcggtgggcatcaccgcgttcctggtgccgaccgaagcgcccggattcacggtgccctactactggtggacgttcaacatgcccaccgaccacggcgaggtcgagctgaccgatgtccgggtgcccgccgacgcggtgctcggtgaggtggaccgcggactcgaagtcgcgcaaaccttcctgcacgagaacaggattcggcaagcggccagcagcctgggtgccgcccagtactgcatcgaccgggccgccgaatacgccggcagccgaacggtgttcggcaaaccgctgtcggtcaaccaggccgtgcaatggccgctggccgaactgcagaccgaagcccagatggtgcggctgctcgtgcagtacgcggcctggcacctggaccgcgaccaccacatggaggtatccgacaaggtgtcgatggccaactaccgggccaaccggctggtctgcgacgccgccgaccgggccatgcagatcttcggcggcctcggctacagccggcacgaaccgttcgagcacatctaccgccatcaccgccgctaccggatcaccgagggcgccgaggagatccagatccgccgggtggcgcagcggctgttcaaattcggcaagaagtgatggacagcgacgcggccgaactgcgccccaaactggaaggggtgctggccaccgtgctcggtgccggcactgccgtcgagcagctgcgcacgctgaccggcggggccagcagaaccacctgggcgttcgacgccgtcaccggcgggcggcgccgcccgctgatcctgcgcaccggcccgcccgacgacgtgcacgccggcatggagctcgaagcccaggcgcaagccgccgccgcggccgccggcgccccggtcccccacatcctggtcgccgacaattcgcctgccgcactgggcaatccgttcctgatctgcgacgagatcaagggcgagaccatcgcgcggcgcatccagcgccggctcgacgccgccgacggccacgcggcccgggcccacctgctcgggcaatgcgcgcacgcggtggccgccatccaccgcgccgagatagaccggatccaggacccgggcctaaggcgccaagaccaactcaccgaatggcggcaacgcctcgacgacatgggcgacaccaccgccaccttcgaatgggcgtttcgctggctggccgcccgccggccccgtgcggcgccggcggtgttggcgcacggcgacttccggatgggcaatctcatcgtcgacggcgcccagcttgccgcggtgctggattgggagctggtgcatgtcggccaggcgtatgaggacctggcctggttctgcatccgcgcctggcgattcggcgccccggccggcttcggcgccggcggcctgggcagcatcgagagcttcctgcgtgcctacgagcaggccagcgcgacgaccgtggaccgggcggcgttccactggtggctggtgctggccacgctgcgctggggggtgatctgccgctaccaggcggagcggcacctgagcggcctgcaccgctcggtcgagctggccaccatcggccggcgcgtctgcgagaccgagtgggatctgctcaacctgctcgaaggggccgcctgatgatcggcccctatggccgcccgctggccgccgaactcgtcgccgccgtggccgaattcctggagaccgacgtgcgcgcggcgaccgaggggcaggtcaacttccacgcccgggtggccgccaacgcgttgcgcatcgtcgagcgtgaactgctcgacgagagcgaagcggaatcgcgtgccgccctggcagccttgggtttcgccgatgaggagcagctcgccgccgcgatacgcgccggggagatggacgggcgggccgacgacgtcatcgcctgcctgcgcgcgctggtgcgacgccggttggccgtcgcccatcccggctacgacaacgaatagcaaacagatcggaggggagcgggtgccatgaccgccagcggtgcgaaaaccgtcgtcgacacggccgaccggctgttcgccgccatcgagcgcggtgacgtgaccgcggtcgcggcgatgtggagcgacgacatcgcggtgtggcgggtcggctcccgccgcgacgacgacaaggcccgcgccgtgcgggtgatcgactggttcatcggcgcgaccgcccggcgccgctaccagatcctggaccggcagctgttcgacggcggcttcgtccagcagcacgtcttgcacgccaccgggcatggcgggcaagcgatctcgctgcgggtgtgcatcgtgatcagggtgggcgcgcacggcatgatcgagcgcatcgacgaatacttcgatcccgccgggatcgcgccgctgatgtgataggcgctagattcgccacgacagttgggggtgatcgatgacgaccttggagacactgctgcacgatccggagatggccggcgtgtggaacctggtgccggaccgctcggccatcactttcaggatcaagaacatgtgggggctgctgaccgtccggggccgcttcaccgacttcaccggtgacggccaactgaccggcaagggagcggttttcgggcgcgtcgacatccgggccgcgtcgctggacaccgggatcggccgccgcgaccagcacctgcgctcgcccgacttcttcgacgtcgaacgcttcgagaagatcagcgtggtggtcaccgggctgcagccgaccaagggcaaaatcgccgacctgcgcaccgacttcaccgtcaagggcgtcaccgcacaactgccgctgcccgtcacgatcctcgagctcgacgacggctcgatccggatcaccggcgaaaccacgctcgatcgcgcccgattcgacctgggctggaaccggttcggcatgatcggccgcaccgcgacggccgcggccgacgtcatcttcgtccgagattcgcaatagattcgcaatagatttgcgggcaccccgataaacccactgcggcaccagtagcatctgcagcgtgtcggactccacgccccaatccagcgtcgccctgcggatcctcgtctacagcagcaacgcccagacccgggaacgggtgatgcgggcactgggcaggcacctgcatcccgacctgcccgagctgagctacgtggaggtggccaccggcccgatggtggtcaagacgatggaccagggcggcatcgacctggccatcctggacggcgaggccaccccgaccggcggcatgggaatcgccaaacagctcaaggacgaactcgacacctgcccaccgctggtggtgctgaccgggcggcccgacgatgcctggctggcgtcctggtcgcgcgccgaagccgcggtgccgcatccgatcgaccccatcctgctcggccgcacggtgctgaacctgttgcgcaccccggttcgctgaccggatccacgcgtcctcgttgccgccggggcaatcgcccggccgcagtcccctgactttgcgctggacagcgcgagcacggcggcgtcaatactgcaaaacgcccaccccgggcaagcgcgccgcgcgccgcgacgctatgttgaagatcactgtgacggtcccgaaaccgggttcgtcacagcagcccggttaccgcctggccgctgcaggcggctcgcacgacggatcatggagcgagttgaacgtctacatacccatcctggtgctgggggcgatcgccaccgcctttgccgtgggctcggtggtgatcgcgagcctggccggcccgtcacgtttcaacaaatcgaagatggcggcctacgagtgcggcatcgagcccaccgaaacctcggtgagcggcccgcgcgccacggccggacagcggtttccggtgaagtactacctgaccgcgatgctgttcatcgtcttcgacatcgaaatcgtgttcctgtacccgtgggcggtcagctacgacgcgctgggcacgtttgctctgatcgagatggtggtcttcatgctcacggttttcgtggcctacgcctacgtgtggcgccgcggcggcctgacgtgggactgagggccgagaggggattgaggtaagcgtgggtcttgaggaacagctgcccggcgggatcctgttgtcgacggtcgagaaggtcgccggctacgtccgcaagaactcgctgtggccggcgacgttcgggttggcctgctgtgccatcgagatgatggcaaccgccgggccaagattcgacatcgcgcggttcggcatggagcggttctcggccactccccgccaggctgacctgatgatcgtcgccggtcgggtgagccagaagatggccccggtgctgcgccagatctacgaccagatggccgagccgaaatgggtgctggccatgggggtgtgcgcgtcatccggcgggatgttcaacaactacgcgatcgtgcagggcgtcgaccacgtcgtcccggtggacatctacctgcccggctgccccccgcgcccggaaatgctgttgtacgcaatcctcaagctgcacgagaagattcaacagatgccgctgggcgtcaaccgggaaaccgccatcgccgaagccgagcaggcggcgctgtcggcccggcccaccatcgagatgcgcggactgctgcgatgagctcgcccgaccaggacccccgcgaggcgatagcccagggcgacgacgaggtgatcgacgttcgtcgcggcatgttcggggccgccggcaccggcgacacgtccggctacgggcggctggtgcgcacggtcaccctgcccggcagcagcccgcgaccctacggcagctacttcgacgacgtcgtcgacacgttgaccgagtcgttgcagagcaacggcatcgaattccaccaggcgatcgagaaggtcgtggtgtaccgcgacgagctcaccctgcacgtcgaccgggccgcactgccgcacgtggcccagcaccttcgcgacgacccgcggctgcgtttcgagatgtgcctgggcgttagcggcgtgcactacccgcacgagacgggtcgcgaactgcacgccgtctatccgctgcaatccatcacgcacaaccgccgcgtccgcctggaagtggctgtgcccgacgaggatccgcacatcccgtcgctgtaccggatctatccgaccaccgactggcacgagcgcgagacctacgacttcttcggcatcgtcttcgacgggcacccgtcgctgacccgcatcgagatgccggacgactggcacgggcatccgcagcgcaaggactacccgctcggcgggatcccggtcgaatacaaaggcgcacagatacccccgcccgacgagcggagagcgtacaactgatgagcaccaccaccgaatcgacgcacgacggcgccggcgagactctcgtggtcgcgggcggccaggactgggacaaggtcgtcgaggctgcccgcagcgccgaccccggcgaacgcatcgtcgtcaacatgggaccccagcacccgtccacccacggggtgctgcggctgatcctggagatcgagggcgaaacggtcaccgaggcgcgttgcggaatcggctacctgcacaccggcatcgagaagaacctcgaataccggtactggacccagggtgtcacgttcgtgacccgaatggattatctctcaccgtttttcaacgagaccgcctactgcctgggcgtggagaagctgctcggcatcaccgaccagataccggagcgggtcaacgtcatccgggtgatgatgatggagctcaaccggatctcctcgcatctggtggccctggccaccggcggcatggagctgggcgcgatgacgccgatgttcgtcggcttccgcggccgcgaaatcgtgctcaccctgttcgagtcgatcaccgggctgcggatgaacagcgcctacatccggcccggcggcgtggcccaggacctgccgccgaatgcgaaaaccgaaatcgcccaggcgctcgaccagttgcgccaaccgctgcgcgaaatgggcgacctgctcaacgagaacgccatctggaaggcccgcacccaggacatcggctacctggacctgaccggctgcatggcgctgggcatcacggggccgatccttcgcgccaccgggctgccgcacgatctgcgcaagagcgaaccgtactgcggttatgaaaactacgaattcgacgtgatcaccgccgacacgtgtgatgcttacgggcgctacatgattcgcgtcaaggagatgtgggagtcgatcaagatcgtcgagcaatgtctggacaagttgcagccgggccccatcatggtcgagaacggaaagatcgcctggcccgccgatttgaaggtcggcccggacggcctgggtaactcgccggagcacatcgccaagatcatgggcggctcgatggaggccctgatccaccacttcaagctggtcaccgagggcatccgggtcccgccgggccaggtgtacacggcggtcgaatcgccgcgcggcgagctcggcgtgcacatggtcagcgacggcggcacccgcccctaccgggtgcactaccgcgacccgtcgttcaccaatctgcagtccgtcgccgcgatgtgcgagggcggcatggtcgccgacctgatcaccgcggtcgccagcatcgacccggtgatgggcggggtggaccgatgaccggcccacaggggcagccggtgttcctccggctcggcccgccgcccgacgagcccaacgcgttcgtggtcgagggcgcgcccacgtcctacccgcccgaggtgcgggcccggctcgaggtcgacgccaaggagatcatgggccgctaccccgacaaacgctcggcgctgctgccgctgctgcacctggtccagtcgcaggactcctacctgaccccggcggggctggagttctgcggcgagcagctgggtttgaccggggccgaggtgtcggcggtggccagcttctacaccatgtaccggcgcgggccgaccggtgactacctcgtcggggtgtgcacaaacacgttgtgcgccatcatgggtggcgacgccatcttcgatgcgctgaaggagcatctgggcatcgacaacgacgagaccacgcccgacgggtcggtcacgctgcaacacatcgaatgcaacgcggcctgcgactacgcgccggtggtgatggtcaactgggagttcttcgacaaccagacacccgagtcggcgcgcgaactcgtcgactcgctgcgcgccggtgagccccggcaccccacccgcggcgcgccgctgtgcgtcttccgggagacgtcgcgcatcctggccgggctgcccgacgagcgccccgaccaggggcagggcggcgccggcgcggcgaccctggccgggctgaaggtcgccaaggaacacggcatgcaggcaccgaacccggcggaaggccagcaatgacaacgacttcggagacttcggaggcctccggggccccgcaggcgacgccgctgacgccggtgatcagccgcttctgggacgatcccgagtcgtggacgctgcagacgtaccaccggcacggcggctacacggcgatgaagaaggcgctggcgatggagcccgacgcggtcatcgggatggtcaaggactccgggctgcgcgggcgcggcggcgcgggcttctcgaccggcaccaagtggtcgttcatcccgcagggcgacaccggcgcggccgccaagccgcactacctggtggtcaacgccgacgagtcggaacccggtacgtgcaaagacattccgttgatgctggccaccccgcacgtcctgatcgagggggtgatcatcgcggcgtatgcgatccgggccaaccacgcgttcatctatgtgcgcggcgaggtgctgccggtgctgcgccggctgcagaacgccgtcgccgaggcctacgccgccggctacctgggccgcgacatcgacggctccggcttcgatctggagctggtggtgcacgccggcgccggcgcctacatctgcggcgaggagaccgcgctgctggactcgctggagggccgccgcggccagccccggctgcggccgccgttcccggcggtggccgggctgtacggctgccccacggtgatcaacaacgtcgagaccatcgccagcgtgccgtccatcatcggcaacggcgtggactggttccgctcgatgggcagtgagaaatcgccgggtttcacgctgtattcgctgtccggccacgtcactcggcccggccagtacgaggcgccgctgggaatcacgttgcgcgagttgctcgattacgccggcggggtgcgggccgggcaccggctcaagttctggacccccggcggctcgtcgaccccgctgctgaccgacgaacacctcgacgtgccactggattacgagggcgtgggcggggtcggctcgatgctgggcaccaaggcgctggagatcttcgacgagaccacctgcgtggtgcgtgcggtgcgccgctggacctacttctacaagcacgagtcgtgcggcaagtgcacgccgtgccgcgagggcacgttctggctcgaccagatctacgaacggctggagaccggtaagggcacggccgaggacatcgacaagctgctggacatctccgacaccatcctgggaaagtcgttctgcgcgttgggcgatggcgccgccagcccggtgatgtcgtcgatcaagtacttccgcgacgagtacgtcgcccacgtcgagaacggcagatgcccgttcgacccgcgagactccatgctgacaccgaacgggagcgactcgtgacccaaactgcggacaccgaaggccgcgtgacccagccggagatggtgacgctgagcatcgacggcaacgagatcagcgtccccaaggggactctggtgatccgcgcggccgagttgatgggcatccagatcccccggttctgcgaccacccgctgctggagccggtcggggcgtgccggcagtgcctggtcgaggtcgaggggcagcgcaagccgatggcctcgtgcaccacggtcgcgaccgacgacatggtggtgcgcacccagctcacctccgaggccgccgacaaggcccagcacggcgtgatggagctgctgctgatcaaccatccgctggactgcccgatgtgcgacaagggcggcgaatgcccgctgcagaaccaggcaatgtccaacggccgcagcgattctcgcttcaccgacgtcaagcgcaccttcgccaagccgatcaacatctccgcgcaggtgctgctggaccgggagcgctgcatcctgtgcgcccgctgcacccggttctccgagcagatcgccggcgacccgttcatcgacatgcaggagcgcggcgcgctgcagcaggtcggcatctacgccaacgaaccgttcgactcctacttctcgggcaacaccgtgcagatctgcccggtgggggcgctcaccggcaccgcctaccggttccgggcccgccccttcgacctggtgtccagccccagcgtctgcgagcactgcgcgtccgggtgcgcccagcgcaccgaccaccgccgcggcaaggtgctgcgccgactggccggcgacgacccggaggtcaacgaggagtggaactgcgacaagggccggtgggcgttcagctacgccacccagcccgacgtgatcaccactcccctggtccgcgacgccgacggttcgctgcaaccggcctcctggtcgcacgcgatcgccgccgcgacccgggggctggaatccgcgctgggcaacaccggggtgctggtcggcggtcgggccacctgggaggacgcctacgcgtactcgaaattcgcccgaatcgtgttgggcagcaacgacatcgactttcgggcccggccgagctcggccgaggagaccgactttctggccgcccggatcgccggccggccgatcaccgtcagctactccgacctggagtccgcaccggtggtgctgctggccgggttcgagcccgaagacgagtcgccgatcgtgttcctgcggctgcgcaaggcggcccgcaagcacggggtgccggtgtacgcggtggcgccgttcgccacccgctcgctgaccaagatgtcgggtcggctgatcaaaaccgcgcccggcgccgaggcctcggcgttggaccggctggccaccggcgaagtgggcgacctgctgtccaccccgggcgcggtcatcatggtcggcgaacggctggccacggcgccgggcggactgtccgccgccgcccggctggccgacaccaccggcgcccggctggtctgggttccgcggcgcgccggcgatcgcggcgccctggaggccggggcgctgcccgggctgctgcccggcggccggcccgtcgctgacgacgacgcccgcgcgcagatcgcgtcggcctggaacgtgtccgaattgccttgcggccctgggcgtgacgtgcaggagatgctggccgccgccgccgccggcacgctgggcgcactgctggtcggcggtgtggacccggacgacttcgccgatccgcaggcggtgctggcggcgctggacggggtgggcttcgtggtcagcctggagctgcggcacagcgccgtcacgcagcgcgccgacgtggtgttcccggtcgcgccgaccacccagaaggcgggtgccttcgtcaactgggagggccggttccgcccgttccaggccgcgctgcgcggcagcatgacgcaggccggccaatccgatcaccaggtgctcgacactttggccgacgagctgggcgtctacctggggacggcgaccgtcgaggagatccgcaccgaatacgccgcgctgccctactgggagggcaaacgcgcggccggcccggacgtcgcggccgccgagccggcgccgcccggggcgggtgaagcggtgctgaccggttggcggatgctgctggacaacggtcgcatgcaagacggcgaaccgcatctggccggcacggcgcgccagcccgtgctgcggctgtcggccgacaccgccgccgagatcggcgccgccgacggcgatgcggtcaccgtgagcacgccgcgcggatcgatcagcctgccgctggtgatcaccgacatgcccgacccgggtggtgtggctgccgctgaactcctccggctcggcggtgcaccgccagctcggcgtcaccgtcggcgccacggtgcggattggagttggctcgtgacgacccccactgaccgccttcgggcacgacccctggtggctggtgctgggcaaggcgctggccatcttcgtgttcctcatgctcaacgtgctggtcgcgatcctgctcgaacgcaagatcctcggctggatgcagctgcggcccggccccaaccgggtgggcccgtggggtgtgctgcagagcctggccgacggaatcaagttggcgctcaaggaaaccatcaccccgggcggtgtcgacaaattcgtctacttcgcggcgccggtcatctcgaccatccccgccttcaccgcgttcgcgttcatcccgttcggcccggtggtgtcggtgttcggccaccgcaccccgcttcagctcaccgacctgccggtcgcggtgctgttcatcctgggcctgtcggcgatcggggtgtacggaatcgtgttgggcggctgggcatccggctcaacctacccgctgctgggcggggtgcgctccaccgcgcaggtgatctcctacgaggtggcgatggggttgtcgttcgcggcggtgttcctctacgccggctccatgtccacctcgcagatcgtggccgcccaggaccgggtctggttcgtgttcctgctgctgccgtcgttcgtgatctacctgatctcgatggtcggtgaaaccaaccgggcgcctttcgatttgcccgaggccgagggcgagctggtggccgggttccacaccgagtactcgtcgctgaagttcgccatgttcatgctggccgagtacgtcaacatgatgacggtgtcgtcactggccaccgcgttgttcttcggcggctggcatgcgccgtggccgctgaacatgtgggcgggcgccaacaccggctggtggccggtgctgtggttcaccgcgaagatgtggaccttcctgttcatctacttctggctgcgggccagcctgccgcggctgcgctacgaccagttcatggggctgggctggaagctgctgatccccgcctcgttggtgtgggtgctgatcgcggcggtgatccgcacgctgcagaaccaggggtacgcgcactggacgccgatcctggtgatctccagcatcgtgttcgccgccgccctggtgctctcgctgcgaaaaccgttcaccacgccgcatattcgcgcgctgcgacggcagctgcgccggaaggccaagcagctgcccaccgcgccggattccaccccggtattcccgacaccgccgctgccggcgaaagcgctggcggccgcgagtaaggagaaagcacgtggctaaattcttggacgcggtcgccggattcggcgtgacgttcgcgtcgatgttcaaaaagcatgtcaccgaggagtatccggagaagccgggcccggtcgcgccgcgctaccacggccgtcaccagctcaaccgttaccccgacgggctggagaagtgcatcggctgcgagctgtgcgcgtgggcctgcccggccgacgcgatctacgtcgagggcgccgacaacaccgaggaactgcggtattcgcccggggaacgctacggccgggtgtaccagatcaactacctgcgctgcatcggctgcgggctgtgcgtcgaggcctgcccgacccgggcgctgacgatgaccaacgactacgagatggccgacgacaaccgcgccgacctgatctacgagaaggaccggctgctggccccgctgctgcccgagatgaccgcgccgccgcatccccgcgcccccggcgccaccgataaggactactacctgggcaatgtgaccgcgcacgggctgcgggaggcccagcgggccggggagccgcggtgagtgccttcgccggccacgccgtcgccgccacgctggcctccagctattcccaggacaccatcgtccgcacatccaccggcgaggcagtgacgttctgggtgctgggcgcgctggccgtgatcggtgcgctcggggtggtgctggccgtcaacgccgtctactcggccatgttcctggccatgacgatgatcatcctggcggtgttctacatgatccaggacgcgctgtttttgggcgtcgtccaggtcgtggtctacaccggcgcggtgatgatgctgttcctgttcgtgctgatgctcatcggcgtcgactcggccgaatcgctcagggagacgctgcgcggccagcgcgtcgccgcggtggccgccggtgtcgggttcggcatcctgctcatcgccgcggtcggcaacgtggccagcggcgggttcgccgggctgaccaccgccaacgccaacggcaacgtggaagggcttgccgccctgatcttttcccgctacctgtgggccttcgagctgaccagcgcgctgctgatcaccgcggccgtcggggccatggtgctggcgcaccgggagcgtttcgagcgccgcaagacccagcgcgaactgtcccaggagcgtttccgggccggcgggcaccccaccccgctgcccaaccccggtgtctacgcccgccacaacgccgtcgacgtggccgccctgttgccggacggctcgtattcgaagctgtcggtgtcgcccatcctgcaaagccgcggcggcgacggcaaggacgtcgccgcaccggagcccagcccgagtctgtcgcaaggcggtgcgtcgtgaatcccatcaactacctgtatctctcggcgctgctgttcaccatcggggcggccggtgtgttgttgcgccgcaacgccatcgtgatgttcatgtgcgtcgagctgatgctcaacgcggtcaacctggcgttcgtcacgttcgcccggatgcacggccacctggacgggcagatgatcgcgttcttcacgatggtggtcgccgcctgcgaggtggtcatcggcctggccatcatcatgaccattttccgtacccgcaaatcggcgtccgtcgacgacgcgaacctactcaaaggctgagcacgccaacatgactcactacactccgctgctggtggcgctgccgctggcgggtgccgcgatcctgttgttcggcgggcgacgcaccgaccggtgggggcattggctgggttgcgccaccgccgtggcggcgttcgtggtcggcgtgggcctgctggatgagttgctcggccgtcccgccgaccagcgcgccatccacgaaagggtgttcagctggatccaggtcggccaactgcaggtggacctggggttgcagatcgaccagctgtcggtgtgtttcgtgttgctgatcaccggggtggggtcgctgatccacatctactcggtggcctacatggccgaagatgccgaccgccgaaggtttttcggctacctcaacctgttcctggcgtccatgctgctgctggtgatcgccgacaactacgtggtgctctacgtcggctgggagggcgtgggcctggcgtcctatctgctgatcgggttctggtaccacaagccgacggcggccaccgcggccaagaaggcgttcgtgatgaaccgggtcggcgacgccgggctggcattgggaatgttcttgatgttcagcactttcgggacgctgtcctacgccggggtgttcgcgggggcgccggcggccggtcggggcgcgctgaccgcgatgggtctgctgctgctgctgggggcctgcgccaaatccgcgcaggtgccgctgcaggcctggctgggcgacgccatggagggccccaccccggtgtccgcgctgatccacgccgccaccatggtgaccgcgggcgtgtacctgatcgtgcggtccaacccgctgtacaacctgtcgccggatgcgcaactggcggtggtgatcgtgggtgcggtcaccttgctgctgggtgctttcatcggctgcgccaaggacgacatcaaacgggcgctggcggcttcgacgatgagccagatcggctacatggtgctggccgcggggttgggcccgaccggctacgcgttcgcgatcatgcatctgctgacccacgggttcttcaaagccggcctgttcctcggctccggcgcggtgatccacgcgatgcacgaggagcaggacatgcggcgctacggcgggctgcgggccgcgctgccggtcacgttcgtcaccttcgggttgggctacctggccatcatcggggtgccgccgttcgcgggcttcttctccaaggacgccatcatcgaggccgcgctggccgccggcggcggccgcgggtacctgctcggcggggcggcgctgctgggcgccggcgtcaccgcgttctacatgacccgggtgatgctgatgaccttcttcggcgaaaagcgttgggccccaggcagccatccgcacgaggcgccggggctgatgacctggccgatgatcctgctggccatcgggtcgctgttctccggcggactgttcgcggtgggcggcacgctgcagcgctggctggagccggtggtcggcaggcacgaagaggtgactcacgccgtcccggtgtggatcagcaccgcgctggcgctgggcgtcgtggccatcggcatcgcggtggcctaccggctctacgccaccgcgcccatccccagggtggcgccgttgtcggtgtcgccgctgaccacggcggtccgtaacgacttctacggcgatgccttcaacgaggaggtgttcatgcgccccggcgcgcaactgacccacgcgctcgtcgaggtcgacgacgcgggcgtcgacggctcggtcaacgcactggcggcgttggtgagcgcgacgtcgaatcgcttgcggggcctgcaaaccggcttcgcccgcaactatgccctgtcgatgctgaccggcgccgtgctggtgatcgcgctgatcctggcggtgcggctgtggtgaatcacctgccctggctgagcatcctgtggctggtgccgctggccggctcggtactgatcatcctgatgccgcccgggctgcggcagctcgccaagtggaccggcctggtgttcggggtgctgaccctggcggtggcgatcgtggtcaccgccggcttcaaaaccggcggcgccccctatcagttcgtcgaaaaacaccagtggatcccggctttcggcgccggctacacgctgggcgtggacggcatcgcggtggtgctggtgctgctgaccgcggtgctgatcccggtgctgcaggtggccggctggaacgacggcggcgatcggcagcgcggcgtgcacgcctacgtcgccctgacgctggccatcgagtcgatggtgctggtctcggtgatcgccctggacgtgttgctgttctacgtgttcttcgaggcgatgctcatcccgatgtacttcctgatcggcggcttcggcgccggatcgggcaggtcgcgcgcggcggtgaagttcttgctgtacaacctgttcggcgggctcatcatgctggccgcggtgatcgggctgtacgtggtgacttcccagcacggggccggcaccttcgacttccgcgacatcgtggccggggtggcctccggccggtacggcgccgacccggcggtgtccaaggcgctgttcctcggcttcatgttcgcgttcgcgatcaaggcgccgctgtggcctttccaccgctggctgcccgacgccgcggtcgaggcgacgccggcgaccgcggtgctgatgatggcggtgatggacaaggtcggcacgttcggcatgctgcgctactgcctgcagctgttcccggacgccgcaacgtatttccgcccgctgatcgtggtgctggcggtcatcggggtgatctacggggcgatcgtcgcgatcggtcaggccgatgtcatgcggctgatcgcctacacctcgatctcgcacttcgggttcatcatcctgggcatcttcgtgatgaccagccagggccagagcggctcgacgctctacatgctcaaccacggcctgtccaccgcggcggtgttcctgatcgccgggttcctgatatcgcggcacggcggcagtcgggccatcgtcgactacggcggcgtgcagaaggtggcgccggtgctggccggcaccttcctggtttcggccatggccaccctctcgctgcccggtctggcgccgttcgtcagcgaattcctggtcctgctgggcactttcaaccgatattggctggcggccgcgttcggggtcaccgcgctggtgctctccgcggtgtacatgttgtggctctaccagcgcatgatgaccggaccggtggccggcggcaacgagaagatcggcgatctgcgggcccgggagttggtcgtggtggcgccgctgatcgcgctgctgctggtgctcggcatctatcccaagccggtgctcgacatcatcaaccccgccgtcgagaacaccatgaccaccatcggtcagcacgaccccgctccgagcgtgccgatgggcacgccgcggacagccgaaggacggcgatgatgaccctgcccaccccgagcatccagtacttcctgctgtgcccgacgctgatcgtgttcggcgtcgccgtggccggtgttctggcggaagcgttcctgcccaggcggattcgctacaccgcccaggtgacgctggctctgggcggtctggtcgccgcactgttcgccgtgatcgaggtggccgagtccctcccggcctccgggcgggccgcggtgctgggcgccatggccatcgaccgcccgacgctgtacctgcagggcaccgtgctgctggtcgcggtgatggcggtgatcttcatcgccgaacgcacccagaccaagtcggacagcaaggttgcggtggtggcgggatctggcggcctggactcgttcaccccgcaggcctcggcggtgcccgacagcgacgccgagcgggaggccgagcgcgccggcgcggcccagaccgagctgttcccgctggccatgctgtcggtcggcggcatgatggtcttccccgcgtccaacgatctgctgactatgttcgtcgcgctggaagtgctgtcgctgccgctgtatctgatgtgcggcctggcccggcaccggcggctgctgtcgcaggaagcggccatgaaatactttctgctgggcgccttttcgtccgcgttcttcctctacggtgtggcgctgctctacggtgcgaccggcaccctgctgctgaccggtatccgcgacgcgctcatcacccgcggtgacacctcgttggccctggtgggcgtcgcgctgctgtcggtcggactgctgttcaaggtcggcgcggtcccgttccactcctggatacccgacgtgtatcagggtgcgcccacgccgatcaccgggttcatggcggcggccaccaaggtcgcggctttcggtgccctgctgcgggtggtctacgtcgcgctgccgccgctgcacgatcagtggcgtccggtgctttggaccatctcgatcctgaccatggcggtgggcaccatcaccgcggtgaatcagggcgacgtcaaacggatgctggcgtattcgtcggtcgcccacgtcgggttcatcctgaccggagtgatcgccgacaaccacaccggcctgtcggccaccctgttctacctgctggcctacagcttctccaccgtcggcgcgttcgccatcgtcggcctgatccgcgacgccgacggggtcgaggacgccaccctctcgcactgggcggcgctgggtcagcgctctcccattgtgggcgtgatgttttcgatgttcttgctggcgttcgccgggatcccgttgaccagtggcttcgtcagcaagctggccgtgttcaaggccgccgcccagggcggcgccgtgcccctggtgatcgtcggtgtggtcgccagcggggtcgccgcctacttctacgtgcgggtgatcgtgtcgatgttcttcaccgaggccaccgaggataccccgcacgtggtggcgccgggcatcttgagcaaggccgcgatcgcggtgtgcgccgcggtcaccgtggcgctgggcgtcttcccgcagccgctgctcgacctggccgaccaggcggcccagctgctgcactgagtcggccggcgaggtcgtcgcgggcagacttggcctgctcgggcgtcagcagcggattcgaatagatgtcgaccaggatggccgcgacccgcagatcgccctgctctgtgctgatgtccacgcccaggccgcgcgagatgtgttgccgcagcagcggtatggcaagagccatcgcggtgatgagggtggcgcgcgacttggcgtcgacatcggcgggctcggcccgatgttcatcggccgaggcaagccattcctcggtcatcgacaccagcgcgtcgaacaactcaccggcgccgccctcaaccagggcgcgggtgatgtagtcctggtgttggccgaggggaatacgggctgaaacgtagtgcacgtcaccacgtttggcgttgtcctgcacctgggcgttgaggtcgcgcatggttttgacgaggtagtcgtcgcaggcttgacgaagctcctgcttggagccgaagtggtgccgcagcagcccggacgacacccctgccgccgcggcgatgctacgaatggtcgccccttcgtatcccttttcgccgaactcgcgcagcgccgcgtgcctgatgcgggcgcgggcggtgagatcgtcgggatctgtcgtggtcattgcgtcagactatacgattggacaataaactacacagatgtatagtcggggcaaaccggagttcagggaggcacggatatgggaattgacaccagcgccatcaccccggaggaagagaccgcatttttgacgttgcaggcccgcgcgatcaacaacgggtgggcacgccccatcctgcccgacccgggcgccgccgatgccgtgacaaagatcgactacgacttcgacggcctggggctcgtgacgcccgtcgtttgtcaaacatccctgcgcgcaaaacttctcgacgaccgggtgcgcgcgttcatcgcccaacacgccgatgccgtggtggtcgatctgggcgccgggctcgacgacgggtacgcccgtgtcaagccgccggacaccgtcgactggtacagcgtcgagctgcccgggctggcggccctgcgcgacaaggtgatgccaccgggacctcacgaacacaccatcggaatctccgtgaccgatcccgagtggatatcggcgattccggcggaccgccccgccatcgtcatcgccgacggattgttccccttcctcaacaaggagcagatcatcgcggtgatgcgcgcgatcaccgatcacttccccgccggacagctggcgttcaacgactacggacgcatggtgattggcgtgtggatctcgaagttgttcccgcagcggatgttcaagaaggtgaaccagctccgtgcgttcgagggttacaacgacccgcacacgccggaacgctggaaccccaaactcaccctcgtcgaggagaccagcctggcgagtgtgcccgaggtggacctgttcccgacgtggttgcggatcgcgacacggatggccgggtggagcaagcggacggcacggtccgcgcgcatcctcaggttcagcttttagcgccttccgcgcgtcgggggtgccgctccggtcgcgtcgtgcggccggcgccggcggtcagctcaggaacggccggatggccagcaggtagatcgccagcgcccccagcggggcaagcagcggcagccacggcagctgcagcggaaacgacgtcgccaccagaccggcgaagctaaaccccacggccgcaacggcggtcgtgcggctgcccaggatcaccgggacgggggtgccgaccgcgtgtcggcacaccaggtaggcggtggcgcacaacccggacagcgcgacgcacgccggcgggggttcgacgtcacgacggtcacggccgccagcagcacggcaatggttgcggcgggccgcaatacggtgcccgccgcgaccgcgatcagggccgcggccgccgcgacggccgccgattccggccggccgccggcggccaatcccaccatgagcagaccgaacccgggcgcgcccacccgcgccggcagattggttcggccgctatccacgcagcctcccccggacccggcggcggcgatcgggcagtacacccatcgactgttccaaaccgcggtcccccggccaccacacgatgtccacgccgacggtggccatgtcgcggtacatcgccgagcgctgcagcgcccacatccgatccaccagcggatcctgttcgtcctcgaacggcgaaccctcgaggatgtcgaccgccagcacgacgtggccgcgccggcgcagatcgatgagggcgagggcgaattcggtgtcgagcagggtggagaacgcgatgacgatggccccggcgggaaccgccgcgcgcggcgccaaggtgccggtggtgtgctcgaatccggcgccggcggccagcacggtgtcgagcacccggtagaactggcgctgcccgatatcggcgccgagccatcgcgggcggttgccgcccagggcgacgatcccggcccgatcaccgtgccgcagcgcggtttgcaccacctgcgccgcgccccgcacgatccgctcagtggccagcgtcgccggacccgccggctgccggtatccgtcgatcagcaccaccacgtcggccgcgcggtcggtcagccgctgggtgacgtgcagctggcggcggcgcgcgctcaccgcccaattcactgcgcgcagttggtctccgggcacataggggcgtatgtcggcgtattccacgccgggcccgacatgccgggtcaggtgggcgcccagccgatccagcagctcggtgcgcgggatcggcgtcggctgcggcggcgtcagcggaaacacgatcacctcggcggcgtccaccagcgcggtcccgctcaacaacccgccgcgggccagcacgtccacccgcgccgcgacgtggtagcggccccagcgctgcgcggtggcccgcacggttttgccgtggcccgaaccggattcgccacctgcagttccattccctcgacgggcggaaccgtcagccggaccgcgcacgggccctgctcttcgatcccccacaccgtcacgtgcgccgcctcgccctcgaagcagcgctgcgtgtcgggttcggcgtgcagggcgaccgccggcacccgtggctgccagctgatcgtgcccagcaccccgagcagcggcgcggcgaaggcgatcagctgccaccgggcgccgatcacggccgcggccaacgcgaacgccgcgcaggtggccatcgcccgcgtcaattccgaagcgcgccagcggaactcggctgcacggggtgcggtcacgccgcgctcatccggtttgcccgggcccggcgccggtacggggcaccgggagccggtgcagcagctcgccgatcacgtcggcgccctggatcttgcgcacccacatctccgggcgcagggtgatccggtgcgcgacggccgcggtggccagggccttgacgtcctcggggatcacgtagtcgcggccgagcagcagcgcccgggcgcgggccagctgcaccaggtccagttcggcgcgcgggctggcgcccaccgcgacctgcgggtggtgccgggtggcgttggccagcgagaccacatagtgcagcacgtcctcgtgcaccgtcacctgctcgaccgattcgcgcatcgccagcaggtcgtgcgcgtcgacgacctggttgaccgccggttcggccgatccgcgttccaggcgccggcgcagcatcgaggtctcgtcacgttcggacaggtagcgcagctccagcctgatcgcgaaccggtccagctgcgcctcgggcagcgggtaggtgccctcgtactcgatcgggttgtcggtggccagcacgatgaaaggctttggcagccggtgtgtttcgccgtcgatgctgacctggccttcggccatcgcctccagcagcgccgcctgcgtcttcggcggggtgcggttgatctcgtcggccagcaacaggttggtgaagatgggcccggcccggaacgcgaagcggcccgactgcatgtcgtagatcgtcgagccgagcaggtcggcgggtagcaggtcgggggtgaattgcacgcgggtgaattgcaggcccagcgcggcggcgaaggaccgcgcgatcagcgtcttgcccagtcccggcaggtcttcgatgaggatgtggccgcgggccagaaccgcggtgaggatcagccgcagcgcgttgcgtttgcccaccaccacgcgttctatctcgtcgagaatcgcctcgcagtgtgccgtcgtggttgcggccggcagagtcatggtcggatcgcgccccctgtcatacctgctccagctttcgcagaatctcttccagcgccgcgcgtcccgggccgggttgacgcccaccggtgcgggtgacgttgttggggttgacccactcccacagttcggcgccgaagagcatctgcccggtcgcctggaaggacgccgggtccttggcttgccgttggccggttgcgatcgcgtagcggcgggcgagcatcgggcgcaggtgccggtcccagtcggcccgggtggactccgaccaccggatcgtcgtctcggtggccgcaagccagcggcgcagtgaatcgccgagatcgtcggcgtcgtgcttggattcgcgttcggcgccgcggccgagcgcacgccgcaggctgagcagcaccagggccagcccgacgccggaggccgtcagcaccagccggcggtcgtgctgggtcagcgccagcagctcgatcccgatgatcaagcaaagacccagggccacagtctttttcatgcgacactccggctccccagttcgtcgagcaccagccgcaacacccgcaccgccacgtcgcggtggccctcgttcatcacgtgcgggctgaaccgcgcctcggtgaacaggttcaccagctggacggcgttgtcggcgtgcagcgcatggtgttccaccgcgcgggccagcacctcgctgggggtgtcgaagtcctgcggcacggcgccgggaacgtgcgccagttcgcgttccatcgcggcgtagcaggcgatgatggcctcgcgcgggtcgcggcgcaggtcggccatctcggccaacccgcgttcggccgcacgcgccagcgactccgaatgtggttgcggcgccgggttttcggccggttcgtcggggacggccggcgccggcgaccgccaccggcgccgcgcgccggccaccgctgaggcgacgaccatcaacagcatcgcgaccgtgccggcgagcaggatgcccaacgtgtcctgcgacccgtcgcgcgggcgctgcgggtgctgcggcggcggcgccgggggtgccgccgggtgcggtggcggcgacgcaccggtgccgggcggcggggcgggcgagagcccgtgcgacgcgaacagccgggccagcagcatcacgatcagcagccaggccacgatcacgccgagcccgatcagcaacacccgccaggtcgggcggcccctgccggcgcccagcgtctccgacagcgcgccggcgggcggagccggcgcccgcgggtccttcaaccgcgcgacgatcgcgaccgcgatcagcgccagcgtcaccgcgaggatggccaccaccaggcccagcgccgcccggccgcccgcctcgctgcgcgtcgcgtcgtgttgggcgggcaggtacccgcgcagggcggcgaccacgagcaacagaacgatcagggcgacgacccgccccgtcggcttgtccatcccgggcatcggcacaccactcgaccggttgcctgccgctggtgcggcactggctttgcccatacttgcacgtcaggcggtcccggggccagaaccgcccgcaccgcttatgcacagttggcggttcatccacagattggccgccgaccgatactgttcgaacatttgttctatacggtggtggcgtgggcgttttcctgtcatcggaacaggcgcggcagcgcatcggcgccgcgctcgacgcgatcgacgctgcccacgacgtgctgcggcagacctcgtcggatctggtcggcactggctttcggatcgacgtcgccgaacgactcgaaacccaggaccgcaccaatcggggcctgatgtaccgcttcttcggcgaaatcgccgaccctcccgacgaggccgggtcgttgccggtggcgcgctccatgctatgggcgcggctgcgcgtcagcccgggagaactccggcgccgcttcgcgctcgcggcccgcatccgaccgcgccgttcgctgaccggcccgccgctggaccccgagctgccggcattggcggcggcggtcgccgcgggcgcggtcggcgaggaccacatccgggcggtgtgcgccgcggtcgatgccttgccctgtgcggtcccccgctccgccacgtcggacgctgagcgcacgctggtacggcatgcggccaaactcgatgccgccgtgatcaccaagctgggccggcgaatcgccgactatctcaatcccgacggcgagttcagcgacgtcgatcgcgcccgccgccgcggtctgcacctggggccgcagggcgtcgacgggatgtcgcggctgtccgggctgctgggtcccgagacccgcgcctacttcgaggccgtcgcatcggcggtgcggcccggccgtcaccaacccgaaggcggcggcgatccgcgggcacgcgatgagcgcacgccgtcgcagcgttgccacgacgcgctcaagctcggcctggaagtcgccatcgcctcgggcggtctcggcgtgcatcgcggccatccggtcaccgtgatcgccagcaccacgctggccgagctcgaccaggccgcgcgcgcggtggccgacccgtcgattccgatgccggcgccggcgctgacgggcggcggttcacgattgccgatgccggacatgattcgcatggcagccaaggcaattcactatctggcggtgttcgacgagcacaccggccggcccttgtatctggggcggcagaagcgcgtcgcgaccgcggatcagcggctcatctgttatgcccgtgaccgcggctgcacccgacccaattgccttgaacccggttaccgctgcgaagtgcatcatgcgccggactgggcggacggcggcgggaccgacgcggacaagctgtttttcgcctgcggtcccgaccatggcgcggtcagccggggcgagtggcgcaccagtgtcggcgacgatgggcgattggcctggaccgacggcaacgggccaccccagatcaaccgggcacaccatcccgacgagctgctgcgcggcgatcccgacccgcccgaaaacgattgacggacgcggcgatcggccgtcaagccggtgtcggccctcggacgaagggattgccggagtttttccggtggtcgttttggtgccgatccgccgggtagccgacgggagtccatccaatcgacattgggggaaacacatatggacgaccgaaagattcaccttgtgatcgcgcgccgcccactggcagcgctcggcgccggtgtggctgcgctggctgtcagcggagcactcggcgcgggggtcgcgtcggcaaccatgtccgacgcgatgccgggcaccgcaaccggccccgcggtgaacttcctgccgaacaacccgccgccacccgggccacctggaccgcccggtcctcccgggccgcccggacctccaggagcgccgggcgctccgggcgcggtggggccacccggcgggccaggggcggtaggacctcccggcgggccgggggcggtaggacctcccggtgggccgggggcggtaggacctcccggtgggccgggcgcacccggcgctccggggccggtgggtccgcccggcgggccgggcgcacctggcgcaccgggacctgccgggcctccgggtcgctaaacccgtgagccgcggtgggggacggtgcaacgcctcccccgccgcggtgatgcgggccagaagaacctaaagccgccagaacctagtccaagccgaaggggcggaagctgccgtccagcacctgcaggtgaccgatggtgcgtccggtgaccctgccgggatctaccagcgccaattccactgcggcccgggcgaattcgtccgccgacgcggtgtcgtcgaaatcgcgggcgtagtaggaaagccccggcgtgaggatcggtttcgacggcgacagcgcattgaccgcgatgcgatggtcggcgagatcgtatgccacacactgggtcaggtgttcgagcgcggccttggacccgccgtacccgggcagcaccccgccgctgcgatcggcgtacgggccgtcacccggcagccgggaggcgaccgaggtgatgttgatgatcgctccgccgcccgccccgatcatgtccgggcacaccctctgcatcagttcgtaggcggcgaagacggcgatgtcgaaatgccgccggtaggcgtgcagcggcgtgctgacgaagcccggccagcccggtttggcgccgcccgacgccggtttggcgccgcccgacgctggtttggcgccgccggccgccggtttggcgcgcgcctcaccaccgggcgccggcggtctgccgggcgcggtgaaggccgcattattgaccagaatcgtgatggggcccaacgcctctcgagccgaatccaccagccgcgcgacgtcgtcgcggtcggtcagatcggcccgcaccggcaccgcgcgcccaccggcggcctcgatgtcggcgaccgtggacccgatggtgcccggcaaccggtcgtcccagacttgctcggtccgcccggctaccgccaccgcggcgccctcgctcgccagggccagcgcgatggcccggcccaggccgcggctggcgccggtgacgatcgcggcgcggccggtcagccgccccgtcaccgccgcaccccgtgcaccacgatcgccgtcgtctgctccacccacgcgtcgtcgagttcctcctccgggcgcagcagcatccgcagcatcgtcgctcccccgatcaactcgatcaaccggtccggatccacgtcgcgatgcgcctcgccgcggtccaccgcctcgcgcaaccgcacccgcaccgcggtgaacaggtccgcgaaccgcgacatcacccgggcgttgagcgcgggatcggccgtcatgtcggccaccaggccgggcagcgcggcgcgcaccacgggcgtggtgaacacgtcgcgcgtggcctcgatcatcatccgcatgtcggcggcgatgtcaccggccggcgcctccagcgcggtcggggccgtcgggaaggccgcctcgtgcaccagttcggccttgctcgaccagcgccggtacagcgccgatttggtggtgccggcacgctcggcgaccgccgccagactgatattcgaatagcccgtttggacaagcagttccgcggtcgccgataggatggccgagtcgatgcgcggatcgcgggggcggccggcgccgggggccttgtcaaggccggacgggtctgctttcataacgctacctaccgtatcgtaattgccgcgaaaaagtctcaaggaatggaggcacccgtggctacagaaccggcggtcgacagcgtcgaccggctgcagcgctcgagccgtgacgtcaccaccgtgccggcggtgatgtcacgctggctttccaccgtactgccggacggcgccgaacccgaggtgacggtggaaagcggcgtggattcgacgggcatgtcgtcggagaccatcatcctgaccgcccggtggcggcaggacgaacgcccgaccgagcagaagctggtggcgcgggtggccccgaccgccgaggacgtccaggtcttcccgacctaccggctcgaccaccaattcgaggtgatcagcaaggtcggtgagctgaccgacgtgccggtgccccgggtgcgctggctggagaacaccggcgaggtgctcggcaccccattcttcgtgatggactacgtcgacgggctggtgccgcccgacgtcatgccctacacgttcggcggcaactggttcgccgacgcgcccgccgagcggcagcgcgaactgcaggacgccaccgtcggcgtgctggccaagctgcactcgattcccaacgcggcgaacaccttcggcttcctcaccgaggggcagaccggtgacacggcgctgcgccggcacttcaactgggtgcggtcctggtatgacttcgcggtgcccgacatcggccggtcgccgctgctggagcgcaccttcgactggctggaggcgcactggccggccgcggcggacgccgccgagccggtgctgctgtggggcgacgcccgggtgggcaatgtgttgtaccgcgacttcgtcccggttgcggtgctggactgggagatggtgaccctggggccgcgcgagctcgacgtggcgtggatgatcttcgcgcacatggtttttcaggagctcgccggtctggccacgctgcccggcctgcccggggtgatgcgcgaggacgacgtgcgcgccacctatgaacggctgaccggcgtcgagatcggggacctgcactggttttacgtgtactccggggtgatgtgggcgtgcgtgttcatgcgcaccggcgcgcgccgggtgcatttcggcgagaccgaaaaacccgacgacgtcgaatcgctgttttaccacgcgggattgatgaaaagacttataggagaagagtgatgctcggaccgctcgacgaatacccggtacatcagatcccgcagcccatcgcgtggccgggctcctcggaccgcaacttctacgaccgctcctacttcaacgcccacgaccgaaccgggaacatcttcgtcatcagcggcatcggctactaccccaacctcggggtcaaggacgcgttcttcctcgtccggcgcggggacacccagaccgcggtgcacctgtgcgacgccatcgaccaggaccggctcaaccagcacgtcaacggctaccggatcgaggtgaaagagccgctgcgcaagctgcgtctggtgctcgacgaaaccgaaggcgtggcagccgatctcacctgggaggggctgttcgacgtggtgcaggagcagccgcacatcctgcgttcgggcaaccgggtgacgctggacgcgcagcgcttcgcccagctgggcagctggagcgggcgcatcgtcatcgacggccaggagatcgcggtcgaacccgcgacctggatcggcagccgcgaccggtcctggggcatccggccgatcggggagcccgagccggccggccggcccgccgacccgccgttcgagggcatgtggtggctgtacgtcccgatggcgttcgacgacttcgcgatcgtgctgatcatccaggagcagcccgacgggttccgctcgctcaacgactgcacccgggtctggcgcgacggccgggtggagcagctgggctggccgcgggtcaagatccactaccgctccggcacccgcatcccgaccggcgcgaccatcgaggccagcgcccccgacggcacgccggtgcacttcgacgtggagtccaagctgccggtgccgatccacgtcggcggcggctacggcggcgactcggactggctgcacggcatgtggaagggcgagaagttcaccgagcggctgacctacgacatgaccgacccggcgatcatcgcgcgctcgggcttcggggtgatcgaccacgtgggccgggcgatctgccgcgacggcgacaaggccccggtggagggctggggcctctacgagcacggcgcgctggggcgccacgacccgtccggattctccgactggttaacggtcgcgccgtaaccggtacgccgccccggggtggtcgtcgcccagcagcggccccgcggcccccaggcgttcgcgcagcgtcgaacccggcacctcctcgggcacccgcccgcgccgacgtagctcgggcacaacgaatttcgcgaaatcgacgaaggtgcccggggtggtcacgtaggccacgttgaacccgtcgacgtcggcgtcgtcgacccaacgctcgagttcgtcggcgacctcggtcggcgaccccaccagcaccgggccgcgcccgccgatgccgatctcggcggccagctcggccaccgtccaggcctgccccgcggtggtgaacgatgccagcgccgagcggttggcgtcggtttcgacgtaggtcagcggttcgtcggggtccagttcggccagatccaccccggtccagccgccgaacagggccagcgccccgcgggggctgacgaagcgccggtattcggccagtttggcgacggccgcgtcgtgcgtctcggcgaccaccggggtcaccatggtgaacaccttgaccgcccgcgggtcccggcccagctgcgcggcggccgtccgcagcgcccgcacggactcgcgcaccacctgcgccgtcggcccggagacgaagaccgcctcggcgtgggccgcggcgaagcggataccgcgcggtgaggccccggcctggaacagcaccggggtgcgttgcggcgacggctcgcacaggaacggcccgggcaccgagaagtagcggcccttgtgctcgatgtcgtgcaccttggcggggtcggtgaacacgccgcgctgccggtcgcgcagcacggcgccggcctcccacgagccctcccacagcttgtagcagacctccagatattcgtcggcgatctcgtagcgctggtcgtgcgggatctgggcgtctaggcccaaattgcgtgcggcactgtccaaataggatgtgacgatgttccacgccacccggccgccggtgaggtggtccagcgtggagagccggcgcgccagggcatacggctgctcgtaggtcagcgacagggtgatgccgaatcccagcgtctcggtcaccgccgccatcgccgagaccgcggcgctcggttcgttgaccgggaactgcgcggcgtcgacgacggcggcgtcgcgggaggcgccgtagatgtcgtagacgccgagcacgtcggccaaaaacagcgcgtcgaacccgcccgcctccagcgtgcgggccagctcggtccagtagctcagctcgcggtaccggtggccctggtcgtcggggtgccgccacagcccggccgactgatgcccgacgcaggccatgtcgaaggcgttgaggtagatccggcgggccgcgctcatccgatcggctccccgcgcgtctcccgggccgcgcaggcggcgcccacggtgatcgccgccagcaccgcgaaatagccgacgatcaaccacggccggccgcccccggcgaccagcagcgacgccgcgatcaacggcgcgaacccgccggagagcacggcgccgatgtgatatcccaggctcgatccgctgtagcgcacccgggtgtcgaacagttcggcgaaccaggcggcctgcggaccgtacatcgcatcgtgaacgacgttgacgccgaacacgattgccacgaccaccagcaccgccgagccggtgccggcggcgacgaagaacaacaccagcgccacgaccgacaccagcgcgccgaacaggtacggcggccgccgcccgacccggtccgacagcagcgcccagcccggcgtgctgagaaaccccagcgccgacgagatcagcaccgcgaccagccccacaccgctgccctttccgaacgaatcctgaaggtagctaagcgaatacgtggtcaacagcacgaacagcccgatctgcgacaggcgcaggccggtggtgatgacgacgttgcgcgcgtcggtgcgcagcacctgcacgatcggcagccgggccagctcgtcgcggcttctgagccggtcgaagacttcggcgtcggtgagccgcagccgcacgaacagaccgaccgccaccagaaagatgctgagcaggaacgggattcgccatccgaagccgaggaaggcggcgggcccggtggccttgcggacaccgaagaacaccgacgtcgccagcagcatgccggccggggagcccagctgggtgaagctgccgaacagcccgcgacggcccggcggcgcatgctccaccgacagcaccgcggccccaccccattccgcgcccacggccagcccctgcaccacccgcagcgacgccagcagggccggcgccgccagcccggcctcggcgtaggtcggcagcgccccgatcgcggtggtgaccaaacccatcaccagcagcgcggccaccagcacggtcttgcggcccagccggtcgccgaagtggccggacagcaccgcaccgagcgggcgggccccgaatccggcggcgtaggtggcgaacgaggccagcgtcccggcggacggcgagatgttggggaagaacagcggtttgaacaccagcgccgacgcggtcgcgtagaggtagaagtcgtaccactcgatggtggtgccgatcatgctgcccgcagcgacggtgcgcagccccggccgggcgggaaggtcgccggccgaagcggcggccgggctggtcagagtcacgtggttgcagggtaatgaacccgtcggcgccggcgaatgtttgccatcgccgtgatgcgaacgccgggcggatgcgctggggctttgccgcaattcgccgacaaaccccgcgaaatgcggttcactagagcgcgtgtcagggccgccgcggatcgtcgacgtcgtcgtggtcggcgccggctttgccgggctggccgccgcccgcgagctcaaccggcagggccatgacgtggtggtcttcgagggccgcgaccgggtgggcgggcggtcgttcaccggcagcgtcgccgggctgccggccgatctgggcgggacgttcgtcgggcccacccaggacgcggtgctggcgttggcggccgaactcgaggtgccgaccaccccgacgcaccacgagggcaagaacctgatccactggcgcggctggacgcacgcctaccacggcaccattcccaagctgtccctgaccggcctgctggacatcggccggctgcgctggcagttcgaccggatcgcccgcagcattccgctggcggcgccgtgggaggcccggcgggcggccgaactggacggcctgtcgctgggcggctggctgcgctcggtgcgcgccaccgcctcgtcgcacgcgctgctggcgatggtggcccgggtgacctggggatgtgagcccgacgaggtgtcgatgctgcacgccgcccggtacgcgcacgcggccggcgggctggaccggctgctcgacgtcgaggacggcgcccaacaggaccgcttccccggcggcacccagcagatcgccgcggccgcggccgccgaactgggcgcacgggtggtgctgggcgcgccggtgcgccggatcgagcggcacggtgcgggcgtgaccgtgcgcaccgacctcggcgacaccgaggccgggttcgtcatcgtggccatcccgccggcgcatcgcgccgcgatcgagttcgccccgccgctgcccgccgagtacgagcagctggcccggcactggccgcagggccggctcagcaaggcctacgcggcctattccaccccgttttggcgggccgacggtttctccgggcaggcgctgtcggacgagggcccggttttcatcaccttcgacgtcagcccgcacccggacggcccgggcatcctgatgggtttcgtggacgcccgcgccttcgactcgctgcccgccgaccagcgccgccgcgacgcattgcgttgtttcgcaacgcttttcggcgacgacgcgctcaagcccctcgactatgtcgatcaccgttggggcgctgaggaattcgcgcccggcggacccaccgcggcggtgccgccggggtcgtggacgcggttcgggcggtggctgcgcgaacccgtcgggccgatccactgggccggcaccgaaaccgccgacgagtggaccggattcctcgacggcgccatccgctccggccggcgcgccgccgccgaggttatcgccctgctatgagctgatccggtgggtgggcaggttgcgggtcgccgattcggcgagcgcccgcagccgccggttcacctcccgcgggtgttccagcatcgagcagtgcccgccgggcagctccaccagctcgatcaggttcggcaggccctcggcgatcctgcgggactggcggatgggtgtcagccggtcccgttcgctgccgatgaccagcgtcggcaccgtcagcccggccaggtccaggtagcgcgaccccaacgcggagaccagcgcccgcgcgcagccggcccgccccgccggcgcggtgttctcgaacagctcgtagaccagccgggcgatggccgggtcggcgtcgcgcccggtggccggcagcgcgaccagatggcggctcgggacgcgggccgcccgcgggaccgcgaacccggcgaacgcgccgatcagcgcgcgcccggccagcacccgggccggcgacaggcccggcggcaccgagagcagctgcacctgccggatcagctcaccgctggtggtgttgatcagggcgacggcgtccgcgcgccgggaaaccttgtgccggtagcggtttgaccatgcggcgatggtgatgccgcccatcgagtgcccggccaacaccgcccgctcgtgcggcgccagcgtcgcctccagcaccgaatccaggtcggcggcaaggtgtttgaggctgtagccggtggccttcggcacgccgctgcggccgtggccgcgatggtcgtaggcgatcacccggtagtcgccggccaggtcgtcgatctggtatgcccaggcgcggatggcgcaggtgatgccgtgggtcagcacgatcggatacccgtccggcggaccgaacacctgcgcgtgcagccgggtgccgtcgaccgcccggaccgtgacggtgcgactcggcggcaaccggtcggggaacgggtccgttcgagccctcatcgccgctcccccctcgaacgcggccccgtcgccgcagctaaaggatcagacgatcttatcgccaagttcggttcgcttttggtaaatcgggcaaacgattcttatctctcgcgcttccgtcacaccgccgtctgttgccgcagcgtggtgtgcgggctctgtccgtaggtctgccggtagagcaccgcgaaccgtccggtgtgcgcgaacccccagcgctgggcgatttcggtgaccgtcgaggaggcggtcgtcgcggccaccagctcctggtgcgcgcggctgagccggacccggcgcatgtactcggtcggggtggtgtcgagctggcggcggaacaggtactgcaccgcgcggggcgtcaggtgcaccgcggccgcgacatcgttgatgccgatgtcctcggtggcgtggcggtggatgaaagacaccgcctccttgagggtttcgggcagggcgagatcgctgaccggatcctgctcggtcaggttggacggatagcactcgagcagcgcgccggccagcaggccggccatcccggcggcgatcagcggttgccgggcggtgtcgggcgaggcgagcgtcgccatcgcgtagtccagcgcgcgatgccaggcccgcaccgcggcccgcgagcgcggccgccagttcaggaactgggtctgttgcgacaacgcggtgtgccattccgcggcgactttctgcagcacctccgccgcgatggtcaccacatcgaaacgcgctccgtggcaatgcaatacgcaggccatgccgtgggcgacgaggagcgggaagtcgggggtggccagcgggccgccggccacgttgagcgcaccggcccgcggctggatcacgacgacggtgtcgcccgccgggatctcgagggtcatcctgccctggatggccacctcgtcgaccgtcatcgatccggtgtcgctgcgccgatgcgacacgacgcagtggttggtcaccccggcgatccgccagcccgggtcataggccgtggcgaagaaccggcgcgccgactgcgcgtcggcgccgtgaaactgcttgtattccaccgcaaccggccgggcccggcgctcgccgttgaccgcgagcaccggatcgaccggaccgtaatcggaccggaccgcctcggccggcgcaccgaccggcgcgccgtcgtcgcggaccgtcatggtggtcaggcccatgaccggcccggggggaagaccgtgggcgggcgcgtcatcgcagcaccgcgtcgccgtcgaggggcgcggccggctcgtgcaccccgaggctttggtagatgttcagcgcgtccagcgcgatccgctgccaggcgaagcgcgactgcgcgcggctgcgtccggccgcgcccatgctttcgcattgaaacttctgcgccagcagccttctcagcgcggcggccaatcgcgcgggattctccggcgacaccacgatgccggtgatgtcgtcgagcaccacgtcggacagcacccccatggtggccacgaccaccaccaccccgctggccatcgcctgcagcaccggggtggggcgcggcggccggcgcggcgtgcacaccagcacgtcggccgaacggagcaaccggggcagctcgtcgccgccgaccggcccggcgaagcggacccggtccgccaccccgaggtgcaccgaaaggcgcagcaactgggctcgcgcgccgtcgtgcccgtcgccgccggggtcggtctcggcgatcaccagctccgcaccgcgaaccttgggcagggcccggatggcgagatcgataccgttgtgccacaacgggtttggcgccacgtacaggatgcgctgcagggccccacgggagtccgccgggccggtcggggtgtagcgctcggcgtccaccccgcaggtcagggcggacacccgcacccggcgccggcgcagccgggccagcgcgtcgacgtcggcgctgctctccccggtcacccagttcgcgctgcgggccagcagcggctcgatgcgttggcgttcggtgccgcgttcgccgtcgtgaccgcgcgccgtcgcggccaggcccaaaaacgactgcacggtcggaatgtggcgccggcgggcggccaattgggcggccagcccgcccagccagccgtaggcgtgcaccacgtcgggccggtccttggaccagatccgctcgagggcgcccgcccagtccccgacgtagggcagcacgtcgaccggcgcggcggcgtcgtgcgggcccaccggcaccgacacccgccggtagccgtccggggcgctgcccccgcgtcgccgcccggcccgccgcaggcaggtggtgacgtcatggccctgggccgccagcgcggcacccaactgttcggggtcctccccgacgacgtcatcgccgctgacaattgcaattctcaactgcaattccctccgcgcgccatcgtccgtccgccaacatcgggtggcataccccggcctgggatggacaaacggcccggatcacctcttcggcgcgcggcccgtgattcgcctgccggacccggcccgagctgggcgatcgcgcgatccggcacccgtcacggccagcgccgccggaaatgcgccgacgggtggagactgaacgggtgacgactgaggcggatcggcccggagtcgagctggtggcgctggtggcgtcggcgggcggcttggaggcgctgaccaccgtgctgcgggatctgccgcgcgattttcccgccgccgtcgtcgtccagcagcacctggccggtcatgacagcctgctggccaccatcctgacccggcaatcggggcggccggtcggctgggcggccaacgggcgagccgtcacgcccggggaggtggtcatctgtccgccgggcaaggcgctggagctgacgccgcagggccgctgccggctgcacggcgcgcagcagcacggggcgcggggcgccgacgtgttgttgacctcgatcgccggctcctacggaccgcgaggcgtcgccgtcgtgctgtcggggtccgggcgcgacggtgcggcgggcaccgtcgcaatgcgccgggccggcggcgtggtgatcgccgagagcccggccaccgccctgtacccgtcgatgccgatcgcggccgcgcaggccggtgccgatctggtgctcgggatcggcgagatcgcccccgtgctggccgacctggtccacgggttgccgctgccgcgacgatcgccgccggcagacgcgccggacgaggcctacctggatggcggcgtcgacccggacggcatcttcgcccggctggcggcccggttcggcgccaacaccccggcggcgcgcgccgaactcgcccggctgcgcgcggccgaactgcgccgccgccgccaggagctgtccgccggggtgggcgccacccgggagacggtggccacggcgcggcgccgggccgaggagtcgcgccggcgcgccctgctggcccaccgggccgccgacgaggcctgggcgcgctccgaacaggagcaccgcgaccgggacggctaacccaccacgtccatcagcagcagcgccccgccgacggttccctcgttgccgcgaaacgacgtgcaggtgacccgcacccgggccgggcggccgcgccggttgaccgcatccaccacgacctcaccggagccgtccgggtcgacgaacgcgttgccgatcagcggacgcaccgcgtccagcggcagcccgatgtccagcgcggtcagcatggtgcccgtcgtctcgtcggcccgcagcccccacagctcttcgcagccgcggttccacaggatcaccttcatctcgcggtccaccaccaccatgcccatccgcaccgagtcgaccagcgaatccaggaagctcttcgcgtcgtcgagttccaggctgcgttcgcgcagcatgtcgttgatggtgtgcagttcgtcgttggtggactgcagctcctcgttcatcgtctcgagttcttcgttggtggactgcagctcctcgttggtggtctcgagctcctcgaccgtggactgcagttcctcgttggtggtttcgagttcctcgttggtggactgcagctcctcgtaggccgcctccagctggcggttggtctgcaccaccttgtccagcagcgcgcgcgtcgcggtcacgtcgaagaacacgatggacacgccgagcaggccgttctcggcgtcgacgagcgggttgacgtggatctcgaaccacaccgtctcggcgccgggccgctgccatttgacgtcctggatgcgcgccgagcgccgctccaccttggcctgctccaggtaggcgcgcagctcgacgggacggtaggacacctcgagatcgcgcagcagccggccgatgtcgcgcgccgagagcccgaagaccgtctcggcctgctggttgatcatcgcgacggtgtcctcgccggtcaccacgatctgggccaccgggctggcccggaacgccagatcgcgcaccgttgccagccccggcaggtcggcgtggcgttcgtagaacgcgcccgccgggtcgtagtggtccaggccgctgtggctgccgaccgccttgcggaagatccggtgcttgaggctcagcggggtgaaccggtcaccgtggctgagcagcatctcggcgtgccccagaaacagcgtgccctgcggggcaagcgcaaaatgcaagcgccccaacacatttcgctgggtctcggcgttcagatacatcagcgtgttgcggcacaccagcaggtccacccgggagatcggcgcatccttgaccaggtcgttgcggccgaagatcaccgcccggcgcagatccttgtgaaaaacgtagcggccgttgacctgttcgaagtagcgggccagcagatccgccggcaccgactcgaccgcccgggcgtcgtaggaggcgccgcgcgcctcggtcagcgcgtcctcgtcgacgtcggtggcatagatcttcacccgctgccggaacgcgtcgaagcccagcgcctcggccagcagcatcgccagcgtgtaggcctcctggcccgaggcgcaccccgcactccacacccggatcggatcgttgggcccgcgttcggccagcagtcgcggaatgacttcggcggcgacgaactcccaggcgtccgggtcgcggaagaacgaggtgacgttgatcaggatggtgttgaacagcgcggtgaactcgtcggagctggcctgcaggaagtccaggtactcgtcgaaggcggtgtagcccgcctggtccatccggtgccggacgcggcgcatcagcgaggtgcgcttgtagccggtgaagtcgaagccgcgcgaatcccgcatgtaccgcaacaaggcctcgaatgcctcgtcggcctcgtcagtcgtggaattcatccaagtcccgtctgataagggtgccgaaggacttgaacactactcgcgggactcagatccggtcttccctgccgaccgatccccacacggtcttgccggacgacgtgggggtggctccccacacccggcacagcgccgacacgatggccagcccggagacgatgtcggcgccgcggtcggcgtcctcgtgccggccgggcagcgcaaagctgttgtcctcgaccgcgaccgtgacggtgtcgcgatggctctcgacgatcagcaccggcgcgctctcggtgtggtcgaggacgttttcgacgaacacggtcgccaccgtcgccgcgacggggatgacctcccggatgtcccactgggtgagccaatcggtgagcacggcgcgggccaggtgcaggctggtgtcggagcgcggcagttcggtgcgggcccgccgccgcacctgcagggtccggccgtgcacggcccgcacggccagctcgcgggtgggatgcaccggcacgtagcgggtcacgccggcggtggtgatctcgcgccgcgtctgcgggtgcgcgcacaccagcaggattgggacgtcgggccagatgctgacgtgccagcgcgcgctggtgaacaccgtccaggcggaggcggacggggcgcgcacccggtcgacgtcgacgacgacggcgcggggttcatcgatcgcggccttgatgacggtgtcgcgcacggtgcggtaggtcgaactgtcgagcacgccgtcgaccgtcaggaccggcacgtcccggtcctgttcggacgcgatctgcaccgcggaccgctgctcgttcaccgggtttcaccctcggcggcggcgccggccagccggtggctgagcacgtgcagcgcgcgttcgctttcctcggcgatctgggtgtagcgccgcgagagcaggcccgccccggccttgccggccatgtcacgggccagccgggccttctcctgcaggctgcgcaccgccacccacagggcgccctcgagctcgttgtcccgcgcgctcagcagggcctcggccgtccaggcatgaccgacccggcagcggtagttgccctcgctgagcgagaccagcgagccgttgcagtcgggacaggtgtagccggacggcgggcccagcttttcggtgtcgaagtcggtggcgaaccgcgacatcatggcgatgcgattctccagctccatcccggggtcgcgttgcatgtcgggatcctctatctctcggtgcgccagctccttgagcaccacgccgatgtcggccgcggcggcctgccggtccaccacaccggcgtccagggcgttggccggcatcgccgggaacagtgcgtcgtcgggtgattggcagacggtgaccccgccgcgggagcggatggccgccatccccagcacgccgtcgtcgagcacaccggagagcagcacgccgatcgcgcgcggcccgaacgtcagcgccaccgaccggaacaacgcgttgatggcgggccggtggccgttctcggtcggcccctgcgacagcagcacgtgcgcgccgtcgaccagcagatgccggtccgggacgccgacgtagatgtgcccgggttgcagcggcgcgccgtcctgcgcggcggaggcgggcagcggaccgctgcggtcgatgatgcgggccaggatgctgggcgctcccgcgggcacgtgcagcaccatcagatacgcgaacggcacgtccggcgacaacccggcggcgaggttcgacagcgcctcgacgccgccggccgacgcaccgatcgctaccgcgccacgaaggtcgctctgaaggtcgccgtctgccgccgcaatcaccactttcgactacccctatcgatcgtaggcaacccacccaccgatggataggggcacagccgcgccgtttgcgcgggtgagccggtggtactcccccacggtcgaaagggtcgaaaggagaggcaacacatggccaccgaccacacttcgggtgcgcccgatcccaagcagcgcgatctggagtccgcgcggttccgccgcgacaccggatacctgaccacgcagcagggcgtgcgcgtcgaccacaccgacgatgcgctcaccgtcggcgagcggggtccgacgctgctggaggatttccacgcccgggagaagatcacccacttcgaccacgagcgcatcccggagcgtgtggtgcatgcgcgcggggccggcgcctacggctatttcgaaccgtacgacgaccggttggcgcagtacacggcggcgaaatttctgacctcgccgggcaccaggacgccggtgttcgtgcgtttttcgacggtcgccggatcgcgcggttcggccgacaccgtccgcgacgtgcgcgggttcgccaccaagttctataccgaacaaggcaattacgacttggtgggcaacaacttcccggtgttcttcatccaggacggcatcaagttccccgacttcgtgcacgcggtgaaacccgagccgcacaacgagattccgcaggcgcagtcggcgcacgacacgctgtgggacttcgtgtcgctgcagcccgagacgttgcacgccatcatgtggctgatgtcggaccgggcgctgccgcgcagctaccgcatgatgcaggggttcggggtgcacaccttccggctggtgaacgcccgcggcgaggggactttcgtgaagttccactggaagccccgactcggcgtgcactcgctgatctgggacgaatgccagaagatcgccggcaaagaccccgattacaaccgccgcgacctgtgggaggccatcgaatcccgccagtacccggagtgggagctgggcgtgcagctggtcgccgaggacgacgagttcagcttcgacttcgatctgctggacgcgacgaaaatcattccggaagaacaggttccggtattgccggtgggcaagatggtgttgaaccgcaaccccgacaacttcttcgccgagaccgagcaggtcgcttttcacaccgccaacgtggtgccgggcatcgatttcaccaacgacccgttgctgcagttccgcaacttctcctatctggacacgcagctgatccggttgggcggccccaacttcgcgcagctgccggtcaaccgcccggtggcgcaggtacggaccaaccagcacgacggttacggaccaaccagcacgacggttacgggcagcacacgattccgcagggccggtccagttacttcaagaacagcatcggcggcggttgtcccgcactggccgacgaggacgtgttccggcactacacccagcgggtggacgggcagacgatgcgcaagcgcgccgaggcgttccagaaccactacggccaggcgcggatgttcttcaagagcatgtcgccggtggaggccgaacacatcgtggccgccttcgccttcgaactcggcaaggtggagatgcccgaaatccgttccgcggtggtggcacaactcgcccgcgtcgatgaccagctggccgcccaggtcgcggcgaaactggggctgcccgagccgccggaggagcaggtggacgagtcggcaccggtttccccggcgctttcgcaggtcaccgacggcggcgacaccatcgcgtcgcgccggatcgcggtgctggccgccgacggcgtcgacgtggtgggcacgcaacgcttcaccgagctgatggagcagcgcggcgcggtggtcgaggtgctggccccggtggccggcggcacgctggcgggtgggtccggcggcgagctgcgggtggaccggtccttcacgacgatggcgtcggtgctctacgacgcggtggtggtggcgtgcggaccgcggtcggtgtcgacgctgtccgacgacggctacgccgtgcacttcgtcaccgaggcctacaaacacctcaagccgatcggcgcctacggggccggtgtcgacctgctccgcaaggccggcatcgacaaccggctcgccgaggacaccgacgtgctcaacgaccaagcggtggtcaccaccaaggccgccgccgacgagctgcccgagcgcttcgccgaggaattcgccgccgcgctcgcgcagcaccggtgctggcagcggcgcaccgacgcggtgccggcctgaaagccggccgaagaccgccgaaaggttttcccggccgccgggacgggcatccggctcagaaggcgtcatcgtggacaggaggacaagtcatgccgcgctcgtcgatcaagaacgaaaagatgtatcaggatctgcgcaagaagggcgaatccaaggagaaggccgcgcgcatctcgaatgcggctgccggccaaggcaagtcgtcggtgggccgccgcggcggcaagtccgggtcctatcaggactggaccgtgccggaattgaagaagcgggccaaagagcttggcatttccggctattcgggcctgaccaaggacaagctggtcgccaaactgcgcaaccactgatccgtcatctcgtcaaccgcagtcgttcggccagcaccaggaaggcgaccgcgtagtcgttgtcggcggtctgagcccggatttcgtcccagtccagccgttcgcgcacggcgcgcaccgcgggcagcagcttggcgaagtcgcagtggtgctcgcccagcgagcgcagctgctggacgagcaccatggtgggtggcagcaccggcatgccgatcgccagcacgtcgtggtgctcggcgcggtccagggtctgcgcatcgacgggcacgccgttgaggcggtgcagcacatcgaccagcatgtcgccggtgcgggccttgaagagccagtcctcgggcgggcgttcgatttcgaacccggcgctggccagggtggtcaccgcggtctccacgtccgcctcggccaccaccaggtcggcgtcgtggctgggttccggtgcgccgtaagcccataacgcgtagctgcccgccagggcgaaacgcgggcccttctccttgagcgccgatgccgccgcgcgcagcgcctcccgcagccgcggggcggccgcggcggtgtcggcgcgcgcgtcgccggatgtcatggtgcatagtcataccccgcccgcagggcggccaacccgttgacccctggtcacggcgccgcgcggttgtcaagaccgtttaacttgcggccgattgggaaatcgtgggttatgtcaactcctgtgccatgcgccgatgacgctgtcgccgtggtgattcccgcgcacaacgaggcagcgaagccggcgacctgcaccggcgccgggagccgggtggatgcgggctggctggccggtcggcccggcgccggcccgctcgacggaatcgcctgtcgctttggccaattggggggatcggtggcgggtgattgcgcgtgacggcggggttggtcaagcactggctggagtcggggcggctcgagttgccgctacccgcctcggggcgcaccgccgaacgctggcaacgcctggccgagctggccgcggagaacatcgtggcggccagggtggccgaggcgcacgtcgacgccgtcgcgatcctgcacgaactgggcggcaagcccccggaaccggggcagttgtggagcgtgtgggcggccgaggccccggacgcggtgctgaccgccaccgacatccgcggcgcgtacctgttgaacggcaccaaggtgtggtgcccgggcgccgggttctgcacgcatgcgctggtgaccgcgcgtcgcgacgacggaacaccgggcctgttcgcggtgaccgtgaccgacccgaccgtcaaggcgttgcccagcacctggtggaacgcggggatggccggcagcgacaccaggccggtgcagttcaccaacacccacgccgtcgccgtcggcgacccgggcgactatctgatccggcccggcttctggcacggcgccatcggcgtggccgcctgctggctgggcggcgcgcgccgggtcgccgatccgctgtatcgttgcgcggcaagccaatccgctgacgcgtattcgctggcacacctgggcgccgtggacgccgcgctggccgcgggggacgcgatgctggccgcggccgcggcgcaggtcgacgccgacccgttcgaccgggccggtaccgcacagctgctggcccgccgggtgcgcacggtggtggaacacgccgtggacgaggcgatcacccgcaccggccgggccctggggcccggcccgctgtgccaggacggccggcatgcccagcgcgtcgccgacctgagcatctacatccggcaaagccacgccgagcgcgacctggccgaactcggccggctggccggacggcgggcggtgcgggcgccgtgacgaccgtgccggcgggcagccgggccaggttcgctgccaagccgctgacccacagcggcaccccggtcccgttgtggctggccgcttttcaagaagcgccgctgcccgccctggatctggccggctgtcccggcctggtcgtcgtcgccgcccaccccgacgacgaaacactcggtgtgggcgcgatgatcacccagctggtggcgatcggcgttcgcgtgcaggtggtctgcgtcagcgacggcggggcaaggcccggctccgcggcatcggagcggcttcgcgcccagaccatccgcagattcgaattacggtcggcgacaaacacattgaacgctcctcccccgctgtcgctgggccttccgggcggcgagttgaccgctcacgaggaccgcctcaccggggcgttgaccgagatcctgcgcgccgccgggcccggtgcctggtgcgcggcgccgtggcgcggcgacgggcatcccgatcacgaggcggtgggacacgccgcgtgggccgcctgcgcgcacaccggggccgcgctgctggaatatccggtgtggatgtggcactgggccgttccgggcgacccggcggtaccgtgggagcgggcccatgcggtgcccgcgccggcctgggcggtgagtcgcaaacgcctcgccgcgcaacggtatcgcagccgattcgagcccaccggcggctcggcccccgcgctgccggggttcgtgctggcgcggttgctggcggtgggcgaggtggtttttcggtaacccgctggggcgcacggcgcggggggtgaccgtacgaggggaaagtgagcggccgaaaagctatgcgtgtggcgaccttcaacatcctgcacggtcgcaccgtctgcgacggcgtcaacgtggagcggctgcgggactgcatacgccggctcgatccggacgtgctcagcctgcaggaggtggactgcgaccaaccccggtccgaacacgccgatctgaccggcgcggcggccgaggccatgggcgcggtggaacaccgcttcgtggcggcgatttcgggcacgccgggggccacctggatggcggccaccggcgacgagcagcccggcaccgccgcctacgggatcgcgctgctgtcccggtatccggtggccagctggcaggtgctgcggttaccccgcattccgatgcgatttccgatgtacctgcccggccccaaccgggtgatgatcgtcgacgaggaaccgcgcgccgccgtcatcgcgcagctgcgcaccccgatcggcgaactcacggtggccaacacccacctgtccttcgttcccggctggaaccggcgccagctgcgccggctgattcgcgacctgcgcggcttgcccgggccgcggctgctgaccggggacctgaacatgacgccgcagacggtgcgccgctggtcggggatgcgggcgctgggcaacgccaaaacctttccggcggacaaccccaaccgccagctcgaccacatcctgaccgatgatcgccggctgcgctgcgccgccgtgcaggccgacctgatgccgatctcggatcaccgcccgttggtggtggacctgcagcgggtgtgacggctcatcgccgccagcacccgctcgacgtcgcccggggcgggtagctcgtcggcgatgcggacgatctgcgcgccgatctcggccgcgtcgatccgcgctgtgcccgtgataccttgcggcgcaagaattctcgcgacggtggcgatgtcgtcgtcggcggtgcgccgcggcagcagcgccagcgtcggcgcgtagccgacggcgggcgcctgccggggatagcccgcgcgcaaaaacccgaccacgccgcccaccagctgccccaggcccatgtctcacctcgctacctcaccgcacgccgcacgccgacaacgccgttgcaccccgaatagccggacccgatcggttgaaacccacgcgcacggaaagggcccggtccgccgatcggaccgggcccctccccttggcgggcagcctattggttcttcttctggcgctcctcggcggcctccgcgccggcccgcgccgactcggcctcggcttccttcttgcccgcgtcgcgctgggcgtcggccttgtcctgctgggcctgaccctcttcggtcaggtcgtcgcggccgaggatggtcccgccgacctccttggccttgcccttcacgccctcgacggcgcctttgaccgcttcctgcggcccgctctgctggtcccccatgggttcgacctctctggtaggtggtgagtgagcttgcgctcgatggcatccaaggcgttcccgccgcgggcggtgtcaaacggttcgtccggtatcgcgcccgggatgtgcgggccgtcaccgcgggcccggcggccggcgcaggtcacgccgcggaccggcggtcggcgggtttgaacgggccgttactgggtagctcccccgcggcacggagcagaaggcaggtgagagcactgaccaccatcgccgtgataggggcaaccggcacggccggctcccgcgtcgtcgcccggctgaggccgcgtgacgtcgcggtggtcgagatctcccgggcgcagggtgtcgacgtgttcgacgcgcccgggctcacccgggcgctcgagggggtcgacgtcgtcatcgacgtctccaatccggtgccgcccgacgggcgatccgacatccggcagacgctggccaccgccgcccgcaacatcatgggggcgtgcgccacccaggaagtacagcgcctggtggtgttgacgatcgccggcatcgaggacccggtgttcgacgaattcccctactaccaggccaagcgggaggccaaggagatcctgctcgacggcccggtcccgaccaccgtcgtgaagtcgacgcagtggtacgaattcgccaccaaccacgacgcggtgagctgtgacgacaacgaggtgatcgtcgaggactggctgatccagcccatcgccgccgacaccgtcgccgacgtgttggtggaaaccgccctggcgcagacccacacgccgcgcaccatcaccggcccggacgccatccggcttcccgaactgacctcgaaactgcttgtgcggcaaggcgatcgccgggcggtgcgcagtgtcgagcccgcggtgtccgcgctcggcgccggggcgctgctggcctccgggcacgcggtggtcgtcgggcccgacgtcgacacctggctgcagaccctggcgccgcccggcggcgacggccatcggggcgctggcggcgacggccatcggggcgccgacggggacggaaagccccggcgcggataacgattccgtcacaatcaccctcaccattgcctaagagcgcggcgccatttcttaaaaattcgcggctcggttgatcattcgcttagcaaacacccgtccgacggcccttaccggcacggtgcgttcgttgtcagcgaacacggtcactgttggcctccgctactttggatttcgaggatcgggagcctcagtcgagaacatttcgcttcgaattcgaaggacaacaaagcacatgaaaatcagcagtatcgtcgcgcgccggaaagtggccggggtcagcgccggctgtctgctcgggggaatggccatgggcatcgtcggcgcaccgtcggcggccgccgcacccgactgcagtcccagcggtgtgaactccaccgtgtccgcggtggagggctcggcccagcagtacctggcggcacacccggacgccaaccaggtggtgaccgccgcctacggccagccgcggccgcaggccgaatccagcctgcgcagctatttcaccggtcacccgcaggagtacaacgacctgcgcggcatcctggcgccgatcggcgacaccgaacggcagtgcaatgtcaccgcgctgccgccgtatctggagtcggcgtaccaggagttcatggccggctgacgccatcggagacgacccgccacaacgccgtggcgggtcgttttcgcattcgcctgcgggcgccgccgcggtgtgaacgacttctcgggtgggtatctgaggcgaatggccccggcccgcaattgcgttgcggccggccgttgcggacagccgagaaaactggagggttccgaatgcggctccgtcgcagcgtgctgagcaaaccggggatcacccgcaaacggcgcggtaagggattctcttatcacgcgccggacggcaccacggtgcgcgatcccgaaaccctgcagcgcatcaaggatctggtcattccgccggcgtggaagaaagtgtggatctcgccccaccccaacggccacatccaggccgtcggcgtcgacgcggccggtcgccgccagtacctgtaccactgcgcgtggcagcaggaacgcgcggaggagaagttcgaccgggtgctggagctgtccaccgagctgccggcctggcgggcccgaatcgccgaggacctggccgcccggggtttgacccgcgagcgggtgctggcgctggggctgcggctgctcgatcgcggctacttccgttccggcggcgagcagtacgccgaggagaacgagtcctacgggttgtccaccctgctgtgcgagcacgtgacggtccggcgtgacgcggtggagttcgacttcccggccaagagcggggtccggcgcaccgtgcgggtcgaggatcgcgaagtggtcagggcggtgcgtccgctgatgcgacggcggcaccgcggcgaccggttgttggtgtgccgcaccgcatccggatggtcggaggtgcgcgccgacgacctcaacgaccggttcaaggagctggtcggcgaccagtacacggtcaaggacttgcgcacctggcacggcacggtgctggcggcggcggcgttcgccgaggccgatgccgcggtgtcgcggcgggtcgccaggcgggtcgaggcggcggtgatgaaagaggtggccgaggagctgggcaacaccccggcggtggcgcgcggctcctatgtggacccgcgggtgatcaccgggtatgagcggggactgaccatcggcgcggcgacgcggcgcgcgggccgcgcccgcgaccccgacgccgcccaggagatcctggacaaggccacccggatgctgatccggcgagtggccaagggccacagcgcctccggagcatccgtgctgccgaaatcggcctagcgccgccgggcaggtttgtccgcgcggcccggcacccgcgcggggctggcggccgggcaaaccggttcgacaccgacaacccttcgtcaaatgtccccggcgattcgcttactggacagaaccgccgcgcgccgcgggcgccggagaagcggctccctacgcgtggaatcacttgcccactaacggtttacagaggttcgctgcgcctcgccgggaccgtgcgcccggggaaaacgtcgggcccggcgctgtttatgccagtacctacagggtatttggctcgccatgttggatcctgtccgagcaaagcgcgtcctggtgtggcatgtgcacggctcgtggacgcagtccttcgtcgcgggccggcaccgctacctgatcccggtggcccccgaccgcggcccggacggcatcggactggccggccggtgctggcccaacgcccgcgaggtggcattcgaggacctggccgaccgcgatatcgacctggtggtgctgcaacgcccgcacgaggccgagctggtcgcccgctgggcgggccgccgggtcggggtcgacgtgccggcggtctacgtcgagcacaacaccccgcgccccagcgcggcacagacccggcatccgctggccgaccgagccgacatccccctggtgcacgtcaccgacttcaaccggttgatgtgggacaacgggattgcgccgacccgggtcatcgaccacggggtggccgatccggggcggctgtacagcggcgagattccccgggtggccaccatgatcaacgagccggggcgccgcggccgcgtcgtcggcgccgatctgctggaaccgttgtcggcctacgcccagatcgacgtatggggcatcggcaccgaggggttgtgcgccaaccgcggcgcggtgcgcggccgcggcgacgtgcccaccccgcggctgttcggagacgtcgcgcgccggcgggtctacctgcacacggcccgctggacctcactcgggctgtccctgatcgaggccatgctgctgggcatgccggtggtggccgtcggctcgaccatggcgccgttcgtaatcccttgcgaggcaggagttgtcagcgccgacccagccagactgggtgaggggttgcggggcttcctggacgaccaggccagggcggtggccgccggcaaggccgcccgggacttcgccaccgcccggttcggactcaaacgctttctggccgactgggaccaagtgatcggggagctgtgcagatgagcagggaaggaacccgcatgagaatcgcgatgatctccgaacacgccagcccgctggcacatttgggcggcgtggacgcgggcggacagaacgtccacgtcgccgagctgtcctgcgcgctggcgcggcgcggccacgacgtggtggtctacacgcgccgcgacgacccgcggcttcccgactcggtcgacaccccgcacggctacagcgtggtgcacgtgccggcgggaccggcgcgggtgctgcccaaagacgagttgctgcaatacatgtacggcttcgcgcagttcctgcgccagcagtggtgctcggacgggcccgatgtggcccatgcgcacttctggatgtcgggggtggccacccagcgggccgcccgcgcgcattcgataccgaccgtgcagaccttccacgcgctcgggctgaccaagcggctgcaccagggcagcgaggacaccagcccggactgccggatcgacgtggaagcccgggtcgcccgggaagccgactgggtggcggccaccagcaccgacgaggtcttcgagctggtgcgcatgggccgggcccgatcccgcacctcggtggtgccgtgcggagtggacctcgacgcgttcacccccgacggccccgtcgctgcccgcggtgcgcggccgcgcatcgtcacggtgggacggctggtgccgcgcaagggttttgacaccatcgtgcgcgccctgccccgcatcccggacgccgagttggtgatcgtgggcgggccgccggcggccgaactggccggcgacgagcaggcgcggcggctgcaacgactgaccggcgagctcggcgtcgccgaccgggtgcggctgctgggcggggtcacccgcgcgcagatgccggcgttgctgcgctcggccgacgtggtggcctgcacgccgtggtacgagccgttcggcatcgtgccgctggaagccatggcctgcggggtcccggtggtggccacggcggtgggcgggatccgcgacaccgtcgtcgacggcgccaccggccggctggtgccgcccaaggacccggacgctctgggtgaggccgtcgccgccctgcttcgcgacggccgccgcggccggacgctgggcgaggccgggcgggagcgggcccgggcccgctacagctgggaccgggtggcggccgacaccgaacgcatctacgaacggctgtcccccgcccggcgcggggtcggcaccccgagcacgcgatccgggtgatcttgtggctcaaccactttccagcatccgcagcgaacgctcgacggcatcgggcagccgccggcgttcccgcagcgcggccggcaacgccgccgtcgcctcgagcaacgccttggcgtgggccgcgtcgtgcagcgccgcccaggccagcgccgcacccgcccgggcgcaccggtcgacggggcggcgcaggcacgcggtgagcagcgcgttgcgcaggatccgggcacgctgcgcccggctcgccgagcggatctgcgacggccggtggtatgccaccagctcggggcagaagcacaggtcccagccgtcggcggccagatcgcaggccagcagggtttcctcaccgcggaagtgcaggatcgggctgaacccgccgacgcgtcggaacgcccacgcgcgcaccagtgccgagcaggcctggaacccgagaatggacggcccgggcaggcccgcgcggtgcccgagtgggctgtgggcgagctgctcggtgaaatcgtcgtcgcggcgcgccggcagtaacacggtgcgcgcggccaacagcgcgacggtgccgaacgtgtcgaagatctgctcggcccgcgcgatcgcgtccggcgcccaccacgagtcgtcgtcgcagaacgccacgtacggtgtgccgcaccgcgccacaccgatgttgcgcgccgctgcgccggcgttgcggctcagcggtatgacggtcacccggccggcggcggcgatgcggctggcggcggcgaccgagtcgtcgcgggatgcgttgtccaccacgatgatcgggcactcggtggtgtccagcaggcgggtcagcgtgccggtcagctccgccgagcggtcccgggtggcgatgacgaaggaggtgcgcggcatggtcgacatgaccggggcgactaccccgaagggcaacggtgaaacggggtttcaccccagacctgacgggtaccagagcccgatgcgatcactgacccgggtgctgatcaccggcggcgccggctttttgggcgcgcacctgtgtgcgcggctgctcgacgacggcgtcgaggtggtcagcgtggacgacctgtccaccagcgggcctgcggtccgattcggcgaccggcccggataccggttcgtgcagcgcgacgtctgcgagcccgggttgatcgacgaggtcggcagcggcttcgacgccgtattccatttggcctcagcggcttccccggtcgactaccagcgccgcccgatccagacgctgtgcaccggctcggcgggcaccgcgactgcgctggagatcgccgagcgcgccggcgcccggttcgtgttggcgtccaccagcgaggtgtacggcgaccccgagtcgcatccgcagcgcgaaagctattggggcaacgtcaatccggcgggcccgcgcagcgtatacgacgaagccaagcggttcgccgaagcgttgacgttcgcctatcaccgcctcggccgcgccgatgtcggggcggcccggatcttcaacacgtacgggcccggcatgcgggcggacgacggccggatggtgccgacgttctgcttgcaggcgctgcgcggcgatccgctgacggtgtccggcaccgggctgcagacccggtcgctgtgctacgtcgacgacaccatcaccgggctgatcgcgttggcgcacagcgacttcgccggcccggtgaacatcggcaatccgaccgagctgaccgtgctgtccgccgccgagttgatccgggagctggccggcagcacgtcgaccatccagttcaccccgccggccgccgacgacccgcagcgccgctgcccggacatccggctggcccgcaaaaggctgggctggcggccgcgggtcgactatcgcaccggcttgagcaccaccctggcgtggttcgccgagcgggccgggcgcaccggtgagtcggcgcaacagctcgtcgcgaccactgaccggcggacccggtaggaggcagcagagtgcgaattctcggagtcaatgcggtatttcacgatccggccgccgcgctggtgatcgacggccgggtggtggcggccgccgaggaagagcggttctcccgccgcaagcacggcaaaccggcggtccccttcgccacctgggagctgcccgtcgcggccatccgctggtgcctggatcacgccggcgtgcgggccgaggacatcgacgcggtcggctattcctacgacccggcgctgatgtacgaggaaccgctcgaccccgccgggctggaccgggactgggagcacctgcgcaccctgtatgccgaacgggcgccgggctttctgaagaccgccctgcccggcctcaaccccgcggtggtgcatcacgtgcgccaccacgtcgcgcacgcggcgtcgacggcgctggcctccccgcatcccgagaccgcggtgctggtggtcgacgggcgcggtgaacgcgcctccatgctggccggggtgtatcgggagcacaagctcgacgtgctggccgtccagcagctgccgcactcgctggggctgctgtacgaaagcctcaccgagcacctgggtttcacccgctccagcgacgaatacaaggtgatggcgatggcctcctacggccggccccgcttcgccgaccggctgcgcgggcgggtgtacgcgcgcggcgacggcgggttctgcaccgagccgatcgactgggagcaactcgccccgccccggccgccgcacgcggcgacgctcgacccggtgcacgccgacctggcctgcagcgtgcagcgcgtcgtcgaggacgtgttgctcgagctggtcggctggctgcgcgaccgcaccgacggcgacgcgctgtgcctggccggcggggtggcgctgaactgcgttgccaacacccgcattcacgccgagggcggtttcgaccgggtgtgggtgcagccggccgccggcgacgcgggcaccgcgctcggcgcggcgctgcacctggccgcatccttcgacgagccgatcgcaccgatgcccggcgcgcagctgggccgcggctggtccgacgcggcggtcagggccgcactcgacgacgcggcggtgaattacgaacgcccgcacgatcttccgtcggccgtcggcgacgcgctggccgagaaccagttgatcggctggttccagggccgcgccgagttcgggccgcgcgcactcggcggccgctcgctgctggccgatccgcgctatccggccaacgccgaacggctcaacgccgtcaagggccgcgaacagttccggccggtcgcccccatggtgctggccgagcgcgccgccgagatcttttcccgcggaccgcttcccagcccgtacatgctgttcgtgcacgacgtcggcgagcactggcgcagccggattccagcggtcacccacgtcgacggcacggcgcggatccagaccgtggacgcggatgcggacccgctgctgcacgccaccatcaaccggttcgcgcagcacaccggggtgccggtggtcgtcaacaccagcttcaacaccgccggacggcccatggtggacaccccgcgcgacgccctcgaggtattcggcagctccccgatcgacgtgctggccgtcggcccctacctggtcaggcggtatctgtgaggcacgacgactacacgctggtgatacccacggtggggcgggaatcgttgcaccgcttgctgattgcgctgcgctcgagcatgggtccgcagccgccggaggttgtggtggtcgacgaccggccccgcccgggcgacgatctgccgctgccggacgacccgccggtgcgggtgttgcgcagcggcgggcgcggaccggcggccgcccgcaacgtcggctggcgcgccagccgcacccgctgggtgtgcttcctggacgacgacgtgctgcccgaccgcgactggatatcggcgttgtgcctcgacctgaaggccgccgacgcgtgcggcgccgccggctcccaggcggtgctcgaggtgccgacaccgcggcggcccagcgacgaccaacgccggaccgcgcggctggccaccgcgcaatggatcaccgcggacatggcctatcgccgcgacattctggtcgccgcaggaggtttcgacgagcggttcccccgcgcctaccgggaggactccgacctggcgctgcggatcgtgtcggccggcggaaccatcctgcgcggcgagcgtcgctgcacccacccggtggcgccggcgacctggcgctcgagcgtgcgggcccagatcggcaaccgcgacaacgcgctgatgcggcgcaagcacggccgccgctggcggacccggatcggcgagggacccggccggatgccggcgcacgcggccaccaccgcggccggcgccgtcgcgctgctggccgggctgctgggccggcgcgccaccgcccgccgcgccgccgcgctgtggctgctgtgcacgatcgagttcgcggcgcggcgctggctcagcgggccgcgcaatgtgcgtgaggcacttggcctttcggccagcagcgtgctcatcccgccggtcgcggtggcgcaccggctggccggggaatggaccttcggcgcgcgcgtcccgagccgccgctggccgtgctgctggaccgcgacgacaccctgatcgtcgaccggccctacctcaacgaccccgcgggcgtgcggcccacccacgacgccgccaaggcgctgacccggctgcgccgccgcggcctgctgctggcggtggtgaccaatcagtccggcgtggcgcgcgggctgatcagcgccggccagctggccgccgtcaacgaccgggtcgacgaggtgctcggcccgttcgattcctggcaggtgtgcgtgcacggcgcgtccgacggctgcggctgccgcaagccgcggcccggcctgatcctggcggccgccgaggcgctgggggtgccggcccggcgctgcgtgatgatcggcgacaccggcgccgacgtgcgcgccgccctggccgccggcgccgcggccgtgctggtgcccaccgaccgcaccctgcccgccgaggtcgagcacgcgcgcacccacgcccgggtggccgcgacgctgaacgacgctgtctcccttgtgctttcggagtgccgatgagtaccgcggtggtggcccgcctggacagcgccggtgacgtgctgatcaccgggccggcggtgcgcgcggtggccgcccggcacgaccgggtgaccatgctggtcggcccgcgcgggcgggccgccgccgagctgctgcccggtgtggacgagctgatcgaatggcaggcgccgtgggtggacttcgaggcgcccgagctgaccgcggcgcacgccgaggcgctgatcaaacagctgcgcggcctcgcgcccgaccgggtctacatctgcacgtcgtttcaccagtcgccgctgccgctggcgctgctgtgccggatggccgcggtgccctgggtgggagcggtcagcgtcgactaccccggcgctctgctgaacctgcggcatcgggtgccggacgggattcccgagccgcagcgggcgctgtcgctggccgaggccgccggctgcgccctgcccgccggcgacgacggcgcgctgcggatccgggccgtcgacccgctgccggcgcggctggccgaacaactcgcgccccggccgttcgtggtgttccaccccggcgccgcggtaccggcccgccggcccagcccgtcccgcagcgcggcgatggtggccgcgctggccggcgccggccaccgggtcgtcgtcaccggaagccccgacgaggccgcgctgaccgcggcggtggcgggcgacgtcgccgtcgatctgggcgggcgcaccagcttcgccgaactcgcggcggtgttcgcggcggcccgcgtcgtggtcgtccccaacaccggacccgcacacctggccgccgcggtaggcacaccggtggtgtcgctgttcgccccggtggtgcccgccggccagtggcgcccctacgggcggcgggtccgcgtgctcggcgaccagttcgcgccctgccgggccagccgcgcccgggtgtgcccggtcacccctgcctggaccgcatcaccgacgcggagttgctcgccgccgtggcagaaggcgccgtggcagaaggagggaagccatgatcgaggtccacttcgacgcgctgcgggaagcggtgcggcgcaccagcatccaggccccccggttgcgcgggtggggcggacggctggccacggtgctgcccgccggaggccggttgttggcctgcgggaacgggggcagcgccgccgaggcccagcacctcaccgccgaactggtgggccgattccgcgaggagcgaattcccatgtccgccatcgccttacacgccgacacctcggcgctgaccgcgatcgccaacgactacggcgacgacgaggtgttcgcccgcggggtgcgggcgcacggccggccgggcgacgtgctggtggcgctgtccaccagcggcgccagccgcaacatgatcgcggcggtcaaggccgcgcacgacgtcggcatggtgacctgggcgctgaccggaccggcccccaacgagctggccggcatgtgcgacgaggcgatctgcgtggacgccgccggcaccgcgacggtgcaggaggtccatctgctgctgatccacgggctgtgcatggcgctcgacgaccaccttttacgacgggaagcatcatgagcacatcgaaacctctcgtcgtcgtgggtgattcgatgctggacgtcgacatcctgggttcggcgaccaggctcagcccggaggcgccggtgccggtggtggacgccgaacggcacgtgcaacggccgggtggggcggggctggccgccctgctcgcagcccggaccgaggcgccggtggtgttgatcaccggcatcgccgacgacgacgccggccgggcgctgcacgatctgctgagctgctcgggggttcgggtgctggcgctgccggtgagcggaacgacggtgtgcaagatcaggatccgggcccgcggccagtcggtgctgcggctcgatcgcggcgacgcgaccccggtcgacgggccgctgccggccgcggcggccgacgccctggccgatgcccgggcgatctgcgtcgccgactacggcgcgggggtgaccgcgttgccggcggtccgggcggcgctgaccgagtcggcccgtcgcgtcccggtggtctgggacccgcatccgcgcggcgcgccgccggtgccgggatgcgcgctggtgacaccgaatcacgaagaggcgcggggcttttgccacgacgacggctcgggtgacggcggtgaggcgctgctgcggacctgggccgccgacgcggtgtgcatcacccgcggcgcccagggggcccgggtgtacgagccgcgggccgacgtgcaccgggtcgcgatcccgcagcgggccgcgcccgccgccggcgatgtctgcggcgccggcgatcggttcgccgtcgccgcggcggtggtgcgggccgcggtcggcgacgcggcgcgtttcgtcgccgccggcggcgcggccgcggtctcgatcccggtgtccgacaccggatccgacccgctgaccagccggtcgcggcccgcggacgccagcgcggtggacgcgctgggcctggccgcgcggctgcgccggcagggccgcaccgtggtggccaccggcggctgcttcgacctgctgcacaccgggcacatccggctgctccggcaggcccgcgagctgggcgatgccctgatcgtgctggtcaattccgacgcgtcggtgcgcgcgctgaagggcagcgggcgtccggtgatgcgcgatgcggaccgggcccgcgtcctggccgcgctggcctgcgtcgacgcggtggccgtcttcgacggcctgacccccgaacgcatgctggaggatttgcgtcccgacatctgggtcaagggcggcgactacgtggccgccgagctgccggaggccgacgtggtgtaccggcacggcggcgaggtggtgatcctgcccacggtggccggttattcgtcgtcccgcttgatcgccgcggcggccaccggccgcccagagtagcgaaaggtgttgatatgaaagcacaatcactggaaggcgtattgatctccggcggttcttccggcctgggcgcggccacggtggccgcggtggccgaccgcggcggggtgccgctggtgatcgaccggaaaccgccggccgccgacgtgccctacgtcggttgcgatctggccgacaccgacgcggtggccagcgccgtcgagtcgctggccggcaaggtgggcggccgcatcaccggggtgtttaccccggccggcatcgactcgtgcggcaccctggaacaggtcccggccaaggactgggagcaggtgatcgccgtcaatctggtcgggaccgccgcggtgatccgggccgccctgccgtacctgaaggccaccgggggccggatcgtcacctgcgcgtcgacgctgggcatcaaggcggtcagcgacgccaccgcctactgcgcatccaagttcggggtggtcggcttcacccgcgcgctggcggccgagctggcgggccaggtcggcgtgacgctgctcatccccggcggaatgcacaccccgttcttcgacgggcggcccgaacagtacaagccgccggccgacgccaaactcaaccagcccgaggacgtcgcccaaacggtgctcttcgcgctctgccaaccggccggctgcgaggtgcgcgagatggtggtgtgcgcctcgacagagtcgtcgtggccctagcggccggcgccacccgggccgggccgcggcagcgcatcgtggtgttgcgcgccctgggactcggcgacctgctgaccgcggtgcccgcgctgcgcgggctgcgccggcactaccccgacgcccgggtgatgctggccgctccggaccgctaccgcgagctggccatgctcaccggcgccgtggacgagctgctgcccaccgccggactcggcgacgtgcagccgctcaccgacgcgccggcgctggcggtcaacctgcacggctgcggcccgcagagcatcgaccacctgctggcctgggaaccccggtcggtgatcagccattgccacgactgccatcccggcctgcccgggccgcgctggcgcgccgacctgcacgaggtgcagcgctggtgcgccctgttggagtgggccggaatcccttgcgactcaaccgatatcctccttgaacgcccgtccatcccgcgggacgagaccggtgccgtgctgatccaccccggggcgtccgcgccggcccggcagtggccgccggaccggttcgcggcggtggccgcggcgctgcgcgacgacggccacgagatcctgatcaccggatcaccgagcgaattccacctcgcgcacaccgtcgcccgcgccgcccggttgccgcgcaccgccgtggtgtccggagtcctcgacctgccggcgctgaccgcgctggtcgccgacagccggatggtgatctgcggcgacaccggtgtggcgcacctggccgccgcgaccggcaccgcctcggtggtgctgttcggccccacctccccgcggcggtggggaccgcgcgggccggcgccgcacgccgcgctgtgggccggccgcagcggcgacccgcacgccgcgacgccgcaccccggactgctcgagctgaccgtcgcgcaggtgctgtcggcctgccgcggggtgctgggggagacggcatgagcaccgagccgctggtcggcgtggtcggtgtcggctacgtgggtctgaccaccgcggtctgcgtggccgctgcggggcgcaagaccgttgcggtggacatcaacccggaccgggtgggcaggctgcgcgccggggtggcggtgatcgacgaacccgggctgtccgagctgctgggtgacgggctggccggcggcgtgctgcgcttcagcgccgatttcgccgagctggccgaccgcgacgtcgtcttcgtgtgcgtgcccacgcccagcgccccggacggacacgcggacctggccgcggtggagtcggtgatcgaccggctcggccgcgtgctgcgccgcggtgccgtggtggcgctgaaatcgaccgtcccggtcggcaccacgtccaccatggcacagcggctgtgccacaaggggattcgtgtcgtctccacccccgagttcctgcgcgagggacgcgcggtcgacgacttccgcaacccggaccggctggtgatcggcagccacgacgaactggcggcccagctggtgcaccaggcctacggcctggccggacaccgggtgctgcggatgagcccggaaagcgccgagctggccaagtacgccagcaacgcctttctggccgtcaagctgtcctacacgaattcgctggcggcgctgtgcgcgcgggtgggcgccgacatcgacgacgtcacctgctgcatgggcgccgaccggcggatcggcgcggagttcttgcgcccgggcccgggttggggcggttcctgcctgcccaaggacaccgcggcgctgctggacatcgcgcaccggcaccgggtgtccttcgccgaagtggaggccgcccggcagaccaacaccgcgcaggcacgacggatcgtcaccgcgctgcggcacaccctcggccggccgttgtcgggttgccggatcaccgcgctggggctcaccttcaaggccgccaccagtgacacccgggagtcgccggcgctggcggcatgccgcgaactggccgcggccggcgcccaggtggccggccacgacccgcagttgcccaacatcgaccccgccgtcctgcagcaaaaccgggtgaccgcggtcgacgacccgtaccgggcggccaaggccgccgacgcggtcgtggtgctgaccgaatggccgcagttccgcagcctcgactggcgggcggtcgcacaggacgcgccgctggcggtggtgctggacgccaggaattcgctggacccggccaccgtgcgggaagccggcctgcgctatctgggaaacggtgtgccacaagggttttgactgttggtggcgggcgccggcgactttcggcgccgcgccggcgactggcaggtggctgggagtcggctgaccggggcgggcggcagcgcataacaccggcgaatccgggtaacccggctcgtgtgggacgtgccgaggccgccgccgcggcggcagcctgcctggttcaaccaccagccacacacccacccgccagcacggtcggccgtttgccgaggagggaagacatgtccaaacaagaggtttccgactatctgctcgagcgtttgcgggcgtggggcgtcgagcatgtattcgggtaccccggcgacggcatcaacgggctgctcgccgcgtggggccgcgccgacaacaagccgcagttcatccagtcgcggcacgaggagatgagcgcctttcaggcggtcggctacgcgaagttcaccggccgggtgggcgtgtgcgcggcgacctccggccccggcgccatccatctgctcaacggcctctacgacgccaaactcgaccacgtcccggtggtggccatcgtcggccagaccaaccgcaccgcgatgggcggcaactaccagcaagaggtcgacctgctcagccttttcaaggacgtcgccagcgactacgtccaaatggtcaccgtgcccgagcaactgcccaacgtgctggaccgcgcgatccgcatcgcgatgacccagcgggccccgacggcgctgatcatcccggccgacgtgcaggagctgccgtactcgccgcccgagcacgcgttcaagatggtgccctccagcctgggcatcgaatacccggccatcgccccggaggacgccgccatcgcccgcgcggccgagatcctcaacgcgggcaagaaggtggccatgctggtcggcaccggcgcccgcggggcgcaccacgagctggccgaggtcgccgacctgctcggcgccggcgcggccaaggcgctgttgggcaaggacgtgctgtccgacgaattgccttgggtcaccggctctatcgggcttttgggcacgcggcccagctatgagctgatgcgcgactgcgacacgttgctcacggtcggatccagcttcccctacacgcagttcctgccggagttcgggcagtgtcgggcggtgcagatcgacatcgacggccggctcatcgggatgtgctacccctacgaggtgaacctggtcgccgacgcgaaggccgcactgcgcgcgctgattccgcacctgaagcgcaaggaggaccggtcctggcgggaaggcatcgagaagaacgtggcccgctggtgggagaccatggacaaggaggcgatggtcagtgcggacccgatcaacccgctgcggctgttctccgagctgtccccgctgctgcccgacaacgccatcgtgacagccgattccggctcgtcggccaactggtacgcccgcaatctgcgcttccgcggcaacatgcgcggctcgctgtcgggcacgctggcgacgatgggccccggggtcccgtacggcatcggcgccaagttcggccagccggaccggcccgtcatcgtgttcagcggtgacggcgccatgcagatgaacggcatggccgaactgatcaccgtcaagcggtactggaacgaatggaaagatccgcggctgatcatcgcggtgctgcacaacaacgacctcaaccaggtcacctgggagatgcgggcgatggccggagcgccgaaattcgctgagtcgcaaaaccttccggatgtcgacttcgccgcgttcgcggccgggctggggttgaacgcgatggccatcaaggatcccgacgagttgtccgacgcgtggcgcagcgccctgtcggccgaccgtcccaccgtgctggacgtctacaccgatcccgacatgccgccgatcccgccgcacgccacctgggagcagttcaagtcggcgaccgcggcggtgctctccggcgacgaggaccgcaccggcttcgtcaaggtcggcctgaaaaccaagatgcaggagttcttgccgcacaagaaaagctgaccgcggccgttcagcccagcgcggagcgggcgctgcgcaggtcgtcgacgaacaaccggtagacctcgtcgtgccgttcgctgcggtcgcgcagcaccgacgacgggtgcaccgtcgccaccagcaccggctcgggcgccacgtcgggtatcacctcgggcgaggccggcagcttgagcggttggccgcgttgggtggagacccgaaagctggtgcccagcaacgattgtgcggcggtggcccccagacacacgatgacccgggggtgcaccgcctcgatctcggcgatcagccagggccggcaggcgacgatctcggtgcggcccggcttctgatggatccgccgcttgccgtccttgcgggtgaacttgaaatgcttgaccgcgttggtctgataggtcagcccgggatcgatgccggcgtcgtgcagcgcccgggccagcagccgcccggccgggccgacgaagggtgcaccggcgcggtcctcctggtcgccgggctgctcacccaccagcatgatcggggcacccggatgtccgttgccgaacaccgtctgggtggcgtcggcgaaaagtgaacagccgcggcatgtttcggccgcatgcttgagcgcctcaatgtcccgttgctcggggaggtagcggtcggcacccggggccttcgaagtcgcggtcatggtagggggcggcgaggtgcccccactcccccaccgagcgggggtacctcgcctgggatggccgtcagcccttgccgacgatgacgtcgcgggctcggtcgagcatcgcggcgaacgggccggcggccaggttggccagttgcgattccactccggcgtgcggccgggtgggcgcgatcgcttcggccagtttggcggcgcggcccatccgttccagctcgtcgccgctcaattcctggcccagcttggcgaactcgtcgtgctcctcgtgctcggcgtggtcgatcaccgcgtcccgcagcttggtgagctcgcgggtgaactcctcgctgtcgacgtcgagcttttccagcttctgcagcgcggtcttggcctcgtgctcttcgtgcaggcgttcctcgaccacacctgccccgccggcgatcttgcgcttggcgcgcggatgcacgatctcctcttcggcggtctcgtgcacggcaagcaggcgccgcagttcgatgaaggcctcctcgcgcgcctttccggacgccgccaacgtgttggcgaacatcgccttgatctgctggtgctggctgaccagaaagtcgaccacatcggtgggcgacttgatggcggtcggtgccatgctgtccctcccatctgctctggttcggcgcgcagggctgttgcgcgctctggttgcggctacccgagccacccgggggtcaaacgggtgtggcggtggccaggcggggtatgccctggaaaaacagggcgggaggcaaaagttgcgcgcgggagttgggtcccggtgtggtgctgcgcggcggcgcgctgacgggcgtgctggcggtgagcgtcggcgcgctggtcatgagcgtggcctgctcgcggcccggcgcggcgaccgaaagcgcgcccgagctgacggtctggccggtcggcacggcgctgcaccagccggtgtggtcgtatcgcgggcacgccctggtggccgtcaccgaggatcagcgggtggccgaggtcgccgaagaccgcgccgcggcggcgaccacccggctgtcggcgccgctggcggcgggacgcaatctgcagatcagcaccaaggatccggcggtggtgttcgtgccgcagcccgcgcgcggccgggtggccgtcgtcgatctgcaaagtctgcgtcaggtgggcgatttcgacgccggtcccgccccggcctacctgtccgaggacgccgggttgcggatgctgctggcgctgtcgtcggacggccggtcggtgaccccggtcgatcagtacggctaccgcaagctggcgaccgcaccgatcgccggcgcccccgccgaggtcatcgacggcgccaaccgcggccgcgaaatcgactaccacgtctacgcgccgtccgggatccggcattaccagggccccgattccccggcgccgcaacgcggttcgctggacatcgacgtcgcggtctccgccggcgacggcaccgcggtgacccgcagctatgtggccggccacgacgacgccgtgctgtacgcggtggactcgcgccgcggcgggcaagggatagaggtgctggccagcacccggctgcccgccccgatccgggcgctgggcaccgacgacacccgcatctacgcggccaccgaccggcagctggtgaccctggaaacggcgagcttcaccgggtttccggcccggcacattccggtgctgcgcaccgtcgactaccgctcggcgctgcccgagtccgcgcgccgagccccactctccggcatggccgtcgggccgcatcgggtctacctgaccttggcccaggcgccctttgtggtcggcatcgccaagccgcggctgtgacgggttcggtttgggcaccgggcccgctcggctacatttcgggcaggttcggccgccgaggaggcccctaggaggcgctgcgtgaccaaccagcaggatccgtattggcgcaacccgctgagttacgacccgctcggccgggtcccgccgcccgaacccgagcccgtcggcccgccgccggcgcaaccagccacgctcgcaccgccgtaccgcccgggcgtcaacacgttggcgacgctgtcgctggtcttcgcgttcctgttcgcgcccgcgggcgcggtgctgggtcacctcgggctggcgcagatccgccgcaccggcgaactcggccgggaccgcgcgctggtgggcgtcaccctgtcgtacgtgttcatcctgctggcggtggtcgcgctggccgggtgggccacgctgggcgggtccaccgccgcccaccgcgccgcgcacgaggccaccacgtcggccgggccgccaccgcccacggtgccgccggacaccatcaccaccctgctgcccgggctggacgcgctgcgcaacatcaccgccgacgccaacctcgacgtcggcccgacctggaacagcccgggccgctcggcgcaggacggcagcatcgaccgccccgaatgctggggcagcatcgccgccggcagcccggacgcctacacccccggcgccttcaccggctatcacgccggcgaattcaccgacacccgcagcatgctgaagtcgatccaggtcatccagggcgtggcggcgttccgcgacgcgcccggcgcgcaggcgcaactggacgcgctgctggccgggtggcgccagtgcggcggctcgacggtaaccgtgacggcgccgggcgggcagccgatcgcgatggcgttgagcacaccggccgacgccggcaacggcatcaccactttggacctgacgcccaagggaattcaggtgcgctccgcgcgggcggtcgcggccaaggccaacgtcgtcgtcgacctgaacgtgtcggccagcggcacgaccgacagcgagcgggcccggctggccgcggtcagcatcgccaactacatcctcggcaagattcccggctgagcggcccgcccaccgatcagtaggctgggcggatgaaatacgttgacgtcgacggggtcggccgcctcagccggatcgggttgggcacctggcagttcggctcccgcgagtggggctacggggacagctacgccgccgatgccgcgggcgacatcgtgcgccgcgcgctggcattgggtgtgacgctgttcgacaccgccgagatctacgggttcggcaagagcgagcggatcctgggcgacgcgctcggcgagcagcgcgccgaggtggcggtggccagcaagatcatgccggtggcccccttccccgcggtggtcaggcaacgcgcgcgggccagcgcccggcggctcggactggaccgcatcccgctctaccaggtgcaccagcccaacccggtgttccccgattcggtgatcatgcccggcatgcgcgacctgctggacagcggcgagatcggcgccgccggggtctccaactattcgctgcagcgctggcggaaggccgacgcggcgctgggccggccggtgatcagcaaccaggtgcacttctcgctcgcctaccccaaggcgctgaagaacctggtgccgttcgccgaacgggagaaccgcatcgtcatcgcctacagcccgctggaacagggtctgctgggcggcaagtacggcgtcgacaaccggccgggcggcgtgcgcgcagtcaacgcgctgttcggcaccgagaacctgcgccgcatcgagccgctgctgcagctgctgcgcgacgtcgcggcccaggtcgacgccaagcccgcccaggtggcgctggcctggctgatcagctacccgggggtggtcgccattcccggcgcctccagcgtcgagcagctggaattcaacgtcgccgccgccgacatcgagctgcccgccgagtcgcgggacgcgctcaccgacgcggcgctggccttccggcccacgtcggccgcgcggttcctgaccgacctggcccgggagcggatccccggccggggctaggtctggcttacgactggctcaggactgattggcctcggcgaacgcggcctggctggcgggcgcgccacgcgccaccaccagcggcatcgaggtcgaggcgttggtgcgcaggatggtgtgcaccacgtcgatgaggtcctccaccggcatcagcttgccgggcatgcagccgcgcgacgaccacagcggaaccgccttcatcgccagatccatgtcccagccctggttcatgccggtctgcccgtcgccctcgccgcccgcgcactccccgacgatcaggcaggtgaagccgatgtcggggtgttcggcccgccacgcttcgaccaggcgctccagcgcggccttgctgacgccgtaggcgcccagccccggccacggcggcccgaacgcgccggcgtccgacgacaggtacaccgccttgccggccgaggcgctcaggtgcggcaccgcggcggcggtgaccagcgacgcgccgatgacgttggtgtcgaagatgcgccgccaggtgtcggcgtcggtgtccaccatgcgcaccagcgggcccaccgcgggggtgtagacgatgttgtcgatcccgcccagcgcgtcggcggcctcgccgatcgccgaggcgcaggacgcctggtcggtgacgtcgcactcgatggcgaccgcacccgggccggcgtccttggccgcggcctcgatgcgctgccggcgccgggccagcagcgccacccggtcgccgcgctgcgccagaccgaccccgatgcagcgccccaacccgctggaggcgccgaccaccactgtccttgacatattcgccctctcttgtaacgagcccgctgcagccacagcgtatcgggcggcggcgcgctacgtgacgttcgggcggattcgtgtcaaggtgctcagccgccgtcgggtgcccgcagcaccaccgcggtgtgggcgtcgacgttgagtacgccggcaccgggcacctcgtcggctggcgtggtctcctccggcccggtgtacaccacgacctgccatgatgcaccgaattcctttgggggaagggtgaattcgatggactcgtggtgggcgttgaagcacagcaggaacgagtcgtccagcagccgttgaccgcgggcgtcgcggtcggggatgccgtggccgttgaggaacaccgtgacggacttggcgaaattggcgccccagtcctcgtcggtcatctcggtgccgtcgggggtgaaccaggcgatgtcgcgcagcccgtcctggccgcgccgtcccaccggcttgccggagaagaaccggcgccggcggaacaccgcgtgctcggcgcgcagcgccgacaccacccgggtgaaggccagcaggtccacgtccgcgttggcccagtcgatccaggtgagctcgttgtcctggcagtagccgttgttgttgccgttctgggtgcggcccagctcgtcgccgtgacagatcatcggcacgccctgcgacagcaacagcgtggtcaggaaattgcgctgctggcgggcccgcagggcgttgacctgctcgtcgtcggtcggtccctcggcgccgcagttccaggaccggttgtggctctcgccgtcgttgttgtcctcgccgttggcctcgttgtgcttctcgttgtaggacaccaggtcacgcagcgtgaacccgtcgtgggcggtgacgaagttgatcgaggcgaccggccggcgcccggtgtgttcgtacaggtcggccgaaccggacagccggtaggcgaactcgtcgagggtggcgggttcgccgcgccagaagtcgcggacggtgtcgcggtacttgccgttccactccgtccactgcggcgggaagttgcccacctggtagccgcccggcccgacgtcccacggttcggcgatcagcttgacctggctgaccgtcggatcctgttgcaccagttcgaaaaacgtcgccagccggtcgacgtcgtagaactcgcgggccagggtggcggccaggtcgaagcggaatccgtcgacatgcatctcggtcacccagtagcgcagcgagtccatgatcagctgcagggcgtgcgggtgcccgacgttgaggctgttgccggtgccggtgtagtccatgtagtaccgcttgtcgtcgtcgaccagccggtagtaggcggcgttgtcgatgccgcgcatcgacagggtggggcccaggtgattgccctcggcggtgtggttgtagaccacgtcgaggatgacctcgatgccggcctcgtgcagcgagcgcaccatggccttgaactcctgcacctgcccgcccggcgtggcggcgctggagtatttcgtgtccggggcgaagaagccgatggtgttgtagccccagtagttggacaggcccttctcgatcagggtggagtcgttggcgaagtgatgcaccggcatcagttcgatcgcggtgaccccgatgctctgcaggtgctcgatgatcaccgggtgcgccaccgcgccgtagctgccgcgcatctgttcggggatgtcggggtgggtctgggtgaggcccttgacgtgcgcctcgtagacgacggtgtcggcgtagtggtggtccggcgggcggtcgttgccccagtcgaagtacgggttgatcaccacggacttgggcatgctgggcgccgagtcgtcgtcgttgcggctgtccgggtcaccgaagttgtagccgaacagcgactggttccactcgaaggtgccgtcgaccgccttcgaatacgggtccagcagcagcttgttcgggttgcaccgctgcccggccgccgggtcgtaggggccgtgtacccgatacccgtagcgctgccccggttcgatgccggggatgtaggcgtgccagacgaagccgtcgacctcgggcagcgccacccggctctcggtgccgtcgccgtcgaacaggcacaactcgacccgctcggccacctcgctgaacacggcgaagttggtgccggcgccgtcgtagctggcgcccagcgggtaggccttgccaggccacacctctccggtgggcgtgggagcggcagcctttgcagaggtcatggcgcattcaataccctgccggtgcgcccgtcaaactcgggcgcccgtggcggcgttgccggtgggaagcggaatgcgttgccgtagaagcgattacggcttgagtatgactttgaccgctccgtcctgcttcttctggaagatctcataggcgtgcggggcccgctccagcggcagcacgtgggtggcgaagtcgtccacgcccagcggatcgtcgtcggtgagcagcggcatgatgtcgtcgacccagcgcttgacgttggcctgccccatccgcagcgtgacctgcttgtcgaacagggtgagcatcggcagcgggtcggccatcccgccgtacaccccgatcagcgagatcgtcccgccgcgccgcacggcatcgatcgccgagtacagcgccgacagccggtccacgcccgcggtctgcatcagccgcttgccgagcgcgtccggcagcacgccggccacctgctgggccagcttggccgccggcgagccgtgcgcctccatgcccaccgcgtcgatcaccgagtcggcgccgcggccgtcggtcaggtcccggatcgcgtcaccgagcccggcgtccagccgcgccaggtcgatggtgtggattccgcgttgcgcggcccggcccagccgctcgggcaccaggtcgaccgcgatgacccggtagccgaggtgatcggcgatgcgggcggccatgtcgccgatcggccccaggccgagcaccgcgaccgtgccgccatcggggatgtcggcgtaggccaccgcctgccacgcggtgggcagcacgtcggagaggtagacgaaccgcgaatccggcggtcccacaggcactttgatgtgggtgaactgggcctgcggcacccgcagcagctcggcctgcccgccggggacttcaccgtagagctcggaatagccgaacagcgccgcccccatgccctggtcgcgcacctgggtggtctcgcactgggtgtacagctgctggccgcacatgtagcaactgccgcaacagatttggaaggggatgaccacgcggtcgccgacgcgcaggtcgccggtttcggtgccgacctcgcgcacgacgcccatcggttcgtgccccaggatgtccccgggcttcatgaaagccccgaggatctcgtagaggtgcagatccgaaccgcagatgttggtcgaggtgacctcgatgatcgcgtcggtgggctgctcgatcttgggatcgggcaccgagtccacccgcacatcgcgtttgccgtgccacgtgacagccttcatgccgggggcgcatacccgcccgctcagcgccgaaacggcagccgcggttgagcccgcgcagcgcgggtaccgcccgtcgtcggggtgctgacccacaacgccgacgacgactacgagctgggcgagcggctgatcgcacagcaccggccggcgccggtggcgatgggctagcgccggcgctgcttgagcgggtgctcgctgtcgatgagtgcggccgcgatgtcgaccacccgggtgttggactgctgcgagagccgggtgagcagctcgaaggcttccaccgcgtcgaggtcgaagcgctccatgatcacgcccttggcctgcccgatgatgtcgcgggaggccagggcgctgcggaactggtcctggcggcgcatcatcgaccaggccagggcgatgtgggtggcgtagacggtgccgagctcgaccgactcctcggtgaacgcgtgcggcgggtcggcatagaagttgagggcggccatgctggtgcggtcgacgaacagctcgaacgacaggatggagcggatcggggtctgctcgagcgcgtgccgccggtagcgctgccagcgctgttcggcggccaggtcggcgatgtgcatgacgtggtgttcccaggccgcggccaggcacggcccctcgccgtacttgttctggatggcgtccagcaccatcgggtagcgatgcgtggccgccacgctgttgaccgatttgctcttctcggccagggtgatccccgcgtactgggagccggtgacgtggtggacgccgttgtcgatgagttcgtacagcccggccgcggtgtcgctgttctcccgctccaaactggtcaccagctccaccagctgagtgacgatcgtggtgctggcctcgcgcatcacatcacccccggagccgtctggcggcaaggcccttccctgccggcatcacgggaggcattgacattttcgtggctgccaacacccaccccagaagtctatgagccagacaacgaagcgcaaggccggataacgaaacgggcggccgggcggcgccccggaaacgacggcccagccgggctgggccgggccgcgcggccgcgcccgacggcgacctccgccccggccgccggtccgaaatcattgctggtcaacgggtttcaccgggggcgggtcgcggcccgatcgcgcacgggctccgacccggccggccggcgcctacactcggggcggtgacctccattgtgatcgtgggaagcggcttcaccggattcacctgcgcccgccggctggccaaaacgctgcgccgggcgccggtggacatcacgatgatctcccccgtcgactacatgctgtacacaccgttgctgcccgacgtcgccggcggggtggtcgacgcgcggttcgtcgctgtgccgctggccaattcgctgcgcggcgtgcacgccgtgcgcggccgggtggacgcggtcgacttcaccgggcgcacgctgacctaccgcgaccccgaggaacgcagccattccatgtcctgggaccggctggtgctcacgccgggatcggtcaccaagctgttcgacgtcccggggctggcccggcatgcccgcgggttgaaaaccaccgccgaggcgctgtatctgcgggaccacttcgtcgaacaactggagctggccaacatcgaggacgacccccgagtggcggcggcccggcgcaccgtcgtggtggtcggcgcgtcgtattcgggcaccgaactggtggcgcagctgcgggcgctggccgacgcggcggcccggcagatgggctttgatcccggcgcggtgcggttcctgctgctggacctggccgagcaggtgatgcccgaggtgggcaagaagctgggcgacgccgcgctgaaggtgctgcgccgccgcggcatcgacgtccggctcggcaccaccctcaaggaggcgcacgcggatcacgttgtgctcagcgatgattcgcggatcgacacgcacaccatcgcctgggtgaccggggtgaccggcgcgccgctgatccaggacctgaggctgccgaccgagaagggccggctgaaggtgcagcccgatctgcaggtccccggccatcccggcgtgttcgcggccggggacgccgccgcggttcccgacctcacccagcccggcaagatcaccccgccgaccgcccagcacgcgacccggcagggcaaggtgctggcccgcaacgtggccgccagcctgggtcacggcagcgccaaggaatacaagcaccgcaacctgggtctggtggtcgacctcggaccgcgctacgcggtggccaacccgctcaacattcacttgtcggggctgcccgccaaggccgtcacccggggctatcacctgtatgcgattccgcgcggcgtgaaccggtgggcggtgtcgctggcctacctcaccgacgcgctgttcgcccgctccgtcgtatccatcgggctgtcctccgaggacgacgcgcaattcaccgccagcgagggcattccgatgccgaagacgggctgagcgcgcgacggctcagccctgcgccgcctgctgcgcgatcgcgtagccgagctgaagaaagtccgcaccggtcagcacgctgaacacgcccgcgaccagccgggtgtagcgcggcgcgaacaccaggccgatggcgaacccggtggcaacccacatgtccaggcagaacgggcaggtcagcagctcgcccaggctgtgccgcagctggctctgctcgcggacctcctcctgcacctcggccgggccgccggtgcccgcgtagtgggtgaacggcgcgcgcagcgggctggtcaccgcgtccttggtcagggtgcgcgacagcttgtgggtgcccagggtgaggatcagcaggtcctgggcgcgccatcgggtcggcaggctgcggccactggccagggcggccagcgtcgcggccgtcaccaccaggccgtagacgaccagcaccgccaggtagccgcccagcgggcggggattgtcgccgcggtaggcctgcgcttcgcgccgcgcgccgtcgaccacctgggcgccggtgtcggccaactcacccatcgcttcacctcgaggcttggaaggcatagcccgtcgggtacccggactcgaccggcgcaacccggggacggcggctcagccggtggccgcgtcgccgtcggcggtcttcgcggcttcccgcaacgcccggttggtcgaccgcaggtcggtgttggccgccgacagcgtggcgttgtcgtcctccagggcgaggatgcgggccacgccggccaggttgaccccggcgtcgaccagcttgctgatccgcttgagccgggccaggtcgtcggcgctgtaccggcgggttccgccctggcttcgggccggtgtgaccaggccgtggcgttcgtagagccgcagcgactgcaccgcgatcccggacagctcggcggccaccgagatgccgtaaacaccctggtcggacgccggagcacccgcgttgccgcggcggtcggccatcgcgcatctccctcgctcatgccctgataacgcccagaaaatctgtttagcacagttgcgtcatattgtcgaggatgatatatcaaatctatattgttagacatagaaaaccacatacacgtcacctagatcacactgaggggtgaacatcatgctgatgcgttcggacccgttccgcgaactcgaccgactgaccaaccaggtcctgggcaccgccacccggccggcggtgatgccgatggacgcctggcgggaaggcgagcacttcgtggtcgaattcgacctgcccggtatcgatgccgagtcgctggacatcgacatcgagcgcaatgtgttgaccgtgcgcgccgaaaggccggccctcgaccccagccgcgagatgctggccaccgagcggccgcgcggcgtgttcagccgcgagctggtgctcggcgacaacctcgacaccgacaagatcgaggcctcgtaccgcgacggcgtgctgagcctgcacatcccggtggccgagaaggccaagccgcgcaagatcgccgtcggccgcggcgaggcaccccgggccgtcaccgaaaccgcgcgagaggtcgtcaacgcctgaccgcccggaggcgggcggcggccgcacgcgccaggcgctttcgcgcgcccgtcgcccgcctgcggctccagggctcgggcgtgcacctctcgcccggtgagcccagtgagagggagggattgacgatgacttggaatctcgacggccagaccgccaacgtcgagcaggcgctggccggcggccacacacagcccgccggctggtttcggttctacttcgccgaccagcggtgggaatggtcggagcaggtgcagcgcatgcacggatacgaaccgggcagcatcactccgaccaccgagctggtgctctcgcacaagcaccccgacgaccgggcacgggtcgccgccacgatcgatgagatcgtcaccaaccatcaggcgttcagcacccggcaccggatcatcgacaccgccggaaacgtccgtcacgtcgtcgtcgtcggtgatcggctgaccgacgaacagggcgaggtgatcggggcgcagggcttctacatcgacgtctccaccccgcacgagcaggtgcaggaggagatgatgagcgcgagactggctgagatcagccggaatcgggcccgcatcgaacaaaccaagggcatgctgatgctgatctacggcatcagcgacagcgcggccttcgagttgctcaaatggctttcgcaggaaggaaacgtcaagctgcgaccgctggccgagcagatcgccgaggacttccgcggcgccgacgtgccgctgcccacgcggtcggaattcgaccaccttctgctgaccgcgcaccaacgcctgaaggcttccgacacccgcagctgatcggttgcgggccaaggcttttggtgctcagtggtcgagcagcggggcggtccaatgcacccgggtgccgccgccgggcgggctgctgatctcgcagctgccgccgagttgctcggcccgccgtgtcatgttggccagcccgctgcgacgggtgttgccggacgcgatgccgcggccgttgtcgatcacgtccagggtgaacatgtcggcgacaccgatctgcaccgtcagccgcgacgcgcccgagtggcggacggcgttgctgacggcttcggcggtcaccgcctcggcgtgctcggcgagctcggcgccgaccgccgtcatcggaccgtccatgcgcaccgtggtgaccaggtcgcgattctcggtcagctcggcgatgacccgctgaatgcggtgccggaagtcgccggcgacggccgccggggagcgcagcgcgaagatcgtggtgcggatctcctcgatgatcgtctgcaggtcgtcgagcgtccggttgagccggtcggccacctccggcgaccgcgcccgggccagcgtgccctgcagatccatgccggcggcgaacagccgctggatgacgtggtcgtgcaggtcgtgcgcgatgcgctcccgctcggccaaaacggccagctgccgcgcgtcctcgcgcgccgcggcgagcaccagcgcgatggcggcgtgggtggcgaagtcgcgcaccaggtccagatagctctcgtcgaacggcggctgctcggtgccgcgggcgatcgcgatcaccccgaccacttcgtcgcgggcgcgcagcggcatcacgatcgccggtcgccgcccggcatcggtgaaagcctggatgggataacggaattcgtcggtgatcagcggttcgccggacttgaagaccgcgccgctggtggagccgcgcaccgggacccgctgcccgagcacgtcggcggcgggcaggcccaccgccgccaagaccaccagggtgtccacctccgggttgccgggctgctcggggtcggcgggcaccagcacgatggcctgttcggcgtcggtcaacgcgcaggcgcgttcggcgatcagctgcatcgggcgccggtgcggctcggtgcgcgacagcagcgcggtggtgatctcgcggctggcttcgatccatttcaccgacatccgctcgcgctcgaagacctgcgcgttgtcgatggcgaccgccgccgcgaaggccagggcgcgcgcggccatctcgtcggcgtcggagaacacccgcgcctcatcgacgtgggtcagatacaggttgccgaacaccgcgccgcggatggtgatcggcaccgcgagaaaggcccgcatcgccggatggtgctcggggaatccggcggcggcggggtgggcggtcaggtcgtccatccgcagcgccggggtgtccagcagggacagactgagcagccccttgccgaccgggtggtgcccgatgcgccgcaccgtctcggcgtccatgccttcgtgcacaaaggagatcaggttggcatgccggtcgcgcacggccagggcaccgtacggggccgacgtcaattcccttgccgcgctgatgatccggtgcagcgtcgcgtcgagatccaggcccgcgccgatctcggcgatcacccgcagcagtttctcggtttgatcgcgcgcggccgccagttcgtcgaaccggttcccggtcaccccggccagtccggtggggtcggcggacggccggcctgctggttgagtttcgacgcgaacaccgccgcctgggtccggcgctccatgccgagtttggccagcagccgggacacgtagttcttgaccgtcttctccgcgaggaacattcgcgcggcgatctgccggttggtcaggccctcgctgagcagcccgagcagcgttcgttcctgttcggtcaggcccgacagcgggtccgcctgcgcggcgctgccgcgcagcttggccatcaacgcggcggcggcccggttgtccagcagcgatttcccggcgcccacgtctttgatcgcccgggccagctccatgcccttgatgtccttgatgacgaacccgctggcgccggccaggatggcctccagcatcgcctcgtcggaggtgaacgacgtcagcatcaggcagcgcaggtcgggatgctcggagagcaggtcgcggcacaactcgatgccgttgccgtcgggcagccgcacgtcgagcacggccacgtcgggccgcgccgccggtatccgcgccttggcctcggccaccgtgccggcctcgccgacgatctgcagatcgggatccgaggagagcagatcgcacagtccgcggcggacgacttcgtggtcgtcgaccaggaacaccttgaccatggcgagccttcctgtcggcagaccagtccaatatcccacattctcggctccctgcgggtcggggcgtaactggttcaacgactttggtcccgaccgcagaggaccttcggccgccgcaccgacacggggccggccaatagtgttgcggcagtgacccattgcggcagtgattcattgcggctcaacaccgcgggcgcggaaagggacgaagcgatgccggcgaccgatgacggggtggagatcctgccggtgcgcgagtgctgggatctgctgcgcggcctgacgctgggccggctggtcacccacgccgacggtcagcccgacatcttcccggtcaactacgtcgtgcagcgccgcaccgtgctgttccgcaccgcggagggcaccaagctgatcagcgcggcgatcaacaaccgggtgctgttcgaggtcgacgaccacaacgtcgtcggggcgtggagcgtgatcatccggggcatcgcccgctcgctgcgcactcccgaggagatcgaggaggccgagcgcgcgcaggtgctgccgtggaccaggtcggagaagacgcactacgtacgcatcgttcccgagagcgtcaccggccgccgcttccggttcgggtcaccggcgggctgatcagccgacccactcgacgaagtcggcgaggtcgcggcgcggggtcgccggcaacgggtccgcgttgatcggcgcccaacccacccgcagcagcatctgcggatggtggccgtcaccgaagatgtcggcgcgcaccgccgcgcgcgtctgcggcgtctccagcggttcggtgaccgggcagctggccagccccgccgaggtggcggtgagcagcaccaccccggtggcctcgccggcgcgcagccgcgccagccggtcgtcgtggcgggtgcccagcgcgagcaccacggcgttgtcgtcggcggccgacgacccctgcgccatcggcagcgccgcgccggcgaacaaccgggtcgggatcttggcggccggatccgggaacggggtgttgcgggcgggcaccccggacaccgagaagtagcgcccactccaggtggtcagctcggccagataatcctgggtcaggtggtcgcggatcgattgcgcgacgatgtcgtgcaggccgtcgacgtcctgcacctggtacagcgtcaccccggcgcgggccgcccgggccgccatcagcgcgatgtcgccgaccggcaccggccaacagctgtagtggcgccggtcggtgcgccggcgcgggatcgcggcggcgagcgcgacgtcgacgtagtcggcggtctggggcgaaaactcaagcgtcgcaaggtgatccgggtcgtcgggatccggcagcctgcgcaccctggaccgccagccgacggcggcgaacgcggtgacgcagtgctgcagggcgatgccgcaactcaggatcaagtcgcggccgtcggggtcggtgtggggcagttgccgggcggggtcggcgtacaggtgcaggccggccggatcgatgcgccaccgccacggttgggtgttgtgcaccgagggggctcgagacgccagcgccagtgccgtgcggaccgtttccggatccgggaagccggtgttcatgagattccccctcttctcgcctggcgccctgcggtatccacgatcacgcgttctcggcggcaccgcgagggcccgacggctctagccggagggactttcggccgatatccgtggccggcccgccgccggccgatccgcccttatgctgaccacgatggcgaatcacggccccgatcccaccacgccgctgtggcgcgcggcgcaagtgttccgcctgctgagctgcgtctacgccaccggcttccagatcgccatcaacccggatctgcttcgccccgtgctgggttgggtgcttttcgccgggctgatcggctggagggcggcctccgcgctggcctatctgcggggcttcggccgcaagccggcgtgggtgctggccgagctggtggtcgtcgtcttgctgatgtggtcgaacaacctcgtcgcgagcccgcactgggcggccgacaaccagacctggccgacgacgttgtgggccagcaatcccaccatctcggccgccatccagttcggcccggtgggcggcatgctgacgggcctggcggtgatgaccgccaatttcgccgtcaagaactacttcgcgctcaacctcgggcacaacgccaccgtcatcatcgaactggcgatcggcatggcgatcgggatggccgcgcagaccgcgcggcgcgcccacgacgagctgcaacgcgcggcccgattgaccgccgcggcgcaagagcgcgaccggctggcccgccaggtgcacgacggggccatccaggtgctggcgctggtcgccaagaaggggcacgaaatcggcggcgccacaaccgaactcgccgacctggctagcgagcaggaacgcgcgctgcggcgctggctggcgtgtacggatatcgatcgggacgccgacggcgataccgtcgacctgcgcacgctgctgcggcgccgagactccgatcgggtgtcgatcagcctgcccggcacgccggtgaggttgggacgttgggccgcaaccgaactcgacgccgcggtgggcaacgcgttggacaacgtggtcgcccacgccggcccgggggcgcacgcgttcgtgctcgtggaggacctcggcgattccgtgttggtcagtgtccgcgacgacggtgtggggatcgccgccggccgggtcgaggaagcggcgcgccaggggcgcctgggcatctcccaatcgatcgtgggacggttggcgtcgctgggcggcaccgccgaactgcacagcgagcccggggccggcaccgaatgggagttgtgcgtgccgcgccgggagggacgcgatgacggatgacgcgacgcccacgacggtgatggtggtcgacgaccatccgatctggcgtgacgcggtggctcgcgacctggccgaaagcggcttcgcggtggtcgctaccgccgacggggtgaccgccgcccagcggcgggcgggcgtggtcaggcccgatgtggtggtgatggacatgcagctgcccgacggtgacggtgcgcaggccaccgccgcggtgctggcggtctcgccctcgtcgcgggtgctggtgctgtcggcctccgacgaacgcgacgacgtcctgcaggcggtcaaggccggtgcggccggctacctggtgaagagcgcctcgaaagccgaactggcgcaggcggtgacggacaccgccgccgggcgggccgtgttcaccccgagcctggccgggctggtgctgggcgaataccggcgcatcgcgcagagcaaggacgacggccccacccgcccccggctcaccgaccgcgagacggaggtgttgcggtatgtcgcaaaagggctgtccgccaagcagatcgccgagaagctctcgctgagccaccgcacggtggaaaaccatgtgcaggcgacgtttcgcaaactgcaggtcgccaaccgggtggaattggcccgctacgccatcgaacacggcctcgacgaagagccgtgacccgcggggccggcgtgctgggccacgatccgcgcggccaccagcgcggccaccaccacggccatgcagaccagcccgtcgtccttgagcccccacctgatcgcggcgagcagcgcgatgccggccaggcacagcagggcaccgacggccgcaccccacccgcgcgacatcaccgcgggcgcgccgtcccagccggacagcgggttgttctccagcggccgcagcgcgacgaacagcaccgccacggcgacgaccaccaggagcacctgcgcgacgctgatggcgaggaagtccggcgcgcccggaaagcgcgggcagcccaggtaatcgaaggccaggtgcacgccgagcagcaccggcatgtgccacaggtacagggtcatcgcgccggagttgccgatggcggtccaccaccacacccgcggccgctgcgcccagcgcgcgatcgccggtgcggccgcgatcgccaacgcgctcaagatgattgcgtgcccggccagcagcagcgacggcgggctggtgttggacaggtggtggtcgccggtgccgaccatgctgagctgatacgggccccagtgcaccagggcgacatccgcggcgaagaaggcggcggcgacggccagcgcggcacgcccaccgagcaggccgcgacggtaggccaccccgaacatggccggaatcagccagatggccaggttgaggtaacccagcggcatcatcgccggccagtgcaaccggatcacgtcgatcagcgcgatggccccgtagaccgccgccacgccggcggcaaggcgcccggtggtggtgatgcggtacagcacgggcatggcggccagcaccaggacgtaggcccccaggaaccacagcagctgtgtactgacgccggcgatcggctcgtagatgtgttgcggcagagcctgatacagcaccgtcagcatcaccgcccagaacaccagatagtagaacaccgggcggaacagccgggtgcagcgcctcatcaaccagcctccccagtcggtgccgggtgtccaggaggacacgcacgccgccgcgccggcgaagaagaacagcggcatgatctgcagcaaccaggtcatcgcctggaacagcgccgaggtggtgagcaggttgtcccagatcaagacgtggtcgcgaatgatgctggccgccatcacggtatggccgagcaccacgccgcccagggagacgatgcggatgacgtccagcacgcgatcgcggtcggccggtgtgcgcgcggccacctcggccgcgtcgggaaatctcacaggagttgtcatggaagcgaaatgcccttctgctgatgcggatgcgttgtggtggagcacaagtcgtgcaatgagggaagcgtcgccgatggcgcgggcgcggacctgcgcggttctacgcgttacggcgcagtggtactactcagttcgcggtgttgagcgggtcgtaatcggcgagcagccgttcgatgcgggcctcgtcgagtcgtacccgcacggtggcggcctcctgctggtcacggatcaccttggccagggtgaacgcgctcgacaccaggaacaggaacgtgacgccgaggaacaaccggggccacgggtcgagcgggaggaagtagatcccgccgagcgcggccacgaagctgatcgcgaacgcgacggcggcctgaacgaagaaggcggcggtggttttcggcatggtgtggggaacggtcatgcggataagcctgcggcagcgcaccgcccgcggggatccgtaagactactcagattttgcggtgcgttcgcggtgccgcgccagcaggggcgccgcgcccgcggcgcctaccccgatcgccgcggcggccaccgtcgccacctggaccggggcgaactgggagtccaccagcggtttgaccaccgccaccaccgccagcgcgggcatcaccagccgcacccaccaggccaccacgctgtcgccggggatccgcgaattagcctctgcgacaagcacgtacagcgccatcaggagtaggggtgccgcgcccaggatgaccattccgatcgagcgcatgccgtgcgccgataccacgacggcaaccaccgcgacgagccccatcaccgccagtcgcagacccgcgttcggtgtcgccccgcgcatggccgccaggcccgcggcggtgcgcgtcgcggcccatccggtgaccagcgcggcggccacggccaacgcgatgccggccgccgccatccaccgccggccctcgtcggtgtagaactcgggcaccgcctcggccagcatcgtggcgctccatcgccacggccccgccacaccgcggtgatcgcccacccacaacacgaccgccgccgctgccaccaccgcggtggccagcgacatggaccgtcccggcctggcgatgcgcggggtgcggaccgtgagcagttcgacgccgaccatccccaggccgaagccgacgagctggccggacagcgggcgcggcgttgccgccgacccgatgacgacgggatcggtgctgagcgtgacgagggcggtcaccgccaccgcgaggcagacgtagagcagcaggcccgcgagcacgagcggcatcgccagtgacgccacggcgcgggtcgacgcccaacaggcggcggcgccgacgacgagcgccgcggccgcggcgccgaccggcagccacgacacgatcgcggcgggatcgtcgccgggcgaaagcagctgcagcagctgcaatccgagcgtggccgcgaattgcgcggccagcaccaggtaggcgagcaactgaacgatgcccgcggccgtccccgctttccggcccagggtggcaccgatcaactcggcggtactgcgcgcctgcggcgcatggcgacgcaaccgcgccagcgcgtagatcaccggaatcatcaccgccgcgccgagcagcgcgcccagcccgtaccacgccgcgggcgcgatcaccgccatgctcagggcggcggcccgccacggccccagcacgtactcccccgacccgggttccggccgcgcttgcaccggtagcgatttcttcggcatcgcctaagcatgacgcagcggccacgcaattgatcccggaacgcggcgcggtttcgatacttttgtaggtccaacggcagtgagggctcagatatgactgacacggtcaaggtgtccgtggaccgcagctcggtcgccatgggcgacgatgtcgagtcgcaccgcgaattctgggttttccccgaatcggccacggtcgacgacctactggtcgagatttcctcgcacttcttgccgggaatcgccggaccggccggctggcgcgtgtacctcgggactcgtcgcgatgagcggcaggagatcggcctcatctacacccgcgatgacctcggacagcaggaccaaatctgtcggttgtcggccggcaaaacaacgctgggtgagttggcccgacgcactggactacccgagctggacgtctatgcgtcgtaccttaccttcgaccgggcccggcctttggcactcgacgagatcacggggggccccaccttcaccggctgccgaccggacaaactggaatccgaggcggccgccgacgccaagcgggattgggtgatgttgcgtgagctggaccggcgcgccgccgccgtcgccggcacgcgccgggactgggttcggcgcaccctgctggccgctcccccgccgtggatcgatgtcttcatcgcacgcaactttcactacctgaccgagctgcactgcccggccagcatggctctggccgcaaagttgttgggcgtcaacgagtcccctccggaggacttcgcggcccgggcccacgcggacgtccggcccaacgtcgtgatcctggcgatggtgctggccgcgttcgaatggggaaccgagcgcgacacatggcgcgtcggcgaacgaccgcaccgcaaggcctatctcgagctgctcgcccattgcggctaccggctctcgccgatcgagcaggtcatggccggccacatcggcatcgagcagctcaagctttccgaggccgacagcgccaggctcgaccgcatccggcaactgcgggaccagcaacaccagctccgcatgagccgctactacacaaaaaccctcagcgaggagcagtaccgggccgccatcgaacccgtccatgccgagctttccagtttgggagagcttcccgggccgatgtaggtcatcgagaccggctgcgatcgaacagaatcggtggcgcccgcggttacttggcgggctcgcccggttcgggagcaccctggcggcgcgccgcgagcccggtcgcgatcgatgcggcggcgatggtcagcagcgcaccgaacatcagcgccgaggcttcacccggggccagcaggtgctgctgggtgccgatggtggccgccgccaccggcaccccgagctgcgcggccgagagcaccgccagggtgagcggctggccgagcagcctgccggcgcaatgtgccagcaccgcaccgcatcccaggccggcgcccagcaggatcagctgcgggtgcgcccccagctcccgcacctgcagtgaggcgcccagccacacgaagaacagcgggctgaaaaacccttcggtgatgccgaagagctgacgggccaaccggtgcggctcgccgaccgcgccgaccaccaggcccaccgcgaagcccgccaacataatcgacacctgggtggccaccgccagcgccgccagcgcgaacagcaccagcaggctggtccgcaattccagcgcgaaccggtgctgctcggagtaggcgtgcagacgtctgcgccagcccttgcggtcgaccgcgcgcagcaacacgaacagcgccgccgcgcaacccgccaccgccagcgagcccagcgtcgccgtcggcgcccgtcggatgtcaatcaccaacggcagcaacacgatacaggcggcatcggcgatggcgatctgcgtggtcaccgacagcacccgcggtccgcgcagccgcagcgaatcgatcaccggcagcgccagcgccgccgacgaggacgccatcagcaccgcgtagagcgccgcgtgcccggtgtcgaactgcaccgccagcgcgacacccaacaccgccgcgatgccgcccgccagcgtggcgcgggccagcgccgccggcaacgccgagcgcatcagccgggcgcgcagcggaacatgggtgcccaccacgaacataaccaacgcgaagccgatgttcgccaacagctggaacgtcgggtcggcgacgtcgacgacaccgaagccggtccggccgatcgccaggcccgcgatcagctcaccgatgaccaccggtatgcgaaatcgcttcgccgaagccaacaacggaccggcgaaaccgacggcggtcagcagcgccagggtgtggaagccgaatccctgcacccgctcattctgcacgccgcgcgcagatccggcggcgcaacaccggggcgcgggcggatagatcaggcgtcgatgaccaggcggtcgtttttcgccctggagacgcagaccagcatttcgtcgtcgccctcgacggtgcgcccgcgccgatccacttgcccggcaagcaccttcaccttgcaggtgccgcagaatccctgctggcaggaatacggggtggccggatcgcggtcgagcatgacttccagcgccgagcggttccccggcaccgtgagcacccgccgcgagcgggccagttccagctcgaacgggacgccgtcgaccaccggcggcggcccgaaccgctcgtagtgcagtggcgcgtcggcgtgttcgtcgcgcgcggtgcgcaccgcttccagcatggcggtgggcccgcacacgtacacggcggtcgccggcccggcctcggcgagcaggtctgcggcggtggggattcggccgcgctcgtcgtcggcccacacgctgacccgctcgggcgccacggccacgacctcgtccagcagcggcatgtcgtcgcggctgcgcccggcgtacacggcgcgccaattgatcccgtgctgctgggcggtctggatcatcggcaggatcggcgtcaccccgatgccgccgatcacgaacaacacgtcacgctcgtcggtgacgagatagaacgcgttgcggggaccctcgaactcgagggcgtcgcccaccctgaaggtgtcgtgcatctcgatcgagccgccaccgccgtcttcgatgcgccgcaccgcgattcggtagtcggtgcgccgtccgggcgggccgcacagcgaatactgccggcgccggcccgacggcaaccggacgtcgatgtgcgcgcccggcgtccaggacggcaacaggccgccgtgcgggtcggccagcgtgaaggcgaccacgtcgggtgcgagctcctcgcgctgggtgaccaccgcggtggtggtccggcgcaccggaaccacccgcgcgggtgtccaccgcgacgccgacgccaggccgccgaacagcgcacccacgccgtacaacgccgtgtacatccggtcgcgtttgcggcggccgtacaggtcggccggaatgttttcccaaatcgcttgtgccatagtcatcctcacgtctgtcccgtgtggtggccgcccgccggccgcgtcgtcaggtcgacccagtcgccggtgagccgggcgatgacgtcgggatgggagttgaccacccagtgtccgccgtcgatcgggacgacccggctgccgtccgggatggagccggtgaaccgttgcagggcaggcgatacgaagtagtcccggcgcgcgacgatcacctgcaccggaaccgaggtctgcggcagccgcgccggcggcgacaggatcggtcccggcatgttcgcccggtaaaggttgagcccgttgaggtagtcgtcggtcgaccggtacccggctccccgctgggcgccggcggtcgagccgccgatacgttcaacggcctcaaagactttcaccgtcgccccagaccggatcgcccactccggcgcactcggggccaaaaagaaccagatgtaggacgacgccaggatctgcttgacgacgtcgaggacgccgcccggcgtgcgcgccgagcgcaggaaccggccggcgtagttcaggtgcgggccggagatcgaggtgaacgaggcgatcttgcccatcaccgactcgtcggtgaccgccgcccagccctggatggagccccagtcgtgggccagcaggtgcacgctgtccacgccgagccggccgatcaccgcgtcgacgtcggcgaccagctgatccagccggtagccggaacgctctggcggcgttgacgattggcccgcgccgcgcacgtcgtaggccaccacgttgaaacggcggcgcagcaccccggccaccccgtcccacacgtggtggttgtcgggatagccgtggatggccaggacggtcggccgtgcggggtcgatcccggtgtaggtgtgcaccgccagtcgcacgccgtcggtggcggtgaccgtggtggaggccacttcggtggtcatggtcagtgcgcggcccgggcggccggtgagcgggccaggtagtcgacggcgcgccccaccccgcccagctgggacgggtgaaagcccggcgtgtagtacgcgccgatcacccgcaggaactcgaacggtcccggcaccagaccgcggcgcgccgccgagaagtagtcgcgccagcgcggtttgctgcccggcggcaggtgcgggtcgaccgagtacatgaaccgcacgccgcggatgaacagccacagcaacgcgggggtgaccagcagctgggtgcgcacctgccgccagtacccggcgcgcaggtgcttcatggtgtcgaaggcgaccgccttgtgctcgacctcctcggcgccgtgccagcgcagcaggtccagcatcaccggatcggtgcccagcgcgtcgtgttgcggggtgtccaggatccattcgccgaggatcgcggtgtagtgctcgagcgcggccaccatcgagacccgctccagcagccagctctgccgtcggcgcgggctccagcgcggccggtcaccgatgagttggccgaacagccaacgcatttggtcggtgaacggggtcacgtcgatgcccttggccgcgaagtgcccgagcaccccggcgtgcgcctgggagtgcatggcctcctggctgatgaagccctgcacgtcgcgccgcagttgatcgtccttgatcagcggcagggtgtccttgaacgcctcgacgatgaactcctcaccggccggcagcagcaggtgcaacacgttgcagaagtgcgtggtgaagggctcgcccggcacgtagtagaacggcagcgccgaccagtcgaagtcgacgtcgcgggcctgcaggacgatccgctcgtgatcgagggcggcgtcgtgcgggccggttgccttgtcgtcgacggtgaacatcgtcgtcttcccttccgagtagcgcgccggtcaggcgctgcgttgcgcctcgtcctccacctcagtgatcatccgctcggtgcgcaagaaccgcaccaggtggtcgaccgtttcggtcagcgccggctcccgcagccgcaccgggaccagcccgcgccggtgccggtactgggtgttgtcgtagcgcttgtcgcgcatcgcggcgatcttgtccgccgagcgggtgaggaaatcgaccagcggatacatctggtcgtccggcgtgcagcgccggttgagctgctcggcgaacgaatcgatgtcgtggtagtcgaagcggtacccgtaccgctcggacaggatccgcgtcacgtcggtgaggttgtagtagtcgtcggcggtcatgttgaacacgctgcccgactcgtccggcagatccatcagcgcgacgatgtgatcggcgatcaaatccgccggcagcaggctgatctggttgagcgcgttgacggccagcccgtgctcgatcatgaaggcggtcagccgcaccaggatgtcgtcctggctgccgaagccgctgcgggtcggcgagatcagcgacggccggtagatgcggacgtcgagtcccttccgctgcgcggccagcgccaactgctcggccacccacttggtctgcgagtagccgaagtccaggcccgccatcttctcgttggcgtcccactctcccaccaccggctgggtgctccagccgtagatgaaggtgctggagaccaggtggaaggtcttggcgtggtcggtcatggccagccgcaacaactctcgggtgccctccacgttggtgggccgcagtgcatcgtaggtgcgcacgtagttgaccaacgcgccgttgtgcacgacggcgtcgacgtcgcgcgccagccgcgcgaaggccggctccccgatgcccagcgcgggctcggcgagatcaccgcagatcacccgcacccgggcgcgcacctcggcttccagcgccggtgtccacagctgggccttgcgcagcgaggcgacgatgcggtccagcccgtgcccggggtcggtggcccggaccagcgcgtgcaccgtgtagggcgtccgcgccaacaggctgctcagcaggaacggccccaggaaaccggtcgccccggtcagcaggatgtcggtgggcgtgcccgcgcgggcgggcgccgggtcgggcagcggcagcgccgcgtcggcgcgcatctgggcggcctcgtgcgcctcgtactcggcggaaatctgatccagcgcccggcgcaacgcgtccagcggctgcccggaaccctcgccgaattgccttatcagagagaagaattcggctaccgtcaggcgctgcagcaggcgcgtgttgacctcgtcggccaactccgccgcgccgtgctcggccagcagggcctgcatgtcgttgcgcagttcggccagcgccaacgagtcgatacccaggtcggcgaacgagcagtcctcgtcgccggtcaggtcgtagctctcgatgaggttggcgaagcgttccagcgggcccgccccggcggccgtcccgtcgtggccgcgggtggccgccgggttcacccagctggagaacgtcggcagggcgccgtccagccacagctgacgggtgctggcccggcggatcttgcccgacgtggtcttggggatgctgcgcggcggcgcgaacacgatggtgtgcggatcgatgtggcagtgccggcggatcgcgcgggccaacgcccgggcgtccggcaggttgtgctcgtcgcgcacctcggcgaccaccaccagcgcctcctggtcgtcctgctcgacggacagcgcggcgacgcagccgccacggacctgcttggccgagcgctcgacgacggcctcgatgtcggaggggtagcagttgacgccgcggacgatgatcaggtccttgctgcggccgcagacgaacagctcgccctcgtagaggaagcccaggtcgccggtgcgcagatagctgtgctcgtcgtcgccggccaggcgggcttcgaacatctcggcggtgagctgcggacggttccagtagccgcggcccttggacggtcctgccagccacacctcgccgactcggccctcacccagcgcctggcgcgtctgcgggtcgaccacccggaccacggtttcctcgaggggcttgccgcagctgaccagcggcacctggttgctgttctccggcagcgccttttccacccgcgcgacgttcttttccaggccgcgcttgttcaccgtcagcgtctggcgcccgcggatggacacgatcagggtggattcggccatgccgtaggcgcccgtcagcgcctcgggccgcaggccgtacggggcgaaccgctcacggaactggtggaaggtgttggcgcgcaacggttccgcaccgacgacgatgcattccaggctgctcaggtcgatgccggccagctcggccgcgggcaccttgtcctcacgcaggcagtattcgagcgcgaagttcggcaccggcgtgtgggtggcgcgcacgtcgctgatcagccgcagccaggccgacggccgggccaaaaagtccagcggcgacatggcgtgcgtggtcccgccctgcagcaggatgaacatgtaggccgagatcaggcccatgtcgtggtgctgcggcagccaggagaccagcacctcgctgccgccggtgaaggcggagacgttggcgatgacgttttcgtggctgacgatgacgcccttgggatcgctggtggagcccgaggtgtactgcaggaacagcacgtcgccgggggtgtcgggcaccggggcgccgccgaattcctgggcgccgtcggtggcgaaccagggcagctccggcaggccggcgtcggaccagggttgcccgccgtggcgctgaccgagcagcatccggaagtcgtactcgaactgcttggtcgacagcaccgcccgggcctggcagtcgcgcgcgatgaagccgagcttggccagcccggactcgaacgacatcggcagcggcgggctgaccggaacggcgatcacgccgatgcgggcgcaggcgtacagggccgccaccatctccaggcccggcgggtagaccagcagcgcacagtcacccgcccgcagcccggcctcggtggacaggtaggcggccagctcgcgggtgcgctcggcgaagctgcggtaggtgtagtgctcaagttcgcggccgtcgacgtcgacgaaccggaagagggtttgctcgggcctgcgctgttcccacaggtgcaggtaatcgatcagcgtctccatagtcgagctatcccctttccaggctgggctcagccgagtacgacttgcaatcatgaatatgaaaccaatgtagtcccgccggccggtgcggagcaaagcagttgagggccttaatggccattacacattgcattcacagcttgaattgaagcgcccgaattgaatacgccgatcctgagctacgccgatacgcacttcagtacatacgtggtggttcaccaggaggaacggcgcgcactgatccgagaatactgatctgctgatctacgaattcccgcatttcatattccggttccggcgcgaatcgattgccatggaggcggcgctcaataacgaaatcgcaaagcggggaattgtaaattccgacgtggattcggcgggtcgccggcgcgtccgggtccctcggcgggcccacgggtgagccacccggcgcgcccctgatctactgacccgggcggggccgtgaacctcgtcacgtcggcgccacggcccgggcccggccgacggtggccgacccgaccggggcgatgcggatgcgcggtccggcgcgggccaccagttgcacgatgcccacgaagcgttccccgtcgatgatcggcgacagcggctcgtcgagggcctcgatgatcatctcgtggccggtgacgtcgcgcagctcggcaccgcgcagcatgccgttggtcagcgccagcggcagctgcaccacgatcttcgacggccgcaggtctccggcctgaaagtgcagcgcaccgggttgggccgccttggggaacagccgcagtggaccgccgatgcgcaggtcgatcgccccggcgtgcagcagccggtgggtgcgcgacggcacctcgtcgccgtcgatgaccacccgggcgagcgtcggggtgaacaggatcgaggcgtagttcggggtcctcacccggctcggggcgaccttggaggtgatgtagtcgccgaagctgcgggcgatcacccgggcgacggccaggcggccgtgatcgggggcgtcgtagtagcggtcgtagaagcggttgccgacgcccccggcggccagcccgaagcagagccggtggaacgcggcgccgtcggcggtggcgccgtcgagccgcagggtgtccagccgaacctcggccggcggccgatcggattcggccgcggccaccaacgcgcggatgatcgcctcggggtgtccgcgcaccccggccttgcgcgcgacggcgttaacgctgccgccgttggtcggcacgaacgccggccagctgtccgggtcggcgacgccgcgttcgatctcgttgatcagccagtgcagcgcgccgtcgccgccgtcgcccaccaggtgggtgacccgggggccgatccggccgagggtgtcccggagttcctcgatggaggcggtctcgtgcacctcgccccacgggccgacgatgcgccgcaactcggcgatgcgcgccggcgacgcgccgcgattcctccgcgctttcggattgacgatgacgcctagatacatccggcgatcccccgcgcgtacctgacaaaacaccgccgtttcggcgaccgctccggtgggatgtcgctggtcatcccaggcacgatacccgcgcgtaccgctgggcgggcaatgcgtccggtgcgccgcgggggcggccgtcggcccgtcggcgccctgcgcaggtgcgaagttagggtgtctgtcagtgtcagggtgaggttgccgcgtgttgcggtggttggatcctgatcacctggtgtctggctcgtagggtgcttgccgcgttggggttggcgttcatgcgttttgtcgacgccaggtgtgaaggaccggccggcgtgacttgataggagcgtggcatcgcccccactgagatgtgtccgccgaccggcccaaccgtcacctcacagtgaaggaggcaacctccatggttgttgttggagccgatgtacacaagcgcacgcataccttcgttgcggtcgacgacgtggggcgcaagctcggtgagaaggtcgtcgcggcgaccaccgcggggcatgccgaggcggtgatgtgggcccgggaacgcttcggaaccgaggtggtgtgggcgatcgaggattgccggcatttgtcggcccggttggagcgtgacttgatgggctttggccagtcggtggtgcgggtgccgccgaagttgatggcccaaactcgggcgagtgcacgcacgaggggtaagtctgacccgatcgatgcgttggcggtggcgcgggggtttttgcgggagcctgatctgccggtcgcttctcatgacgaggtttcgcgggaattaaagttgttggtggatcgtcgcgaagtccttgtggcgcaacgcactgcgacgatcaaccggctgttgtggcgggtgcacgaactcgatcccgaccacgcacctaaggctggttcgctggatctggccaagcatcgccgcatcctgggtgactggctggtcacggtgcccggcctggtcgccgaactcgcccgtgacgagctggccgacatcacccggctcaccgagaccatcaacgcgttggccaaacggattggcgagcgtgtccgcgttgtggccccggtgctgctgtctcttcctggctgcgcggagttgaccgcggccaaactcgtcggggaggccgccggagtgacccgtttcaaaagcgaggccgctttcgcccgccatgccggggtggcgccgattccggtgtggtcgggaaacaccgctggacgagtccggatgacgcgctcgggcaaccgccaactcaacgccgctttgcaccgcatcgcggttacccagatccgtcttgacggcctcgggcagacctactaccggcaccgcatcgccgtcagtggttccaagactgaagccctgcgctgcctcaaacgccgcctggcccgcgtcgtcttccaccacctacacaccgaccaccaaaaccgaatccagccttgccaaccggcagcggcttgacataggagaaactcatgcccgattggaccgcagcgcaactgccctccttcgccggccggaccgtcatcgtcaccggtgccaacgccgggttgggtgaggtcaccgcgcgcgagttggcgcgggtcggcggccacgtcatcctggccgtgcgcaacaccgacaagggccgcgccgccgccgaccggatggccggcgtggcgaccggccgggtcgaggtgcgtgagctcgacctgcaggacctggcgtcggtgcgccgcttcgccgacggcatcgacacggtcgacgtcctggtcaacaacgcgggcatcatggccaccaagcacgcggtgaccgtcgacggtttcgagggccagatcggcaccaaccacctcggccacttcgcgctgaccaacctgctgttgcccaagctgaccgaccgggtggtgacggtgtcctcgctgatgcaccacttcggctacatcagcctcaaggatctgaacttccggtcgcggccgtactcggcatggctggcctacagccagtcgaaactggccaacctgctgttcaccagcgagttacagcggcgtctggacgccgtgccgtcgtcgctgcgcgccctggccgctcacccgggctggtcgcacaccaacctgcaggggaactcgggccgcaaactcggcgatgcggccgtcctcgcggtcgaccgcatcgtgtccaccgacgccgacttcggtgcccgccagacgttgtacgccgtctcgcaagatttgccgggcgacaccttcgtcggcccgcggttcgggctgtacgggcggacccagccgacgtggcggaattggccggccaagcgggccgggaccgccgccgcgctgtgggagctgtccgaggaactgaccgggaccaagtttccgctctgacccggatttgcggcgtgggcgcgccgccgggccgccgtcgccgcgccggccgcccggggcggtgactaaattggtactgagcgcaaccccgcggggggtaggaggttatgccatgtcggacgcgaatctggccgccgtccttgccctgtgcgcggcactggcgtccgcggtcggcaacgtggtccggcagcggtcggcgcaggaggtcaccgacaaaccggtgggccatctggcgttgttcggcatgttgctgcgcgacacccgttggtggctgggcggtttgggcgacatcggcagttatgtgttgcttgccgcggccctggaccggggttcggtgctgctggtgatgtcgctgcaggtgacggcgctgctgttcgcgctgccgatctatgcgcggatgacgcatcacccgatcaccgggcgggagtgggcgtgggcgctgttgctggccgtggcgctggcggtgctgatcgccgtcggcgacccgaccggcggtcagcagcgggcgccgctgcagacctggctcgtggtggcggcggtgatcgggccgctgttggtgctgggtttgctgggcgcccgcgtctgggcggaccggccggtggcggcgctgctgctggcggcggtggccgggtcgttgctggcgatgttcgcggtgctgatgaagggtgtcgtcgacatcctggagcacaatcccggccagttgtggcgcagcttcgagttgtatgcgctggtgttctgcggggtggccgggatgatctatcaccagtcggcctatcgggccggcgcgctcaccgcgtcgctgccgacgatcatcgtggccaagccggtggtgggcggcatcctcgggatcatcgtgctgcgcgagaccctggtggccggcggctgggagtgggtggtcctggcggtgacggcggtggtggtgatcgtggcgacggtgggcctggcccgcggtgaggccgcgtccatgtcggccggcgccgggcgggacgtgcggccgaccgaccggcccaaggcggcctaccaggcctgacggcctacgggttgatggtgttgtcgccgacctggcggccccagacgtactcgagcgcgtagggcgatccggtgtccaggtggttgtagggcgcgatgctgttgccggtgtccatgatcagctcgggcgccggccacaggtcccgggtgatcttctgccagcagcccggcgcgcctcccggcccgccgcgggcgctcacccggggcaggttctcgggatagatgtaggggttgggcgcgccgccgaccacgccgacgatcccgcccaccattgaggcgatgacgggcaccgcggacaccgggttcgcgatgaggcccagcccggagagcgcctcggtgttcatgttgagtgagtagccgttgaaaccgccctcggccgcgccggtggcgggcagcgcgtcgtgttcgttgcgcatcaggcagtagatctcggggctgtaggtgtccagcagttgggcggtgggcaccaggtcgtgggcgccgcgcgccagatacggcccgcccttggtgaacaggtcggcgccggtgttgccgaacccggccgccgacaacagcgcctggtccagatccttctgctgggcgttgatcgtccgcgaggtgatcaccgcattgttcagaaaatcgaacaggtccggcgaggcgtccgcataggtgtcgcccaacgccgccaacccctgaatgtccttgcgcgcctgcggcatccgcgggttcacgtcatcgagcaaagcattcgcgttgaccaccgactggccgaacttctcgcccagacccgacaacgactgcgcggccgcgctcaacgtcagattcagcttgaccggatccaccttctccgcgatcgaggtgatcgtctgaaacaacgtattgatctcggtcgtcaccgagcgggcgtcgatgatggtgtgcggggtgatcttctgcggcgacgggtgcgccggcgtcgtcagcgacacgtacttgccgccgaacaccgtcgtcgccttgatgtcggcgttcacgttcgacgggatcagcttgagataccgcggatacacctcgagggtgaatttcgccgccggctttccgtcgcgcaccgtctccgagatcgtgcccacccggccgatctcgacgccgttgtaggtcaccttcgacccgggatccatcaccagcccggcccgcgacgccagcatcgtcaggctggtcttgggcgtgaaggcgccgcggaactggccgtagatcagcgccagaatcagcgacagcaccagcagcacggcgacggcgagcaacttgtacggcgggatgcgctgggaattgatctgcataagtgaatcactattcgcgtctctcgacctcaccgccgccgccccttgtgctcgctttgcgcgcccatttcccgcgttgtaggcaacctcacctctggttcagacctctgaaatgtaccgcgacggccgcacacatgcgaaccggtgttcgcaccgccggcgggccgtgtcggtcggcgggaggcgatgccgacgccgcggcctgccgggcacggattctcgttatcgccaccaccatcgggcacccactcaccttattcttggcgaatgtccggccgtctcgcgtcccagccctcggcggggcgctggcatgcgatcggcctgatcgcattcctgtggctggtcggcatctactcggtcaaggcgcgcttgggcggtgcgggcgacccgcggctgtacgggctgctgggcggcgcggtgctggcggcggtggccgccgcattggtcggtcggctgcgcggccggcaggagagccgggcgctgctggccggatggccggtggcctcgctgctgctcaccaccgtggtcggtgccgtcgacccggcggtcacccgcgactttcccggcaccatcacgatcacgttcgcctacatcggcctcacctgcccgcgctggcgaatcgtcgcgctgcttgctgatgaagtcggccaccggctgctcatcggggtagttggccgggaagctgatgtcgacgttgtagccggggtcggccatctggatctggcacgtctggccggtgttggcgcccttgaggtcggcgcagtagtccttcggcgcggcggcggcaccggcagggccgacgagaacgagggccgcggcgaacgctgccacgctgaaactgcgcatgttggatccctccccgaggactcacgctaccgatgcgacggaattgagctaaagataagccatcgcgccgccggccctgcttgccggacttcccgcacgggcccgttggccaacgggccgcagggcagcaccggttgacaagcggcatggaaacggcccccggagcttcctccgggggccgtttcacctggtagcggggacaggattcgaacctgcgacctctgggttatgagcccagcgagctaccgagctgctccaccccgcgttggtgaatgccaggttacccaaccggtgtcacgccgaccaaatcgcgcgctcagcgccggtgccgcgccggccgtggccgccgttatttggtgttgttgtacttggtgatcgcgtcgtccaaccgctgcagcgccgcgccgtagccggcgaaatcacccttcttctgggcgtccttggccgcgccgatcgccgcttgaatctcttgcagcacagcggctttggcgggagacagcgtcaccgaaccgtcgggaaccggcggcgcggccaccggcggtgccgatcccggcgtcacggccggcgccggcgcgttggccggcggactcgccgcgggcgccccgccttcggtgggctgaatgttggtcgccgccgcacccgcgcccgggccgaacagcccggtcagcgcgtcgcgcacggtggggccgtagccgatcttgtcgttgtacatcatcgccacccggatcagccgcggatacgacgacgccgcgtcgctggcccccggcgaggcgtacacgggttcgacgtagagcagcccgccctgaccgaccggcagggtgagcaggttgccccaccggatccggttctggttgtcgcgcccgatcaccccgaggtcctgcgacaccgccgggtcggtggtgatcgcgttgttggccagcttgggcccgttgacttggcccgggatggtcagcacggtgatccgcccgtacgtcgccgggtcggagctggcgctgatgtaggccgccaggtagtcgcgcttgaaccggttcatcgcgctggtcagctgatacgacgacgaattgtcgttcttcgcaatgtttttcgcgacgatgtagtagggcggctggtagctgctggccgtcgggttgggatccagcggcacgtcccagaaatccgaggtggagaagaacgtcaccgggtcgttgacgtgatacttcgccagcagcatccgctgcaccttgaacaggtcctcgggatagcgcaggtgctcggccagctccgggctgatgtcgctcttgggtttgacggtgcccgggaagacctgcatccacgccttgagcaccgggtcctgctcgtcttgctggtacagcgtaacggtgccgtcgtaggcgtccaccgtcgccttgaccgagttgcggatgtaggagacccgcttgtcgggcgccagcttgttgaacgccacctcgttggagtccgcggtggccgactccagcgaggtcagttcggaatacgggtagttgtccagggtggtgtagccgtcgattatccacaccagccgcttgttgacgatggccgggtacaccgagctgtcggtggtcagccacggcgccaccgcctccacccgccgcgccgggtcacggttgaacaggatcttgctgttggagccgatcacgttggagaacaagaagtttcgctcggcgaacttggcggcgaacacgctgcgcgacaaccagtcgccgatcggcaccccacccagcccggtgtaggtgtagttcttggtttcggtgctggtctcgtagtcgtattcgcgatcggcgccgttgcgcccgacgatcgcgtagtcggcggaggtgttggagatgaccgggccgaagtagacgcggggctggtcgagtggcgcgggaccgtcggacaccacattgccgttggcgccgacgacgttcaccaggaattcgggatagccgccgttttggttggggtcgttggcgattccgcgcaccgtgttggccggcgaggcaatgaatccgttgccgtgggtgtagacggtgtgccggttgatccagtcccgctggttgtcgatcagccggtcggggttgagctcgcggaccgccaccacgtagtcacgcaacgccccgttgcggtccaggtagcggtcgatggacagctggtcgggaaagtagtagaagttcttgccctgctggaactgggtgaaggccgggctgacgatcgtcggatcgagcagccggatgttggaggtggtcgcccggtcgtcggcgacctgctgggcggtggcctgcgcgtcaccggtgtagttgcgataggtgaccacgtcgctggtcaggccgtaggcctgccgggtggcggtgatgctgcggctgatgtattcgctttccttttgcgcggcattgggtttgacgctgatctgctcgacgatcaacggccacccggcgcccacgatcaacgacgacagcagcagcagcaccaggccgatcgcgggaatcctcaagtcccgcatggtgatcgccgagaacaccgcggccgcgcagatcagcgcgatcgccatcaggatcagcttcgccggcagcaccgcgttgatgtcggtgtacccggcgccggtgatcggcttgccgccgcgggtgtgcgacaacagctcgtagcggtccagccagtaggcaaccgccttgagcagcaccagcaagccgaccagggtgaccagctggatgcgcgccgaccggctcagcgcgccggtgcgcccggacagccggatgccaccgaagatgtagtgggccaacaggttggccacgaaggccaggaacaccgcgacgaacaggtaggacagcagcagccggtagaacggcagctcgaacgcgtagaagccgaggtccttgccgaactgcggatccttgatgccgaaatcgccgccgtgcaagaacaattggatgcgcacccaatagctctgcgcgatgatgccggccagcaggccgatcgccaccgggacgccgacgctgaccagccgcagccgggaaaggaccagggcgcggtagcgcgccaccggatcgttgtcgttgctgggcacgaacaccgggcgggtgcggtaggccaccgccaggccggcgaacacgatgccgcccaccagcagaccggcgatcaaaaagaccacgaagcgggtgaccagcacggtggagaacaccgagcggtagccgagctcgccgaaccacagccagtccacgtaggcgtcgatcagccggggacccgcgagcagcaatgcgatcacacccagtgcgatcaggatcagaatccggctacgccgggtcagcttcggcatccttgcggtgggccgcatccccactggctacgctccctgatcgattgctagacggtgacaactctacgcactgggaaaaccggtgatcgcggctagcagctcggcggttgcccgcccgcggtgatcgcgtgcagcgcatccaccgcctgggcgagcgtctccaccttcaccaggcgcagcccggacggattgtccgagctggcctcgtaacagttcttcgccggcaccaggaagacggtggccccggccgcgtgcgcggcgaccatcttgtgggtgatgccgccgatctggccgaccttgccgtcggcggagatcgttcccgtcccggcgacgaaattggagccggccaagtcaccggtggtgagcttgtcgaccaccgccaggctgaacatcagcccggcggacggcccgcccacgttcgcgaggttgaagttcaccacgaacggcgcccagggcgcgtcgagcacggcgacacccaggaagccgtaatcgcggtccttgttggcgcccagcgtgatctgcgccacaccggcgggctcgttcttgcgccggtagtcgatcgtcacggtctggccgggcttggtgttcttcaacagcccggtgaactcctcgaccgtggcaaccggggtgccgttgaccgcgtcgatggcgtcgccgaccttcagcttgccggccgacgggccgggctcggggaccttggccaccgtcaccgccgacgggtacttcaggtagcccagggcggcgtaggcggcgctgtcctcggattgcttgaagtcggcgttgttggccttgtcgacatcctcgcgcgacttgccgggcgggtagatgaggtcgcgcggcaccagctgctcggtgtccgaaagccacagcgtcagcgcctcgcccagggtcagatcgtcgcgctgggacaccgtcgtcatgttgaggtgaccggtggtcgggtgcgtcatggtgccctcgatcgccaccacctgcttgccgtcgacctcaccgagcgtgtcgaaggtggggccgggccccagcgacacgaacgggaccgtcaccaccgccagcaacacgccgaacaccacgatcggcaccagcgcgaccatcaaggtcaggatgcgcctgttcacgccgattacactagacggagcccgccgtctcgctgtcagccacaagggcccgctacagcgttcagctacaagctgacccgaggccgcgcgttgcgatgccacggtgagtaccgttgaggttatggccgacctgcctttcggtttctcctccggggaggaccccgacaagcccgggaagaaagacccggattcgggctcgaacccgtccgacccgttcgccgcgttcggcatcagcggcgagttcggcatgggcgatctggggcagatcttcacccaactgggtcagatgttttccagcgcgggcagcgcttcggccggcggaagcgattcggggccggtcaattacgagttggcgcgccgggtggcgtcgaactcgatcggcttcgtggcgccgatcccggccaccaccaactcggcgatcgccgatgccgtgcacctcgccgaaacctggctggacggcgcgacggcgctgccggcgggcaccgccaaggcggtgggttggacgccggccgactgggtggacaacacgctggaaacctggaagcggctgtgcgacccgatggcccaacagatttcgacggtgtgggccgcctcgctgcccgaagaggccaagagcatggccgggccgctgctgcagatgatgtcgcagatgggtgggatggcgttcggctcgcagctcgggcaggcgctgggccgcttgtcccgcgaggtgctgacctcaacggacatcggtttaccgttggggcccaagggaattgccgcgatactgcccgacgccgtggagtcgttcgcctccggtctggagcgcccgcgcagcgagatcctgacgttcctggccgcgcgggaggccgcgcatcaccggctgttcagtcacgtcccctggctggccagccagctgctgggcgccgtcgaggcctatgcgatgggcatgcagatcgacatgtccggcatcgaggagctggcccgcgacttcaaccccgcgtcgctgtcggatcccgcggcgatcgaaaacctgctcggccaaggcgttttcgagcccaaggcgacaccggctcagacgcaggcgctggagcgtctggaaacgctgctggccctgatcgagggctgggtgcaggtggtggtggccgccgcgctgggcgaccggatcccgggcgcggccgcgctggccgagacgctgcgccggcgccgggccagcggcggcccggccgagcagacgttcgccacgctggtcgggctggagctgcggccccgcaagatgcgcgaagccgccgcgttgtgggagcgcctcaccgaggccgccggggtggacgcccgcgacggcatctggcaacaccccgacctgctgcccgacgccgacgacctcgacgaccccgcggcgttcatcgaccgggtgatcggcggcgacaccagcggcatcgacgaggcgatcgcccggctcgagcaggagggcccggacagccccggttccggcggcgatacctgagtaccgcggaacggatatcccggaactgatgacaaggacccgcctgattatcagttggctcgcgcctggcgggcaccggatgttctcagcgtctcgtcggttcggctgtggatagctgagcggcgcggtcgcggccggcgtgccacagtgcagcggtgcccgcagccgccgtttccacccccgcggccacctacgcgctggatccggcgatgccggtgctgttgcggcccgacggcgccgtgcaggtcggctgggatccccgccgcgcggtgctggtgcgtccaccgcggggcctggccgccgccgaactggccacgctgctgcggtccatgtgctcgcccaccccgctgtcggagctgcagcgccgcgcgctcgagcacggtctgaccgacgccgacggcctgaggaatctcgtcacccaactggtcggcgccggggtggcgagcgaatgcgggcggtcgggcgggcgggcgccgtcggtgcgcatccacggccgcggcccgctgtcagagctgctggtggagtcgttgcgctgctcgggcgcccggatcgcgcacagcagccagccgcacgccgcggtgtcgggcgacgacgtcgacctggtggtgctctcggactacctggtggccgacccgcgcctggtgcgcgacctgcacgagcagggcgtcgcgcatctgccggtgcgggtgcgcgacggcgtcgggctggtgggcccgttggtgatcccgggcgtgaccagctgcctgtcgtgcgcggatctgcatcgccgggaccgcgacgcggcctggccggtgatctgcgcgcagctgcgcgacaccgtcggagtcgccgaccgggccaccgtgctggcgaccgccgcgctggcgctcagccaggtgaaccgggtgatcgcggcggtgcgcgggcagccggcggcgtccgatccggccccgccccagacgctgaacgcgaccctggaattcgacctgcacgccggcgccatcgtcgcccgccggtgggaccggcatcccttgtgttcctgttgatgcgggcgcactcgtgccggccctatcgcgctgacctgcgccaccggggtgtgacaacctccgttgtcgccgtctctccccatcgcgctggccatcatggatgatggttacgtgtcggatatcaaacggggacgtgccgcgcgcaacgcgaagctggccagcattccggtcggattcgccggccgggcggcgatcggattcggtaaacgcctgaccggtaagtccagggacgaggtccaggccgagctcctggaaaaggccgccaaccagttgttcaccgtgctgggtgagctcaagggcggcgcgatgaaggtgggtcaggcgctgtcggtgctcgaggccgcggttcccgaggaattcggcgagccctaccgcgaggcgctgaccaagctgcagaaggacgccccgccgctgcccgcggcgaaggtgcaccgggtgctcgacgcgcagctgggcaccaagtggcgggagcggttcagttcgttcgacgacaccccggtggcctcggccagcatcggccaggtgcacaagggggtgtggtccgacggccgcgaggtcgccgtcaagatccagtacccgggcgccgacgaggcgctgcgggccgacctcaagaccatgcagcgcctggtcggggtgttcaagcagctcgcgcccggcgccgacgtccaaggcgtggtcgacgagctgatcgagcgcaccgagatggagctggactaccggctggaggccgagaaccagcgcgccttcgcgaaggcgtaccaggaccacccgcacttcgcggtgccgcggatcgtggccagcgcacccaaggtggtgatccaggagtggatgcagggcatcccgatggccgagatcatccggcacggcaccaccgagcagcgcgacctgatgggcacccggctgctggagctcaccttcgacgcgccgcggcggctgggcatgctgcacggcgacgcgcacccgggcaacttcatgctgctgcccgacggccggatgggcgtgatcgacttcggcgccgtcgcgccactgcccgacggcttgcccgtcgaactcggcatgacgatccggttggcccgcgacaagaactacgacctgctgttgccgacgatggagaaggccgggttcatccagaagggccagcaggtgtccgtgcgcgacatcgacgacatgctgcgtcagtacgtcgagcccgtcgaggtcgaggtgttccactacacccgcaagtggctgcagaagatgtccgccatcgagatcgaccggtcggtgtcgcagatccgcaccgcccggcagatggacctgccgcccaagctcgtgatcccgatgcgggtgatcatgtcggtggccgccatcctgtgccagctggacgcccacgtgccgatcaaggcgctgtccgaagagctggtgcccggcttcgccgaacccgacaacgccatcgtctaggaacgctggctgctaggccgccgccccggcgcgccggccgtccttgcggggacgcccgcggggtcgtttgaagcccagcaccgcgccgcgatcgaggatttcgccgccccacacgccccagggttcggcgcgctccagcgccgccgccaggcactggcggcgcaccgggcagccggcgcacagctgcttggcccgctccaggtccgccggcgcttcggcgaaccacagatcgggatcgccgacgtggcacggcagggcttgtctggagaccgtcggtgccgacatgtcctatcaccttcttcctggttcggattgctctgctggtagtgatccggaccaggtcgaaaggtggtcgacccaacaactatggccacggatcctggtgacttcgggtccgtggccatctggggaaaaccgggctggtgcttaccttgccttcggcgggcccccgactcgtacggacgcgtcggtcgcggcggcggcgcgatgcttacgcgcgggcgccagggcggcggcgtgcgcggcgggaaggccggccgcggacagggcgggacgggtcgcgcaagccacgcctacgccgaacgcgttgccgatcatcgtggccgccctcctttccgtcccgctgagtttccgtactgccgggttgcggtatcgagggtaaacggtgaccgtcggccatcacaaccgattttgtgacctgcggattcgccagtcagcgaccgcggaccagctccagcacgtcggggccgtactgctcgagcttgcgcgcgccgatgccgggaatcgcgatcagcgcctgttcgtcgccgggccgcagctcggcgatggcgatcagggtgttgtcggtgaacacgacgtaggcgggcaccttctgttccttggcgacgtccagccgccacgccttgagccgcaccagcaggtcctcgtcgatgtcggcggcacacgtctcgcaacgtcgcagcatgacggccgccggggtggtcaggttgttgttgcagatccggcagcgggtggcggtgctgcggttgcggcgggacctggccggcgccgcctcggcccgggtctggggtgcgatgccgttgaggaatcgcgacggcttgcggctctgccgcccgcccgggctgcgggccaacgcccagctgagcgccaaatgtgttctggccctggtgattccgacgtagagcagccgccgctcctcctcgaccgcctcgctgtcggcgccgtgcgccagcgcgtgcgagatgggtagcgtgccgtcggccaggccgaccagaaacaccgcgtcccactcgagtcccttggcggcgtgcagcgacgccagcgcgacgccctgcaccacgggtgggtgccgggcgtcggcgcgcatccgcagttcggtcagcaggccggcgaagtccagctgcggacgccgcgccacctcgtcgtcgaccagttcggccagcgcgcgcagcgcctcccagcgctccctggcccgggtgccgaccggctcttcggccgtcagccccagcggttccagcaccgcgcgcaccaccgcgggcagcggctcttctcgggcgtcttcgccctcgcgctcggcggcgcgctgcagcgccagcagggcctgcttgatctcctggcggttgaagaacccctcgccgccgcgaacctgataggggatgccggcctcggtcagcgcctcctcgtagatctccgactgggcgttgacccggtagagcaccgcgatctccgaggcgggggtgcctgattcgatcagccgcgcaatcgatttggcgacggcggcggcctcggccggttcgtcggagtgctcgtggaaggtcggcaccggacccggcggccgctgcccgaccaggtgcagcttgctgccggccacccgtccgcgggccgcggcgatcacctggttggccagcgacaccacctgcggggtggagcggtagtcgcgttccagccgcaccacggtcgcgtcggggaaccggcgggagaagtcgagcaggaacctcggggaggccccggtgaacgagtagatggtctggttggcgtcccccaccacggtcaagtcgtcgcgatcgcccagccaggcggccagcacccgctgctgcaacggggtgacgtcctggtattcgtcgaccacgaagcagcggtagcggtcgcggaactcctcggcgaccgccgggtcgttttcgatcgccgccgcggtgtgcagcagcaggtcgtcgaaatcgagcagggtgacgtggtcgccgcgggccttgagggcttcgtaggcggcgtacacgccggcgaccctcgcggcgtccagcggaatgtcccgcccggcggcggccaccgcggccgggtattcctccgggccgatcagcgacgccttggcccactcgatctcgccggccaggtcgcgcacgtcgtcggtgctggcgttgatccgggtgcggctggccgcccgggccaccaccgcgaacttgctgtccagcagctgccagccggtgtcgccgaccacccgcggccagaaatagcgcagctgccggtgggcggcggcgtgaaaggtcagcgccgagaccgagcccaccgccgcgtcggtgcccgccgcggcggcgagcacccgcagccgcgagcgcatctcccccgccgcgcgctgggtgaaggtgaccgccagcacctgattggcggcgacatgaccgcccgcgaccagctgggcgatccggtgggtgatggtgcgggtcttgccggtgccggcgccggccagcacgcagaccgggccgcgcggggccagcacggcttcgcgttgctcgtcgtccagcccggcggtcaagggatcggcgagggttggcatggggtccatcttggcttcccatactgacaagtcggtgacgaacgggatgcatcgcgccccggcgagtcggcccgctcctgcgcaccccgctgcgcggaatgcttcgtcgccgggctccaccccaatcacccactcctgcgcatcccgctgcgcggaatgcttcgtcgccgggctccaccccaatcgcctgctcctgcgcatcccgctacgcggaatgcttcgtcgccgggctacgttatccggctatgacctctgccccgctcaccgtttacaccacgtcgtggtgcggctactgccaccggctgatgaccgtgctcaagtccaacggcatcccctacgaggcggtcgacatcgaacacgaccccgccgccgccgacttcgtcagctcggtcaacggcggcaacaagacggttccgacggtgaagttcgccgacggttccacactgaccaaccccagcgccgcgcaggtgaaggccaagctggccgaagccggcaactgaccaccgggtcagtcgagcgcggcccaggattcgatgatcacccgcgcgatcgaaatcgacccgggcagtaggagtttcgactccgagtcggacgaccaatccccggccgccagcgcggcgcgcacctcgtcgcgggtgaaccacgccgcctcggcgatctcgccgtcgttgaacgcgaagtcctgcgccgggtcggcgacggcgtggaagccgaccatcagcgagcgcgggaacggccacggctggctgcccaggtagcgcacgtcgcgcacggtcagcccgatctcctcgcggacctcgcgggcgacacacacctcgaacgactccccggcctcgacgaatccggccagcagcgagaacatccgctccggccacaccgcctgacgggccagcaccgcgcggtcgccgccgtcgtgcaccaggcagatcaccgccgggtcgatgcgcgggaactcctcgtgcccggtgaccgggttgacccgcgaccagcccgcccgggccggcctggtcggcgagccgtccaccgagctgaaccgcgaccgctcgtgccagttcagcagcgcgacggccgaggacatcagctggctgctggtgtcgtcgaagatcgggccgaggctgcgcaggttcaccacctcggcgcgcacctcgggatcatccggtgcctgcagcgcgccgcggatggcccacacgtgccggccgtcctcgaggcgccccaaaaacaccgcctccggcgggggcttgtcacccagctcggcggcggcgcccagcaccacccggccgtcggcgacgagcacctggttgcgcgagtccacccgcagcagcgccgcgtcggcccagcccgccgcggcggcctcgacatcggtgcgcaactggtcggcccgatcggcgcccacccgcgacagcagcggaacgctgcgcagctgaaagtccgcgatcgccatcaatgccccgcgctgcggatgtagagcaaccggtcgttggcctcgaccgcgtccacctcgggggcgtcgatgcgcagcagccggccgtcgcaccacgccgagcacgatgtcgcgcaggtgccggggcgagccgccgatctcggactgctcgacctcccgctcggcgatcgccaacccgacgtcgggcgtcagcaggtcctcgatcatctccaccacgctcggggtggtggtggccaggccgagcagccggcccgccgtcgccgacgacaccaccaccgagtccgcgcccgactgctgcagcaggtgctgattctcggcctcccggatcgaggcgacgatcttggcgtgcggagcgatctcgcgcgcggtcagcgtcaccagcacggcggtgtcgtcgcggctggtggccacgatgatggacgccgcgtgctgggccccggccagccgcagcacgtcggccttggtggcgtcgccgtgcacggtgaccaggtccgcgctctcggcgtgctcgagggtgctgcgatcggtgtcgacgacgacgacctcggcctgggtggtctcgtcgcccaggatggcggcgacggcggttttgcccttggtgccgtagccgatcacgatggtgtggttgcgcactctgctcctccaacgctgaatcttccacccttggcgggaccgctcggagagcacttccagcgtggtgccgaccaacacggccaaaaaggcgatccgcagcgcggtgaagatcagggtgtgcaccaggcgggcggtctcggtgtagggcgtgatgtcgccgtagccggtggtcgacagggacaccgcggagaaatacacgcagtccagaaaggtcagcgacccgcccctaagatcccggtagccggaccggtcggcgtagacgatgacggcggcggcgaacagcaccaccagcgcgatggccaggcgccgggtgatgacgcggatggggctggcgtgctcctcgggaatgcgcaccacgccgaccaactggtggccgcgctgggcggccagcgtctgattcagaccgctcagctttcgcgacctaccgttgcgcacggcggtccgtcatcgccttgactgctgcgctcgggacacgggtcttatgtaaccacgggaaccggtcgcccaatactcgggcggcgcgggtcacaccggcgcggtcggtgcgagcagaccggccaactcgtcggacgtcggcagcgcctcgggaaccaccgtggtgcgcgcccgcacgtaatggaaggcggtgcgcaccgacgactcgggcaccttcgccagcgccgcccaggccaggcggtacacggcgagctggacggcggcctggcgcatcgcttccgggctgtccggtggcgcaccggttttccagtccaccacggtggcgccgccgtccgattcggcgaacaccgcgtcgatgcggccgcggaccagcgtgtcaccgatcggcatttcgaacggcacctcgacggcgacgggagtccttgcagcccacggtgattcgaggaatgcagcctgcagctcggccaattccgcggtgtcgccgacgtcggagtccgccgcgccgggcaggtcgccgagctcgaacaggcactcggcgccgtagaacttttgcacccacgcgtgaaacgcgttgcccagcaacgcatgcggctccggccgggacggcagccggtgcctcagccgccgcgcggccccggccgggtcgcgggccaggccgaccagcgagctgaccgacagctggcccggcagggcctgcggcggcggcccggtcacgcgggcccgctcggccagcagcgcgtcgacgtcggcggcccagccctcgacgtcggcgcccggatcacccggctcggccgccatcgcctgccgcaccagcgccgcaccgcgctcgacctcaccgcgccgggacgccagcggatcggccggccatacggcctcgacggcgttgtcgcgcagcgggtttcgttcgccgtcggcgggcgccggcgcccactgctccaccgttccgcaggggtcgccggccgcggccgaggcgtcgatgacgtccttgatctcgcagaggaagtccgacgggccgcgcggtttgatgccggtggccgcccagtgatgcccggataccagcagggtgtcttcggcccgggtgaccgcgacgtacaacaggcggcgttcctcgtcgacgcgccgctgctcgagctggcggcggtgctcggagatcttgtccgacaactgcttgcggttggtgacgtcggaggtgtcgagcaccgggatgcccaacgcgcccgggcgggcgcggtcgccgcgcagcagcggcggcagctccgcggcgtcggtgagccaggtggtcttggcggtggtggagggaaagacgccgcccgacaggtgcgccaccgccaccagctgccactccagccccttcgccgagtgcacggtcagcacctggacgcggtcacgtgcgaccgccaatggtgctgccggcaaaccgttttcgaccgactcggcgacatccaggaaggccagcagaccggccaccgaggcggacgccgacgcgtcggtgccaccggtgtcggcgcgttcggcgtagccggcgacgacgtcggcgaacgcgtcgagatgctcggtgccggcccagcccgccgcggccgcggcgcggacttcgcaatccaggtccatcacccggcgcaccacggccaccaggtcgccgagcgggtggtcgaggtgggcgcgcagggcgctcagctcggcggccagcgcggcgatgcgcgcgtaccccgcagccgaatacccttcggccgggccgggatcggcgatcgcgtcggccagacacacggcgtcggcttcgacgttgcggggatcggcggcgctggcgatcgcctcggccgtggccggcccgccggccgtcccggcgccaccgagggcgcgggcgcgttgccacagcgcggccaggtcgcgggcgccgaggcgccagcgcgggccggtgagcacccgcatcgcagccgccccggcggtcggatcggcgaccagccgcagcatggccaccagctcggcgacctcgggcacggacagcaacccggccagcccgacgacctctaccgggatcccgcgggcccgcagcgcgtcggcgatgggcgcggcgtcggcgttgcggcgcaccagcaccgcggccgtgggcgggctgacgccgtccgcccgggcccggcggtagtgggcgtcgatgtggtcggcgatccattcgcgttcggcgaccacgtcgggcagcagtgcgcagcgcacggtgcccggcggggcgtccggccgcgggcgcagggcatgcacggccaccgaacgccggcgcgcctcggccgagatcgcattggccacccgcagcgtgcggggcggattgcgccagctggtccgcagctcgagcaccggcgcgggggtgccgtcggaccgggggaagtcggtggtgaaccggggcaggttggtcgccgaggcgccgcgccagccgtagatcgactggatggggtcgccgacggcggtcaaggccagcccgtcgtcgacaccgcccgcgaacagcgccgacagcgcgatgcgctgggcgtggccggtgtcctggtattcgtccagcagcaccacccggtagcggccgcgcaggtcggcgccgacctgcgggaaggccgcgaccagccgcgccgcggacgccatctgcatgccgaagtccatcaccttgaccgcgcgcatccgctcgtcgagcgcctccagcagcgggaccagctcggcccgctccgactgggtgcccgacagccgcagcagccattggctggggccgcggtcacgctggtacgggccggcgggcagggcatgcacgagccgctccagttccaggtgggtctcgcgcagctgggaggtgtccaccaggtgttcggccagctgtccccacagccgcagcaccatcgaggtgaccgcggccggcgtcttgtcggtccgcagcggcccgcggtatcggttcaccacgtcaaaagccagctgccacaactcggtttcgctgagcagccgggtgtccggctcgaccggcagcagcaggccgtagtcgcgcagcagcgagccggcgaaggcgtgataggtgctgaccaccggggcggcttcggggtcgacggcaccgtggttcgggctcgccgcccccaacccgacgccggccaaccgggccagccgggagcggacccggcgcaacagctggccagcggccttgcgggtgaacgtcagccccagcacctggccggggtgggcgtagccgttggcgatcagccacaccacccgggcggccatggtctcggtcttgccggcaccggcccccgcgatgacgaccagcggccccggcggcgcggcgatgacggcggcctgctcctcggttggcgggaaaagcccgagggcgcaagccaattcgcgggggctgtagcggtcgctcatcggccggacccgtcggcgtgggcggggcagcagggccgcagcgggcagtgggtgcagccgtcgttgcgccgcgcgatgaactgcggaccggccgtcgcgtccgccgcccgccgcagcgcctcgcgccactggtcggcggcggccgccgtcagcggatcctgctcgcgctcgaccacccccgatgccgcggccttgccgacgtaaaccagccgcgccccaccgggttcggcgtcgccgcccgcggcgccgagcaagccgtgcgccaccgccagctgatacaacgccagctgcgcgtgttgctgggcgtcgtccttgctgaccggggtcttgccggttttgacgtcgacgatcaccagccgaccggcggcgtcgcgctccagccggtccacccggccgcgcagccggacctcgcggccgtcaccggtggacagcgtgccgtcgatctcgacctcgacgccgacctcggtcagcgcgccgcgggtgttcgcccgccactgcgcgaacgcctccagcatcgcgcggtggcgggccagctcgttgtccgaatgccattgcgcggcaaagggtaagtgccgccagacgcggtccagctcggccaccagttcggccgggctgcggtgcggttgggcgatcagggcgtgcaccaccgaaccgatggccgagcgcaggtcgcgcgggtcggtgccgccgtgccgttcggccagccagcgcagcgggcagtcggtgagcgtctgcatggtcgacggtgtcaaggtgacgacgtctccaccgccgcgcagcggttcggcggtgctgaccgggatcaggccgtgccagctggccgggtcggcgccgggcaccccggctttggccagccgggccaattgcgttgccgcgcaacgacggtcgagctcgtccacggcgccgtccggcgcgcacaccaccccgcgcagccgccccaccagcgcggccgccgacaacacccggggcgccgaaacaggctgcagggcagcgggttcggcgtcttcgccggcccactgcgcgatttcgtagcagaacggcgacggcagcgcggcctcgcgatccgacccgtcggtgtcgctgtccaccgccgtcaccagcagccgctgccgggcccggcccatggccgccaccagcaacctgcgctcctcggccagcagcggcgcccgcacggacgcgtcggcgctgaccccgtccagcacgtccagcagccgctgggttcccagcaccccgccgcgcggaacggtgttgggccacaacccgtcctgcagcccggcgatcaccacgaaatcccattcgcggcccagcgcggcgtgcgcgctgagcacgctgacctgctcggcggtggccaccggctcggcgccgggcagctgcagtgcggcgacgtgctcgaccagcccgcgcagcgacgcgcccgaggtgcgcgacacgtagtcgtcggtgatgtcgaacagcgcggtcaccgagtcgaggtcccggccggcctgggcggcggcggggccgccgcgctcgctgaccgacagccagcggcgctgcagccccgaccggtgccaggcggcccacaggatgtagcgcgggtcctgaccgtcgcggtggcagcgcccggccgcgtccagcaccgcgcgaacccggcgcagcgcccggaacggtgcaccgggcggcggcgcggtaccggtgagcgcctcgaccaacagctcggcgaaatcaccgggcgggcgtccggcgttggcgcgctgcaggtttcgccgcagctgccgcagcgacaccgggtcgacgcggccgatcgggccagtcagcaacgccagtgcccgctgcccgtccaggccgtcggcggtggccagcagcacggtcagcagcgcgcgcaccgccggttgctcggccaacggcccgctcgccgccggcgcagtcaccggcaccccggcggcggccagcgcccgcggcaaccgcgcgccggcccgcggcaccgaacgcacgatcaccgccatctgcgaccagggcacgccgtcgaccaggtgggcgcgccgcagcgcgtcggcgatggcggccgcctcggcgtgcgcggacgcggccagccgcaccgcgaccgagccctcccccggtccggcgccctcgatgcggcggccggcgctgctgccgggcagccggcccgcgacgccgctgaccgcacgcgcgacggccggggcgcagcggtgcgacctggtcagcgtcaccgccggcgccgcgccgtcgagcagcgagccgggatcgccaccgcggaagccgaacaccgcctggttggggtccccggcgatcagcgccagatcggcgcccgcggccagcacccgcaccagccgcgcggcctgcggatccagctgctgggcgtcgtcgaccaacagcacccggatccggccacgctcggcagctagcagctcggcgtcgacggcgaaggcctccagcgccgcacccaccagttcggcggcacccagcgcgggcgtcgtcgcctccggggcggccgtccccaccgccgcgcgcagcaacatcacctgttcgtactggcgcgcgaactgaccggcggccacccattccggccgtcggcagcgccggccgagccgctccaatgcctgagggtcgacaccgcgttcggcgcagcgcgccaacaggtttcgcagttcggtggcgaaacccgcggtgctcagcgccggacgcagcgcggccggccaggccgtcgccgcgcgcgggccgtcggccagatccccggccagcagttcccggatgatcgcgtcctgttcggcgctggtgaccagccgcggcggcgcctcgccggcgcgctcggcggcgcggcgcaacaccgcgtacgcgtaaccgtgcacggtgcgcaccaacggttcgcggacggccgggccggcgcccgccgaccgcagcagcgccgtcgtcaaggcgctgcgctcggccatcgggagccggccggaaccggtgagcagcagcaccgattccgggttgacgccggcctcgatctgggcgaccgcggcgtcgacgagcaggctgctcttgccggtgcccggcccgccgagcacccggacggtcccgcggacaccgggcgccagcacggcgcccgcctgcgcatcccaggtgaatgacatggctgcatgcaatcaccggggtgtgacaagcgagcgtgacctgcaccgacaccacctccctaccctggaaggcggcgcagcgcgaacaatggtgcttcaacaaccgaaggaggggtccaggaccatgaaggacgaacgcggctttcccatcgacgagccgcccgaaggcgacgtcgccgagcaacagcggcccgtcgataccgacgacgagaccggcctggacaccgagtacgtgagtgcgggcgatcgcgaggccaacgaggccgacgtgatcgaccaggcctacatcgtctccaccgaggacgagtgggatgacgaccgctgagcgcggcaccgcggcgggccgcccgcgcaccgcgaccgcggcggctggcaccatcgacgggtgaccgcgacattgcatgtgcaccgctacggcccgcccggtccggcgcggatcctggcgctgcacgggttgaccgggcacgggcagcgctggcagcacctggccggcatgctgcccgaattcgctttggccgcaccggatttggtgggccatggccggtccagctggtcggcgccgtggaccatcgacgccaacatctcggcgctgaccgacctgctcgacgcgcaggccggcgcgccggtgctggtggtcggccactccttcggggccgggctggcgatgcacctggccgccgtgcgcccggaccgggtggcggggctgctgctgctggatccggcgatcgggctggacggcgcctggatgcgcgagatcgccgaggcgatgctgtcctcgccggactatcccgacgccgaggaggcgcggctggagaagctgcacggctcgtggtcggatgtcgagcccgcgctgctggacgccgagatcgacgagcacctgatcgagctgcccaacgggcggtacggctggcgggtgtgtctgccggcgatgatgtcgtactggagcgagttggcccgcgacccggtgctgccgccggcgcagacggcgacgatcctggtgcgcgccaagcgaaccgcgccgccgtacgtcggcgacgaactcatcgcggcgctgcaggaccggctgggatcgcggttccggctgctggatttcgactgcaaccacatggtgccctacgccaagcccgacgacgtcgccgcgctggctcgcgagctgctcaaggcgcgctgacgtggcgccggtgaccgacgagcaggtggagcgggtgcgggcgctggtcgcagccatcccgcccggcagggtcgccacctacggcgacatcgccgctgtcgcagggctttccagtgcccgcatcgtcggctggatcatgcggaccgactcctccgacctgccgtggcaccgggtgatcaccgcctccgggcgcccggcgcggcacctgcggacccggcagctggaactgctgcgcaccgaaggcgtgctggccaccgacggcaggatcccgctgcccgaggtccggcaccggttcggcgcttagagcaccagccggaccagcgccgcggtgcgggccagccccggaaacgcctcggcggtagacctggggtgcagcgcgtgcacggccagccgaaacatcaacgcgcgcaacaacatctgcggccactccggcagggcgttccagcgttcgatgagtccgtcgtcggcctccccccaggacaacgcgtcgatgaccaccactccggccgcccacgacgcgggccgccagtagggggtgatgtcggtgatccccggcgccgccgaacccacgaaaagcactgtgccgtaaaggtcgccgtgcaccagctggttggggctcttggtgggcttgcgcagcgtggcgagctggttgagcagctccaccgatcgctgggcgtccgccgtcgcgggggccacccgcgcccccggcggcaccgaggccagcggccgttcctcccaggcggcgcggtcggcggcgatgaagatgtccacgtcgccccagggcgccgtgggcccctgggtcaggaagcggggccgctcgagtttgcccgtcgcctcgtgcaggcgcaccgccgccgagacgacttcgtcgtgccggggctccggcgtcccggcgacgaaggtgtcggcgcgccacccggacacgacgtagcggccgtcggtggaacggaccgggcgggccagccgcaccccgtcgacgaacagcgtctcgcggacccgggcggaccaggccgcgcgcgcgttgtcggccaccagtgacaggacgacttcgccgcaccgccagccgccctcccagctggcacccagatagacgggtttaacgccggccaaaccgaacgccgacaacacatgatccggcggtggctcgactgtcacaccggtactctaaacgagtccaacaagcgggttggtcagtacaggatcatgtcgggctgcatctgttgcgcccaggccacgatcccgccctgcagatgcaccgcgtcgctgaatccggcctggcgcaccaccgccaacgcctgggccgaccgcaccccggtcttgcagtacagcaccggcatgcggtcggccggcagctttgccaggccctccccggagttgatcgacgactgcgggatcagctgcgcgccgtcgaggtgcacgatgtcgaactccaccggttcgcgcacgtcgatcagcgccagcttggcgccggagtccagcagctcgcgcagctgccgcggggtgatggccgcctcggccccgccggtggcggcgtcggtggaggcggccggcgcggcgccgcacagctgctcgtagtcgaccagcgtggtgatggcgggccgcgacgcgtcgcaggggtcgcggcggatcgcgatggtgcgatagctcatctcgagcgcgtcgtagatcatcaaccggcccagcagggattcgccgatcccggtgatgagtttgatcgcctcggtgctcatcaccgaggcgatggaggcgcagacgacgcccagcaccccgccctcggcgcaggacgggaccgcgccgggcggcgggggttcggggtagaggtcgcggtagttgagtccgcggccgtccggggcgtcctcccagcacaccgagacctggccctcgaaccggtagatggacccccacacgtacggcttgccggccagcaccgccgcgtcgttgatcaggtagcgggtggcgaagttgtcggtgccgtcgacgatcaggtcgtagtggccgaacagctcgacggcgttggacgcgtccagccggaactcgtgcagccgcacgtcgaccagcgggttgatcgcggcgatcgagtcgcgcgccgaggcggccttggaccgcccgacgtcggccaccccgtgaatgatctggcgctgcaggttggactcctcgaccgcgtcgaactcgacgatgccgatggtgcccaccccggccgcggccaggtagagcagcgtcggcgcgcccagcccgccggccccgatcaccagcacccgggcgttcttgagccgcttctgcccgtcgacgccaaggccggggatgatcagctgccggctgtagcgggccatctcgtcggcggtcagctggtctgcgggcgccaccagcggcggcagcggcgtggacacgggaaacgtctcctgcaggtcggtcggctcagcgattcgagccgtctaccaccatcacagcagcccgcccacggcgcggcaacgaggccgctaggcgatcgggtacggccagggattgaagcggcaggtcttgccgtcggccttgacgacgtcggggtcgaactgggcggcgtcgttgttggacgtggagaacgtctgctgcatcatcaccggcgccagcgcgccctgctgttcgcacggctcgtggtgcaggtagccgatggcgtggccgacctcgtggttgatcacgtattggcggtaggagccgacgtccccttcgaacggcaccgcgccgcgcacgcaacgcgcctcgttgatgaagacccgcgcctcccggttggccccgaataccgggttgtaacaagaggtttcgagccggaattcgtagccgcagccctcgcggaccgtcaccggcgacaccagcgaaatgcgaaagtccggcttggcgccggcggtcgcgtcgacccggatgaacgcgaactgcgggttgtgcgtccagcccttcgggttggccagcgtctggtcgaccatctgagcgaacgcgtcgtcgccgccgaacatggtcgggtcgatgccgttctccacctcgacgctgtacttgaacaccttggcggtgccctgaccgatctgcggtgtgacgccgggcaccacgtgccaggtcttgtcgccggcttcggtgaacgggccgccgtcgggcaatgtgccggccggcaggttggcgtcgaacgcggcgagcccgcgcggcggggcgtcgatgatcgtggtgcccaccgcgccgatcgcggtcgggctctggatcggctggctggccgtcggtttcggcgagctggtgccggtcacggtctggtagatgacgacggcggtgagcaccaccagcgcgggcagggcgtatgcgcgccagccgtaggtggagacgaaccgccccagccaggtctgtttgcgccactgccgcggccgttcccggtctgcgcgggtccgcccggcttcccgggccagcgggtcgcgaagcgcgcgcaacggttcgcgccactcgtcgcgcagcaccggcacacgacccgtgctgcgcgggggccgctgcgacgtcattttcccaggattacacagccgcccggccgcgccgtcggtggcgcgcccgaatcggccgccggacaccgcttctgccagcgacgacgacgtcgatcacggtcgcatcaaccccgcgggtagtaaggtctgtgcaacgagctgcgagcggctggccccggtttaccgacggccggccctcggcgatcaggtgacgatcagatgaggactcgatgagcgaactcgccaagatgccggcacggcgtgccgtcaaatcggctgaccgcggtcggccgacggacggcgccgcggcttccaaccggcgaggcaaccggttgccccgcgacgagcggcgcggccagctgctcgtcgtcgccagtgacgtgttcgtcgaccgcggctaccacgcggccggcatggacgagatcgccgaccgggccggggtcagcaaacccgttctgtaccaacactttacgagcaagctcgagctgtacctcgcggtgctggcccggcatgtggagaacctggtctccggcgtgcagcaggccctgagcaccaccaaggacaaccggcggcggttgcacgccgcggtgcaagcgtttttcgacttcatcgagcacgacagccagggctaccggctgatcttcgagaacgactacgtcaccgaacccgaggtggccgcccagttgcgggtggccaccgaatcctgcatcgacgcggtctacgcgttgatcagtgaggactccgggctggacccacaccgggcgcggatgatcgcggtcggactggtcggcatcagcgtcgactgcgcccgctattggcttgactccgaccgcccgatctccaaggccgacgccgtggagggcaccgtcgcgttcgcctggggcgggctgtcacacgtgccgctcacccgctcgtaggcgcccctcaacgccccttgccggcgtgcttgccgaccacctcggcgcccaccccgaagccgactcggcgcacgtcggcgatgccgatctcgacgtaggcgatcttggaggtgtgcaccaggaagcggcggccccgctcgtcgctgaggcgcagcaggtccgacccgtcgctcagcgcggcgctgaccagttcttcgacttcgtcgggtgtctgggtgctggtcaggaccagctcgcgtggactatccgtgataccgatcttgacctccacggtcaccccttccgtaggtattcgaagtctgtcgccgacattgccgtcgcgccccgtcagcagcaggctagtggacgcggccggaccccacccgagacagtcccacacttcgcggtcagcgaaactgcggtcgcggtgcgataacgattcgcttgcaggttgtctcggccacccgcgcgatacccgatccgtgttgtcacatggctaacttcggccccatgggtaccacactgccgcacctcgacgaccggatccggggttacccggacgacgacgctgacgacgcctgcgacaccgacccctacctgaacgccgactacaactggaccggctggcccgccgactcgcgctggcggccggccaccgcgatcgtcggcgccgtggtggccctgggtgctatcgccaccgccgtcatcatcaacagcggggacagcgcgtccaccaaggccacggtgggggcgtcggccccgcactcggtgacctcggcgcccgcgaccaccaaggcgtccgtcccgcccagcgcctcccccagcccgtcgcgcccgctgccggccgagacgttcaccacggtcacctcgcccagcgcggcgcccagcgtcgcgcccagcctgacccccggcgtcgccccggcccaaacccccacagccgcaccgcctctggcggcggcgccgacggtcacggtggatccgcgcaccgtcgtctacagcgtgagcggaagcaagcagctgctggatttggtcaacgtcgtctacaccgacgcgcacggggtgccgcagaccgagttcaacgtgtcgctgccgtggtcgaaggtggtggtgctggaacccggcgtgcagaccgaatccgtggtggcgaccagcttctacggccggctcagctgctcgatcttcaacgccgccggccagcgggtggtcgcctcggccaacgcctcgaacatggcgacctgcgcccgctgagccccagggcggcgccgccgttcagcccaggcccagttcccgcatgcgccgctcgtgggtctgctgcagccggtcgaagaacgcgttgagctggcccagcccgccggcgccggacaccaccagatcgaccagctcgtcgtggccggccagcaggtactgcgcctgggtgatcgcctcgcccaacaggcggcgcgcccacagcgccagccggctgcgctgcttgctgctggaggtgacggcggcgcgcacctcggcgacgacgaactgcgagtgcccggtctccgccagcgcggcgcgcaccacgtcggcgacctcgtcgggcagcccgtcggcgatctccaggtacaggtcggcggccaacgcgtcgccgacgtaggtcttgaccagcgcctccagccaggtgctgggcatcgtcagccggtggtagttctccagcgccgagacgtacttcgacatcgccgacaccacgtcgacgccccggctctccagcgcgtcgcgcagctgctcgtagtgctgcatctcggcggcggccatgctcgccatcgagatccgtccgcgcaggtcgggagccatcttggcctcgtcggtgagccggtagaacgcggcgatctcgccgtaggccaggaccgcgaacagctcgttgacgcccgggtggtcggccgacagtcggggggcgggtgaatcggctgctcggtcggcttctctggctgcttcggaggactggcaagaggaccgggtcatggcaacactgtagtcggctgacttagcgcaaaatgggagccagctgtcgaccggctatcatgtaggtagatggcggttgtatttgtcttctattgccaccatcggggaaatgtgcgtgcacagttggcccgcccggactgggtttctccagcccgagccggagccggcgactcggcgacgtattcggagtcggaactggtgcgcgcgtgaccgcaacagagaaacaccgacacaatccgatacgtcaccgagcggctacctacccacgcatgaccacacccaccagcacaactgaactcacttttgctcaactcggcgtccgcgacgaaatcgtccgcgcgctcgacgaaaaagggattcagcacccttttgcgatccaagaactgaccctgccgctggcgctggccggcgacgacctgatcggccaggcccgcaccggcatgggcaagaccttcgccttcggggtgccgctgctgcagcgcatcacggccggcaccgccccgcgggcgctgaacggcaccccgcgcgcgctggtcgtggtgcccacccgcgagctgtgcctgcaggtgacagatgacctcacgctggcggccaagcacctgaccgccgacggcggtcgcccgttgtcggtggttcccatctacggcggccgcccctacgagccgcagatcgacgcgctgcgcgccggcgccgacgtcgtggtgggcaccccgggccggctgctcgaccttgcgcagcagggccacctgcagctgggcgggctgtccgtgctggtgctcgacgaggccgacgagatgctcgacctgggcttcctgcccgacatcgagcgcatcctgcggcagatccccgacgaccggcagtcgatgctgttctcggcgaccatgccggacccgatcatcacgctggcccgcaccttcatgaaccagcccacccacatccgggccgaggcgccgcattcggcggccacccacgacaccacggtccagtacgtctaccgggcgcacgccctggacaaggtggagctggtcagccgggtgctgcaggccgagagccgaggcgccacgatgatcttcacccgcaccaagcgcaccgcccagaaggtcgccgacgagctggccgaacgcggcttcaaggtcggtgcggtgcacggggacctggggcaggtggcacgggagaaggcgctcaaggcctttcggaccggcgacatcgacgtgctggtggccaccgacgtggcggcccggggcatcgacatcgacgacgtcacgcacgtcatcaactaccagattcccgaggacgagcaggcctacgtgcaccgcatcggccgcaccggccgcgccggcaaggccggggtcgcggtcaccctggtggactgggacgagctggcccgctgggcgctgatcgacaaggcgctggggctggacgttcccgagcccgccgagacctactccaattcgccgcacctgtacgaagagctgggcatcccggccggtgccgggggccgggtgggcgccgcccgcaagccgcagggcccgcgccgcagcgccgagcgtgcgaccggaaagccggaccagaagtcggagacagccacgcggcgctcgggcacccggcgccgacgcacccgcggcggccagccggtcagcgggcacccgtcgggcaacggcgccgcgagcagcaacggcgaggcggccgcggacgcaccggccggctccccaccgggcaaccccggctccagccggcgccgacgccggcgtcgcaagcccgcggacgccaccgcgcagagcaactaacgccccggcgccgacgcatggtcagacccgagcggcggaccaggggcgacatcgtggccgccgcgaccatcgccgtcgtcgtcgccgcgaccgccgcgctgatctggtggaccagcgacgcccgggcaaccgtcagccgcccggcggccgtgccggcgcccaacccgagccccgcccggcaagtgccggccagcctcaaacagttgtggaccgcggccagcccggccaccaccgagccggtggtggtgggtggggtggtcgccaccggtgcgggccggcggatcgacggccgcgaccccgcgaccgggcagtcccgctggagctatgcccgcgacaccgacctgtgcggactgtcctggttgtaccgctacgccgtcggggtgtaccgcgatgaccgtggctgcggccaggtgagcaccctcgacggttccaccggccgccgcgggccggcccgcagcggctacgccgacccgcgggtgcggctgtcctccgacggcatgaccgtgctgtcggtcggcgacacccggctggagctgtggcgctcggacatggtgcggatgctcacctacagcgagaccgacgcccgggtgaaaccgtcggcgcgcggactgcactcgggctgccggctgatctcggccgcggccagctcgtcggcggtctcggtgctggagagctgtgcgaatcaggccgacctgcggctggtgctgctgcggcccggcaaggacgacgacgagccccagcaacacatcgtggccgagccgggcatcgcaccggattcgggcgcccgggtgctggccgtccgggaggccaccaccgcggtgtatctgccggcgccgcggccgcgggtcgacgtgatcgatgaaaccgggacgacggtgtcgagcacgccgctgcccagaccgccgtcgccgtcggcggcggtctcgcacgcgggcagcgtgatgacctggtggaccggcgattcgctgatggtcttcgacgtcaacaccttggcgctgcgctacaccatcgccgccggggacaagaccgcgccgctggggccgggggcgatgatggcgggccggttgctggtgcccgtcaccggggcgatcggcgtctacgacccgatcagcggcgccagcgaacgctacattccggtggaccgggcgaccagcggcgcgccacccggggccgcggtggtgccggccgtgtccgggtcgcgggtgttcgagcagcgcggcgacaccgtggtcgcgctgggctgatcgcgatctgggccgtcgcttcggttcgggccgtcgagtgtgaatcgttggccttgcgtgtgtatctgcggcggcgacacgccgagcgggctcgccgtcagcgcacactcaaagcccagcgactcggccgcgcgccgaggctagacctcgacggtgaacgtgggcagcggcttgccggacttccagtgcttgagcagcgccgcggccagttcgccgtaggccgccgcgcccttgttcttgcggcccgccatcaccgacgaccccgaggcgctggcctcggcgaaccgcacggtgcgcggaatcggcggggccagcaccggcaggctgtagcggtcggcgacgtcgacgagcacgtcgcgggtgtgcgtggtgcgcgagtcgtacagcgtcggcagggcgcccagcagccgcaggtccgggttggtgatctgctgaacgtcggccaccgtgcgcaggaactgccccaccccgcgatgcgccagcgtctcgcactgcagcggcacgatgacctcgtcggcggcggtcagcccgttgagggtcagcacccccagcgacggcggacagtcgacgatcaccacgtcgaaccggtcggcgagtttggccagcgcccgcttgagcgcgtactcgcgcccggcccgcatcagcagcatcgcttcggccccggccaggtcgatgttggccggcagcagcgtcattccctccgcggtgtccaccagcgcggcgttgggctcgacctcgccgagcagcacctcgtgcacggacaccggcagcttgtcgggatcgtggcccagcgagaaggtcaggcaaccctgcgggtcgaggtcgaccagcagcacccgcttgccctcgtcgaccatcgccgcgcccagcgaggcgaccgtcgtcgtcttggctacgccgcccttctggttggccaccgccagtacccgggtcttactcaccagcgcccgccccttttcatcgccgcgcgtttacagtgccatcctggcatgttcgcccgccagacgcttgggcccagcggccccagcatgtcgtccggcagaatcactgcacatgggcttgcacaaccaccgtctggtgctgctgcgccacggcgagaccgagtggtcgaaaacgggtcggcacaccggccgcaccgaggtggagctgaccgaggccggccggacgcaggccgagcgcgccggccgggcgctgagcgagctgaaactcgttgagccactggtgatcagcagcccgcggcaacgctcgctggccaccgcggagctggccgggctgaacgtcgacgaggtgtccgagcagctcgcggaatgggattacggctcctacgagggcctgaccactgagcagatccgccagtcggtgcccgactggctggtgtggacgcacggctgtcctggcggcgagagcgtcgcgcaggtcagcggtcgcgccgacgcggccgtcaccgcggcgctgcggcagatggagtcgcgcgacgtggtcttcgtcagccacggccacttctgcagggcggtgatgacacgctgggtggaattgccgctcgccgaaggcagccgcttcgccatgatcaccgcgtcgatcgcggtctgcggattcgagcacggggtgcggcaactgcgggcgctcgggttgacgtgaacgacgaaccgacgttcgcgctgtgcgggccgacgcaaaccctggtcgccgacggcgtacggcgaagctaccgcgacgtggccgccgcgcaggccgcgctgcgctcccaagaagtgtcaattgtgttgggcgcgttgcctttcgacgtgcgccgaccggccgccctgctgaccccggataccgtgagcgtcagcgacggcccaccggactggccggcccggaagctgccgtcggtgcgggttgccgccgccctccccccgccgatcgactaccgggaccggatctgccgggcccgcgagcagctcgccgcaaccgacaacccgctgcacaaggtggtgctggcccgcgccctgcacctggtcgccgacgccccgctggatgcccgcaccatcctgcgccggctgatcgccgccgacccgggcgcgtacggctatctcgtcgacctcagcgccgccggccacgaccatgcgggcgtggcgctggtgggcgccagccccgagcttctggtggcgcgcaccggcgaccgggtcgagtgccggccgttcgccgggtcggccccgcgtgccgccgatccggacaccgacgcggccaacggtgccgcgctggcgtcgtcggccaagaaccgccacgagcatcagctggtgatcgagaccatcagggccgccttggagccgctgtgcgacgacctgtccatcgcggccgaaccgcagctgagccgcaccgccacggtgtggcacctgtgcacgccgatcagcgggcggctgcacgataggtcaaccaccgcaatcgatttggcgctggcgttgcaccccacaccggcggtcggcggggtgccgaccgacgccgccgtcgagctgatcgccgacctggagggcgaccgcggcttctacgccggcgcggtgggatggtgtgacgcccgcggcgacggccgctgggtggtgtccatccgctgcgcgcagttgtcggccgaccggcgcagcgcgctggcgcgggccggcggcggtatcgtcgccgaatccgatcccgacgacgaagtcgcggaaaccacaacgaaattcgccaccatactcaacgccctggacgtccgatgagccaccgaatccgccacgccgcaccgcacgacgccgccgccatcaccgaaatgatccatgcgctggccgaattcgagcgcgccgccgatcagtgcatggtcaccgaaacacggctcgccgcagcgcttttcgatgcggccccgacggtgcacgggcatgtggccgaggtggacggcaccgtcgcggggatggcgctgtggttcgtcaacttctccacctgggacggcgtggcggggatctacctggaagatctgttcgtacgaccggggtttcgccgccgtggactggcccgggcattgctggctgcgctggccgccgagtgcgtgcgacggggctacacgcggctgagttgggcggtgttgaactggaacaccgacgccatcgccctctacgacgggatcggcgcccggccgcagcgggaatggaccacctaccggctgtccgggccgcggttggcggagctggcggagtcgtcctgaccgccggcggcccagcgcaccgcggccggactgaacagcaagcccagcacgaccagggccaccgcgccggccgggatcccgaagcccggctgatgcgaccccaccgccagataccaggcgaccggcaacaacagcagctgggtgatcaccgccagcccgcggccccaccgcttgccgcgggtcaacgcgcgccccgcgccgatcaccgcggcgccgaccagcacgaaccagcccgcggtggccaggccgttgaccacatgctggtcggcgccggcgatcccgcgcaccaccagcaccaccgccacgaccagcgcggccaccccctgcagcaggacgatcaggccggcacggcgaacggcggtcggggcggcgggcgtcgtcacagcgtcagcgtagccacgacacccgtccgactcctcctcgcgccgcgctgcggcgcgcatcgtcgcaccgctcggttcgatcgcggcactcctcctcgcgccgcgctgcggcgcgcatcgtcgcaccgcataagctcgtggctcatgcgggccgtgctgatcgtcaacccaacagcgacttcgaccaccgcggccgggcgcgatctgctggcccacgcgctgaagagccgcctgcagctcgccgtcgagcacaccaaccaccgcggtcacggcaccgaactcgcgcagaaggcgctcgccgacggcgtcgacctggtcgtcgtgcacggcggcgacggcacggtgagcggggtggtcaacggcctgctcggccgtcccggatcgctgccgaccggaccggtgccggcggtggcggtggtccccggcggctccgcgaacgtgctggcgcggtcgctgggcatctcccgcgacccggtcgcggccaccaaccagctcatccaactgctcgacgactaccagcgccaccacacctggcgccgcatcgggctgatcgactgcggcgagcggtgggccgtgttcaacaccggcatgggcgtcgacgccgaggtggtggccgccgtcgaggccgaacgcgacaagggcggcaaggtgaccgcctggcgctacatccgcgccgcggtgcccgccgtgtggggctacacccgccgcgaaccgatgctgacgctcgaactgccgggccgcgaacccatcaccggcgtcagcttcgcgttcgtgtcgaactcgagcccgtggacgttcgccaacgagcggccggtgtggaccaaccccggctgcagcttcgaatccggcctgggggtattcgcgcccaccaccctcaagccgattcccaccctgcggatcgtccggcagatgttcgccaaacgccccgccttcgacttcaagcaactgatcaccgaagacgacctgccctgcctgcgagttacctcgaccggcggccccgtcgcctgccagttcgacggcgattacctcggcgtgcgcgaaaccatgacgttcaagtccgttccggacgcgctggcggtcgtcgcgccgccgcggcaaaaacgtctctgaccagctacaacaccgcggccccagggcggccggaaaacgcggttccggcgaagaggcccgtcagtgtagtacaacggagtaagggttcggctacgagatgatcaaagtgagatagcccacgagcgaactcacactattgacatctgttgagcctgtgaaacgatcaaaaggttgcatgcagaaatttcgtgggggtacggccccttttcttctgcacgcgttaaacagccgaagaaaatggccgtgcgccttgctgcgcactcagtaaggagtaaagacgtatggattggcgccacaaggcggtctgtcgcgacgaggacccggagctgtttttcccggtggggaacagcggcccggcgctcgcgcagatcgctgacgcgaaactggtctgtaatcggtgcccggtgaccacagagtgcctcggttgggccctgaacacgggccaggactcgggcgtctggggcggcatgagcgaagacgagcggcgcgccctgaagcgtcgcaacgcccggacaaaggcccgcagcggggtttaacccggataacgcaaaacggtgcggcctcgacgattgtcggggccgcactcttgcgtgcgggtcgcgcggctacagcaacatcctggtccggcgcccgatcggcacccgcaacaccacgtcggtgccgcgttcggaggcttcgctcatccctagcgtgccgtccagctccgccgacaccagggtgcgcacgatctgcaggccgaggctgtcggaggcctccaggctgaatccctccggcaggccgcggccgtcgtcgtgcaccacgacgtcgagccagcgggccgagcgttcggcgcggatcgtcaccgacccctcggcggccgtcggatcgaaggcgtgctcgatcgcgttctgcaccagctcggtgatcaccatgatcagcgccgtggcccggtcggagtccagcacgcccagatcgccgacccggttgatccggatcgggcggtccaccgacgccacgtcgttcatgatcggcaggatccggtcgatcacctcgtcgaggttgacctgttcgtccaccgacatcgacagcgcgtcgtgcaccagcgcgatcgacgacacccggcgtaccgactcgatgagggcttcgcgcccctcggggttggtcgtgcgacgggcctgcagccgcaacagcgcggccacggtctgcaggttgttcttgacccggtggtggatctcgcggatggtggcgtccttggagatcagcgcgcggtcgcggcgcttcacctcggtgacgtcgcggatcagcaccgccgcgccggcgctggcgccgttgaccaccagcggcagggtgcgcagcagcacggtcgccccgccggcgtcgacctccatccgcatgctcttgccgccggccagcaggtccttgacgtgctcggccatctcctgggcctcgaacgaatcggagatcagcggccgggtgatctcgatgaggttgtggccctccagctcggtggtgagccccatccggtggtaggccgacagcgcgttggggctggcgtaggcgacgacgccgttgacgtcgaggcggatgaagccgtcgccggcgcgcggggtggagcgcgacatggccacgtcccccacgtcgggaaaggtgccctcggcgagcatgtggacgaggtccgcggcgcactcccggtaggcgatctccagctggcccgacgcgcggtcggcggccaccgcggtctgatgccgggtcagcaccgccaccacgtgcccgccgtagcgcaccggggacgcctcgacgtgagtgccgggcaaccacgaatcttgttgggccgcaacgtcatcggctttggcggcgccggaggcgaaggtctcggcgaccagcgtcagccgctcggaggccacgacggtgcccaccgcgtcggtttgcagcacggtcggcgccgtgttcggccggcactgcgccacgcacaccagcatgccgtcgtcgcggcacacccacatcagatagtcggcgaaggacaggtcggccagcagctgccactccccgaccaccgcgtgcaggtggtcgaccgcgttgcccggcagcatggtgtgctcggcgagcagatcaccgagagtggacatcgaataactcccgagtggttccccggggctagctgatcaccgcgatgaggtcgcccgcctgaatgacgtcacccaccgacacgctgaccttgctgacggtgccaccgacttcggccagcacgggaatctccatcttcatcgactccagcagcaccagggtgtcgcccttgccgatctggtcaccctcgttcacaacgacttcgagcacgctggccacgatctcggcgcgcacatcctcggccatcttcaccccactcgttttcggcctctgcgcaggctgtctgctggttcatcaaggttctatcaggccccgtcaggctcacctacatcgaaccacagcaccggccgcgacggcggcacaccggtcccgacgggtcccggcgaaggctcgcaccggggtccgacgagggctccgacgagggcgaagtcggtgcgcggcggcgctcgtgagacactgggcagcaagccaaccggcgcgcgacggccggtgtgacaagcaatcgacggaggttttcgaccgatggccaaacgaggccgcaagaagcgcgaccgcaagcacagcaaggccaaccacggcaagcggcccaactcctgacggacgctactgcgtgccccggatgatggtggtgcgccggatttccaaccgcagccgctcgcgcaagccctccggggccttctcgcccttgcatttcgtggcgatcaacgccttgatccgctcctcgagcccgtagtgcttgaagcagccgggacacgcctcgaggtgccggcgcagttgctcccgggtgtccgggccgcattcgccgtcgagcagcagccagacctggcggatcacctccgcgcagccgacggcgccgtgggaatcgtcgttcgggcaggattcggacaaggcgtcgccttgcccggatgactcactcatgacgacacctcctcgtgcgtctgctgcccgcggttgaaaccgcgctccttggccacgtcggccagcaggccacgcagctgccgtcggccgcggtgcagccgtgacattaccgttccaatcggcgtatccatgatctcggcgatttccttgtacggaaaaccctcgacatcggcgtaatacaccgccatccggaattcttccggcaaagcctgcagcgcgtctttgatttcggaatccggcagcgattccagcgcctcgacctcggccgaacgcagcccggtcgaggaatgctccgcattcgacgccagctgccaatcggtgatttcctcggtcggatactccgcgggctggcgctgcttcttgcggtagctgttgatgtaggtgttggtcaggatgcggtagagccacgccttgagattggtgccggcgcgaaacgagcggaaccccgcgtaggccttcaccatcgtttcctgcagcaaatcctcggcgtcggccggattgcgcgtcatccgcagcgcaccgccgtacagctggtccagcaggggaatcgcgtcgcgctcgaaccgcgccgtcaattcggcgtcggtctcttcgcgggcctcttcgtgcgccgccggttctgcgtgcgcttcggggacttccgggctggtcacgccgtctgggccatctggagaatcggccatttcgataaacccggtcccttctgctgcggtgtcaccggaaagcaccgaaagcgcccccggactcgcaaggaagccagccaactgctcctcgcctaacaggctcgtcgccgttgacaccacgctgctcctcccaatctaaaggctgcccccgacagtgtctgcccgggtgtggcccaccgcaccaaagaccgatcccaataccgatccaaagaccgattggatcaacagtgcgcgcgaccgggctatttcccgccggtttccggccgcatttcccgcggctttccgggcccgatcagaccccgatcggaccggatccgccgtggcgttagtgtgacgccatgtccctgaatggcaagaccatgttcatctccggcgccagtcgcggaatcggcctcgcgatcgccaagcgcgccgcccaggacggcgccaacatcgcgctgatcgccaagacggccgagccgcacccgaagctgccggggacggtgtacacggcggccaaggagctcgaggaagcgggcggacaggcgttgccgatcgtgggcgacgtccgcgacccggagtcggtggaggccgccgtcgccaagaccatcgagcagttcggcggtatcgacatctgcgtcaacaacgcctcggcgatcaacctgggttccatcaccgaggtgccgatgaagcggttcgacctgatgaacggcatccaggtgcgcggcacctacgcggtgtcgcaggcgtgcatcccgcacctgaagggccgggagaacccgcacatcctgacgctgtcgccgccggtgctgctcggcaaggagtggttggagccgacggcctatatgatggccaaattcggtatgacgttgtgcgcgttgggcatcgccgaggagatgcgcgaagccggcatcgcctcgaacacgctgtggccgcgcacgctggtggcgacggccgcggtgcagaacctgctcggcggggacgaggcgatgggccgggcccgcaagcccgaggtgtattcggacgccgcctacgtcatcctcaacaagccggcccgcgagttcaccggcaacatgctgctgtgcgaggacgtgctggtggaatccggtgtcaccgacctgtcggtgtacaactgcgtgccgggatcccaactgggcgtggacttttgggtggacggcgtcaacccgccgggatacaccggcccctagcaacgcccgttcgtaggccggtcagcagaaggtgacgacgaccttgtcggcggcgccgggagtacgggccagttcgagcgcctcgccgacgcggtcgaacggaatggtgtggctgacgatcagcgcgtacttctcccagttcctcaccagatcgccggtcacttcgaagatttcgtccggataacccatgctcccgacgatggtgatctcgttgctcatcacgttgatcaggtcgacgggcaccggttccttgtgcacgccaacgattcccaacgtggcgcccttcttggcggcggccagcgcggtgctgacgacggctggcgcgccggcggcgtcgaggtagatgtcggtgccggccttgccggggaacatgctctcgcccgagccgtgcagttcgaccaggcgcgccgccacgtcttcttcggcggagttgacgaccgcgtcggcgccgatccgcactgccttgtccaggcgcccgggaatcagatcgatgaccacgatgtgctgcacgccgagggatttgaaggccagcgtggcgcccagcccgatcgggccggcgccgaagacgacgaccttgtccgtgggtcggggttgacagcggttgacgccgtggcgcgcgacggccatcggttcgttgagcgccgccacctcccacgggatgtggtccggaatgacctcgagacttgttccgcggacggcgttttcgatcagcaggtagtcggcgagcgccccgctggcgccgccgttgccgatgatgccgctgggcgcggccatcgggttgatgacgacgtggtcaccgacggccagcccggtcacctcggcgccgacctcgacgacctcgccggccggttcgtgccccagcggggtgtgtccctgccgcggcgggacgccgccgatgctgatgtagaacgcgtcggagccgcagatgccgcaggcacgcatccgcaccaggacgtcgcgcgggcccacgtcggggcgctcgacgtcgacgacctcgacccggcgcgggccggtgaccacggatgctttcacggcgtgccttccagttcgatgtcgaaggtgtcgaggtattcggcgaagatcggctggagcgcttcgacggtcaggccgtattcgtcgaggcgataggcgttgagcgcgaaccggtcctgcgggtggtgagcgagccaattgcgcatgcgcgcttcggtttcggcggtcaacggctcgtcggcccactcgtagatgcgccgcatgacgtccatcgggtcgcgcatcatctcgtggtagtacatgtggaagaagcgctcgtcgccgatgcgctcgcgggcccgcagcggccggtcgacgtggtagcgcatctgccacatcgccagccggcccatctccgtctgatcgagaagctcggtgttcatcaccaggctctgcggcagccgccacaggttgcacagcgaaccggtcgccttgtacgggtcgcggtgggcccagatcagccgggcgtccgggaacaccttgagcagcgcctcgatgtgcaccgaatgcgacggcatcttcaggctccagctgcccggggcggtggactgcagcacctgcaggtatcgcttctggtactcgtacgtgctgctcatgtcggcctcgtcgaacagccaccgcgcgtagcggtccgtgggcaggaaggaatcccaggacaggcccttgaagtcctggttgtggatgaacatgtcctcggtcgggccgtcggcgtcttcccagtgcggcagcggcattttcgcccgcgtcacggcatccaggatcttgcgctgttcgtccagcagggccaggcagcgcgggtcggtgcgcagcgtctcggtgctcgccggcgggatcggatgcacgcactgccagtgcagcagcgaccgccgggccgggtcctggtcgagcaggtaactgatgaccgtggtgccggtgcgcggcatgccgagcacgatgagcggccgctcgaccggcgcgtcgagcacctcggggtggtcctggatgtaggcgtgcacctgtaggcgccggcccagcgcgttggtggcgtcgtcgaggactcgctggcgcccgaacggcgtgaagaccggcgaggtgttgacctcgtcgacgatcagcgccaggccctctcgccaagagtcggagtcgatttcgctgaggccggtgcgctgcgcggccagcttgaagacgtcgtcggcggtggtgatgttgtcgaagtcgctcatggccctagaccgtcaggtatccgccgtcgaccgcaatcgtgctgcccgtgatgtacgacgccgcctcggtacacaaaaacagcgcggccccggcgcagtccgcgggcgtgcccggccggcccagcggggtgtgaaagccgatctcgacgtccatcacttcgggaattcccatggcggggtgggtcattcgggtgtcgatcagcccgggggcgatggcgttgacccggatcccgtcgccggcccagcggcgggacaggttcatggtcagggcgaccagccccatcttcgacgacgcgtagccggggacgaagaccgccgagcggaacgccgacatcgagacgacgttgaccacactggcgccgccggcggcccggctggacttgagcaggtcatgacagcgcatggtcagccgcatcgggccgaacatgttttgcgtcaccgaggcgacgtagccgtccgggtcgtattcgtcgcccgcggggtagggcccgccggcgttgttgaccagtatgtccagatctgacagtgagttcgccagggcgtcaacggattccggatcctggatgtggcactgccggtagctgaacgcaccgaggtcgatgtcgggatagccggtggccgcggcgcgggttccggtcaccgtgacggcggccccggagtcggcgaaggcggtggcgatcgcgttgccgatgccgctggtgccgccggtcaccagcacccgggcgtcggtgaagtcgaagtggacggtgttcattccgggtccctcaattcgcggatcgatttggtgagccaggctttctcccagaagttttcggtgccggccagcagcgcctcgtgggcgtcggcggcgaccgcacgcgcccgggcgtgcgccggttcggcggtcaggacgaggtcggtgagatgcagcgcctgcaccggccgcccggcgtccaggtgagcgcgggccgcctcggacagcgtttcggcgccggcggcgtcgaccaggtcggcagcgacggaatccggtggcacaccgtataactcggtggtggagcggtgccggaaccatccggtgtacatctcccagatggcccgcacattccacgaggtcttgccgtacccctcgccgatgtcgaaccgctcgggcaccctgatctcgcgcatggccgtgtacaggtcggcgccggaattcatcagctcggcggtgcggtcgtgcacggcccgcatggcgtcgcgcatcgcggtgacttcctcggcgatgcggtcggcgccctcgatgggggcgaagtgaccggtgatcagtcgctgcggcccgaactccagcacggtgttcaacgactcgatgtagaggatggggtcgcggtaccggtctccgcggatggtcatcaggttgggcacatggccgaacagcggcccgaacaggttgccggtgaacaggattcgctcctcgggcagccacaccaccagcgcgtcggtggtctccccgcccggcgtccaagccagctcgaaggcgcgcccgccgacacgcaggttcatgcgctggtcgaaggtaacggtcggctcggggaaggtgaagtcgagcgcggcgggctcgatggtcttgaagtgctcgagcatggcgtcggagaacttctggaacgcgaacgacgtcttgggcacccggtagcccatcagcagcgcgttgtcgtcgcgccagtaccgatagttgcgatgcatgacgatgtcggtgccacggtcgtcgccggcgccgtcgctgtcgtcggcgccgtcgcgcagcgcgttcacgccaccccagtggtcggcgtgtccctgggtgacgatgatggcccgcgccggaccggggatgtcggcaaatgccttgcggtgcaacggcccttcgaagaccagcccggtgttgacgatcacccgcccgtcgtcggtggccaccgcataggagttcgagaccccgggtgacatccagacgtcgtcgcccagcggcgtcgccggggcgccggtggcggccgccaggtcgccggctccgggtcgctcccggtgaatcccagccatgactggcgatcctctacagttctagaggtaaagtcaatatgttgcggcgggttgcggcgggttgcggcggtgaaggggatttccatgggtcttcgcggtctggcggacaaggtcgctgtcgtggtcggcggggccaccggcatcggtgcggcgacggccgcccggctggccggggaaggctgccgcgtggtcatcggcgacgtggccgtcgacgccgcgcggcagacggccgaccgcatcgccgccgccggcggcacggcgacccaggtggccttcgacctcgccgacccggcgtcggttgccaccctgatcgactgtgccgcaacgacttacggcggcgtggacctgctgttcaacgtgggcgccgacatgagcaccatccgggccgacaccgacgtggtcgatatcgacttcgacgtctgggaccgggtgatgacggtcagcctgcgcggttatgtggccgccatgaaatatgcaatcccgcgcatgctggaccgcggcggaggggccatcgtcaacatgtcatcggccgcggcgtttcagggtgagcccgcccggccggcctatgccaccgcgaaagccggcatcggcgctctcacgcgccacgtcgcgtcgcggtggggcaaggacaacatccggtgcaacgcggtcgcgcccgggttcaccgccaccgagaccatccggtcggtgccgcaatggccggagctggaagccgccgcgctcaagcgaattcgtgggccgcgcgtcggcgacccggccgacgtcgccacgttggtcgcgtttctgctctccgccgagggtgattggatcaacggtcaggtcatcaacatcgacggcggcaccgtccttcggtgactcatggcatccgactcccgatcccgcaggcgtgacggcgacgaacgccgccgccagctgtgtgacgccgcgatccgggtgctcgccgagcacggctcgcgcggactgacgcacgggcaggtcgaccgttatgccggcgtccccgaaggcaccacgtcgtactactaccgcacccgtgccgcgctgctgcagggagtcggcaagcgggtggccgagatcgacgtcgccaacctgcagtcggtgatcgacgagccgctcgatccgctgtcgccgttcgcgcacctggcgcggctcaccatgatgcaggccagtgggcccgggctgatgttgaaccgggcgcgccacgagctgctgctgggtgccgcccgcgatcccggtctggccgaaacctcgcagattttcgccggccggatcaactcgatggcccgggatgccatcgcccacctccagcccgacatccgcgaccccgcgctgttggacgcgcagaccaccgccgtgacgacgttcatcgccggcgtcttcacccggctggcggccggtgaccgcaacgtcggcgacgccgagcaactcgcccatctgctggaggcggtggccaccgcggtggcactgcgggcgcagcgaagttagcttggcggcgaaaagcgctccggggtcccccgcttcggcataccgttgatgccgattcgcgcgcccacaggaggattcgatggacatgaagcgttgtgccaagcgttttgccggtgccggcgtgctggcgttggccgggttggtgacgatcggcgtgggcgtcagcaccgccgagacgattcagaccgagggcaactatcccacccgggaggcatgtcaagatgccggcccgggcgtgaaggcgtccacgccggggaactggaacaacttctggtgcgttccggaccggaacgtcaacggcaactggaagttggtgctgagcaactgattccgcgccggttggtggcgggccggctggccaaacctcagggcgttagcgcaccggccgggcagtcggcgcacgcgtcctgccgccgcctaaatcgcttgtgtcactttggtttctgtcgtcacattgccgggttttttgtcggtgcccccggatagtttgcgaggtatgagtagcgatcgggaggcggtgtcggcggcgttcgacgccatcgatgccgccttggacgatctgctcgactgcgactacgtcgcgttggccacccgcgagaagctggcgttgctgaaccgctgcgagaaactgcgccggcggctgcccgcggtcgagcatccgctgatcaacgcgctggcccgcgacgccaccccggcggagttggggggccggctttcgcatgcgatcgccgaggccacgctgatcagccgcgccgaggccgcccggcgggtgcacaccgccgctgacctgggcccccgcgtcgggctgaccggcgagccgttgccaccgttgctggcggccaccgccgccgcacaacgagaggggtcgttgggtctcgagcaggtggcggtgatccgtaagttctgccaccagttgccgggctggatcgatcaggcgacgcgggagcgcgccgaagccgacctggccagggaagccacccggtatcggcccgaacagctcgccgcgttggcgggcacgctggccgattgcctcaaccccgacggcctctaccgcgacgaagaccgcgcccgccgccgcagcctcaccctcggcaaccaacacgccgacggcatgtccgaactccgcggactactgacccccgaactgcgcgccaccctcgaggcggtgctggccaaactcgccgcccccggcatgtgcaacccactcgatgaaaacccgtgcgtggagggcactccgagtcaacacgccatcgacggtgatgcccgctcggcggcccagcgcaaccacgatgggctgctggccggcctgcgcgccctgctggcctcaggaaacctcggccaacacaacgggctcccggcctccatcatcgtcaccaccaccctggccgacctcgaaaccgccgccggacggggtctgaccggcgggggcaccctgctgcccatgtccgatgtgatccggctatcccggcacgcccgccactacctcgcgattttcgaccagggcaaagccctggccctgtatcacaccaagcgcctggcctcaccggggcagcgcatcgtgttgtacgccaaagaccgcggctgcaccgcccccggctgcaccatccccggctactacagcgaagtgcatcactgcaccgactacgccacctgccacaccaccgacatcaacgatctgaccttcgcctgcggaccccaccaccgcctgctgcaacccggcgcctggaccacccacaaaaacgccaaaggggaaaccgaatggattccaccaccccacctggaccgaaaccaaccccgcaccaacaccttccaccaccccgaaaaactcctccggggtgagaacgggggtgaagacgacgacggcgatgacgacgaggcggcgtagcgctggacggcgctagagaagccgagcctgctcgggctccggcttggccggctcgagcaactccgggccgttgttgcggacgttgttgaccagcgtggagacctcgcgcatgccgatggcgtgcacgtcgggcgggcgggtcagcagctcctcgtcgaccggggcgtcgggatcgagccagcggtcccagtcccgctcgggcatcaccaacggcatccgatcgtggatctgcgcgagttccccgggcgcgtcagtggtgatgatcgtgcagctcaacaggggcggtgcgtccttggccggcttccagaccgaccacaggcccgccatgaacagcggctcgccgtcctcggagtacatgaagaacggcgtcttgcggggctttttgccggccgcggcgtcggagttgacccgccactcgtagtagccgtccatcgggatcaggcaccgcttggacttggcgctggcccggaaggcgggtgagctggtgaccttgtcggcgcgggcgttgatcagcatcggccccttggtctcgggcgcaccgtccggtccggctttggcccacggcggcaccaatccccagcgcatcagccgcacccgtcgcgtcggctcgtcctcgggctcggaatggcggctgaccaccgtggcgatggtcgacgtcggcgccacgttgtagttgggagccgtgtcgctcggggcggcgccggtggtctcgtcgatcgccttgatcttttgggccagctgcgccggatcggtggtgaccgcaaaccgtccgcacatgactcccatggtggcagagccaccgggtgcaggtccgtggcagagccacgcagtgctattgggcccgaaaacggtgacaggcgatgatggaccggtgactacgtggacggcccccctcgcaccgcaaccggtgcacgcgaccgtgaccgttccgggttcgaagtcgcagaccaaccgggccctggtgctggcggcgctggccgccgcccagggccggggcaccccgaccctcagcggggcgctgcgcagccgcgacaccgacctgatgatcggcgcgctgcgcaccctgggcctgcgcgtcgacgggacaggcccggaactgaccgtcagcggccacatcgcgcccggaccacacgcccgagtcgactgcgggctggccggaacggtgctgcggttcgttccgcccctggcggcgctggccgacgcggtggtggagttcgacggcgacgagcaggcccgggcccggccgatcgcgccgctgctggacgcgctgcgcgggctcggcgtgcggatcgaaggcaccgccctgccgttccgggtgcacggcagcggcgcgctcgccgggggcacggtggccatcgacgcgtcggcctcctcgcagttcgtctccgggctgttgctctgcgcggcctccttcaccgagggcctgaccgtgcaacacaccggcgcggcgctgccgtcggccccgcacatcgcgatgacggtggcgatgctgcgccaggccggcgtcgacgtcgacgactcggtccccaaccgctggcaggtacggccggggccggtcgcggcccggcactgggaggtggaaccggacctgaccaacgccgttccgttcctggcggcggccgtggtcagcggcggcaccgtgcgcatcaccggctggccggccgacagcgtgcaacccgccgacaatatcctgagcgtgttgggcaagctgaatgccgttgtctcccagactgattcgtctctggaggtgcgcggctccgggagctatgacggtttcgacgtcgacctgcgcgcggtcggcgagctgacaccgtcggtggccgccctggcggcgctggccacgccgggatcggtgtcgcggctgtccggcatcgcgcacctgcgcggccacgagaccgaccggctggccgcgctgagcgccgagatcaaccgcctcggcggcgactgcaccgaaacacccgacggcctggtgatcaccgcgacgccgctgcgccccggggtgtggcacgcctacgccgaccaccggatggcgatggccggtgcgatcgtcgggctgcgggtggccggggtccgagtcgacgacatcggcgccaccagcaagacgctgccggactttccgcggctgtgggcccgcatgctggacgccagcctgccggacggggaagagcacggcatgtgagacccggcgactacgacgagtccgacgtcaagatccgctccggccgcggttcgcggccgcgcaccaagacccgtcccgagcacgccgacgcgcgggccgccatggtggtcagcgtcgaccgcggccgctggggatgcgtgctgggcggcgacccggaccgccgggtcaccgcgatgcgggcgcgcgaactcggtcgcacgccgatcgtggtcggcgatgacgtcgacgtcgtgggcgacctgtccgggcggccggacacgctggcccgcatcgtgcgtcgcggcgagcgccgaacggtgttgcggcgcaccgccgatgacaccgatccgaccgagcgggtggtggtcgccaacgccgaccagctgctgatcgtggtggcgctggccgatccgccgccgcgcaccggcctggtggaccgggcgctgatcgccgcctacgccggcgggctggtgccgatcctgtgcctgaccaagaccgacctggccccgccggagccgttcgcgcagcagttcgccgacctggacctgaccgtggtggccgcgggccgcgacgatcccctgcccgcggtggccgacctgctcgcgggaaaggtcaccgtgctgctcgggcattccggcgtcggcaagtcgacgttggtgaaccgcctggtgcccgacgcggaccgggccgtcggcgcggtgaccgagatcggcaaggggccgcacacctcgacgcagtcggtggcgctgccgttgaccgagcggctgggcaccaccggctgggtgatcgacacgccgggcatccggtccttcggcctggcccacatccagcccgacgacgtcgtgatggcgttctcggacctggcggaggccatcgcggactgcccgcgcggctgcgggcacatgggaccgcccgccgaccccgaatgcgccctggacacgctgaccggacccgccgcccgccgcgtcgccgccgcccgacggctgctggacgcgctcaaccagaattcttagccaaccgcatacccagttcgtcgggcggcaccaaatgcccttcggcgcaacggatttcgacgccgacctcggcgccgcagcccacgtgggtcagctgcaaccggtgacgccccggcagatgacgccggccccactcgaacatcgcccacaccaccggcatgaagtcgattccggcctgggtgagcacgtactcgtcgcggctgcgctgcccgggttcccgatacggccgccgtttcagcagcccgagctcgaccagctccgccagccgcgcggaagtggccgccttggtaatgcccacccgccgggcgaagtcgtcgaaccgggtggtgccgtagtacgcctcgcgcatgatcagcatcgcggacttggtgccgacgacggccatcgtcttctcgatcgcgcactcccccactgccgaccaggcatcgcggtcggccagcggcccctgcagcagtgtcatacaaatcacctcctcggctgagttgctttaagcataccgaggtgcgtatctgagtacagtcgaatatatccagacctggactcgaggaggagccatgaaccgcgacgccgtcatcgtcggagccgtccgcaccccgatcggcaagggcaaggccagtggtgcgctgcacgacgtgttgcccgccgacctgctggcccacagcctgcgggagctggtggcgcgcaccggagtcgatccggcgcagatcgacgacgtcatcgccggcgccgtcacccaggtcggcgaccaggcggtcaacatcgcgcgaaacgcgttgctgggagcgggcttcccggagtcggttcccggtgtcaccatcgaccgccagtgcggcagcagccagcaggcgatcaacttcgcggcccagggcgtcatcgccggcgcctatgacgtggtgatcgccgccggggtggagtcgatgggccgcgtcccgatgggctcccaggtgctgcccggcagcaacccgttcggcgaggcgatgaacgcccggtatcccgaaggcctggtgccgcaagggatcagcgccgaactgatcgccgcgaagtggggattctcgcgcacccagctcgacgagttctccgccgccagccacgagaaggccgcccgcgccaccaaggacgggctgttcgacaacgagctcatcccgatcgccgggctggccaccgacgagttcatccggcccgggaccacggtgcagacgctggccggactacagcccgcgttctacagcgaagccaccgaagcccgcttcccgcagatcaattgggagatcacggccggcaactcctcgccgctgtccgacggcagcgccgcggtgctgatcaccagcagcgagaccgccgcgcggctgggtctgcggccgctggcccggatccacaccaccgccgtggtcggctccgagccgctctacatgctgaccggcgtgattccggccaccgagaaggtgctgtcgaaggcgggcctgacgctggccgacatcgacctgttcgaggtgaacgaggcgttcgcccccgtcgtgctggcctgggcgcaggacaccggcgcggatctggacaagaccaacgtcaacggcggggcgatcgcgatcggacatccgttgggggccagcggcgcccgcatcatcaccactctcgtcaacgcgctggagcaacgcggcggaaggtatggcctgcagacgatgtgcgagggcggcggcatggccaacgccaccatcatcgagcggttgagttaggcccgtgaccgagacccggtacatcccctttcacggcgtgcgggtgcactacgacagcgccaagagctacgaccaactgcgtgccgcgctgctcgccgacatcggcgagcagccggtgccgctcaacgacatcgccaccgacgccggcgactgggagtcgtaccgcaaacgcgtcgaatcccacgtcggcccaagcggattcatgctgatagtcctcatcgatcatggcgcctggatcaccaaggccggcatcgagcgcagggcgctgcgcgtgatcctcggcaacccgctgatcgcgatcaccatgctgcgccacgacgtgacggccgggttgttcgccccggtcgaactgctgctcgccgaggagggttccggcagcagcctgacctacgtcaagccgtcgtcactgatggttccggagagggacccggcgcccaatccggaattgctcgccgccgcggaagcgctggacgagagattggccgcgctggccgtcaaggtgaccggctcggtatcagagttcgcttgagtaccagtggcatacgtcatccccctggctgtaccgctggaaccagcgatcggcgaacaccggaagtggctccttggcgggatcgtgcagtggcgtctggctcatcagcacgcgggcggcggtgccgagcttctgcttccagggcaccgtgtgcagcgcgggccgcacccgcggaccgggaccggcatcacgcctcggcgtcaggccgcgccacggggcgaaatcccgtgcgtccacgccgctctgtcatggcattacctcgcgccggtcggttcgccggaggaaaccgcttagacgacccacgggaaccgtcaccgaaacggtcaggcccaccgcgagcacgaagcacaccagtgcgtaggccaggctgccggtcggcgttccatcacgggtgagcccgtgcgcggcgttcaggtaggcgggcatggccaacacccacagcgacccgagaacaagcaaatacgcggatccgaagatcgcgacgaaggtgttgggcgcgctcggtgtgaacgcggcattgcgccactgccgcaacagcaccgggatggccaccacggcgaacacggccagaagagcgaagtacagcgcccgccgcaacccaccgtcgggatgctggccgccggtcagcagtatcgggacgttggcgacgaccagtccgaccggtaccagcacggccacgccgaatgtgcggccggtcaaggcaattcggctcagccggcggccccgctcgatcgggcgggtcaccagcagctgggcgaacagcgcaacgcaggccggcccgaccgtggcgaagagcaggacgctgctcagcggcaccgacgccagcatcgggcggttgatcgcgttgtcggcgttccacgcccaccagcgcagttgcggacccagctggtcgaagatctcgtagtagcagttgtgcacgaaccccacgcacaccgcgccgacgatcgcgccccagtcccggaacacgccgaggctgcgcaccacttcgtaggccagggtcagcatcgcgggatagagcccgacgatgtagagcggcagccggtcgtacatgaactgcaccgtgaagacgttgtgcgcgaagaccgcaccgatggtgccgtcgacgcggaagaccgtcgggaagtacagcggcggctccacgatcagcaggtagatcaccgtggcgaaccagatcacgatgttgacgggatcgcggtcgcgccgcagccggcgaatcgcccaccacagcgccagcaccgcgcccgcgaccatcagcagctcgagcaccggcagcgtccaattcgccagtccgaacgggtttctcagcgtcacccacggtgcggcgtgctcacagccgaacccgagccggttggcgatgcgctcgatgtcgtcgctacattgaccgctcatcgtcgggcgtcctcagttccaggcgcacgcacaagctgcacgcgcttaccgaaagcttgacgatacatgtctaacaaatgtgtatcgccactgtccagctttgactacatttgctgccatgaggactcacggctggcagggcgagccgccgcgcagcgacgaggatgccgtcgcgcggatcgtggcggcggccgaccggtgcgtgcggcgccgcggcgggcagaccaccatcgccgacgtcgccgccgagctcggggtcagccggaagaccgtgtaccgatacttccccagcaccaccgcgctgctgcgggcggtggccaccgagggcacccgaaagttcttggaagccatggccgaacgcctgagcacgatcgacgacatcgccgaggccgtcgtcgagggcgtcgtcctgaccgtcaccgcggtgcccgacgagccctacctccagctcctgctggaggagccgtcccacgcgctgctgcgcagcatcacgtcggagacagcgcgccgcgtcgggcaacaggtcctggtcgagcacacctcggtcgactgggagcgcacgccgatggcgtcgcggaccctcgacgaactggtcgaatggtcgctgcgcgccgtgcactcctttctggccaaccccagcgatccgccgcgcgacgcggaccagcttcgcggctacctgcgacgctggctggccccggcgatcaggcaatgggtgcaacaggcggcggcggggacgattgtgtgacattcgctgacactcgtcattgacgatcgtcagcgaaatgccgtacggtgcgtccatgcagtcaccagcgacgccgtccgcgaggggcggcggtatccgtgaggcacgccggcgggaaacccgcgcccggttgttcgacgccgcgctggccgagatttcacaacggggcctggccgccgccgacgtcagcgccatcgtcgccgacgcgggcgtggcccgcgggaccttctacttccacttcccgaccaaggaacacgtcctcgtcgaggtggagcgcgccgaggaaacccggatcgtcagcgaactcggcggcgccaccggcgatctggcggcggtgctcaaccaactcgtgcagcacgtgctcagcgcggaaaaaccttgggcccagcggttttccgggacatgctcggactgcacttctgctcgacgcggccggtcgaagacgagttggcgcagcacccgctcggacagttcctggtgggcgtcatcggccgggcccaggacgccgggcaggtctcctccgacgttgacgcggccgaactcgcgacgttcttcctcaccgggctgttcgcgctgctggccaccggcgcacacgacggtgcgctgttaagtcattacgtgacgacgattgtcaaagggatggagaaacgatgactgccaccggtatcgaaggctaccgagccttcctggcgcgacgcgacggcgaggccgacctgctcaacaggcgactggccaatcgcgagcagttcttcacccacatcgaagccaacccggtgcgctcggcgcgtcccgccgaccgagccaccttcctgcgcaacctgcgccgccggaaacccgaacccggcctggacgacaagatgctgttcctgctggccaccgcgaagctcaaccaggccgagcgattcggcgtcgggctcggcgaaacctacgggcgcaacagcgacgaaagcctgccgcccgagaatgtctatctcgaactcgaggagcactatcacactcggctgctggcgtacgccctggacgtgttcgacctgacctttcaggtggtcccgccgccgttcgtgatgcgccagttcgtcaagaccggagtgtttcttccggaacggctcggcttcatgttcgtcggagccgccgagatggccggctgcatcctgttcgacgaactacgccgggtcggcagtgcactgttcgccgacgagccgcaggtcgccgagcgcatcgaactgctctacagcgaaatcctcaccgacgagatcgggcacgtcggctactgcgcctcgcgctgcagcaccgcggagcgggcgatcatgcgccgcctctatccgctgatcggtcggctgttcgcgcgacagaccgccgagatcagcctgctcgtcgacccgaaagcgttgcgcgccaggctcgaccgacccttcgacgtcgatgaactcaccgcgggggtggacaacgaaacctacctcgtcgcccacccctgaccacggactcgacggcggaccctgcaaacaacgtcgcgccgagcgtgcactgagcgcgacagatcggcgaaatattcgccgtgagaacacgaaatattcgccgtgagaacacgtgcggcgaaggctgggccggcccgaaaagccaacgggcggttaggccgccagctcaccgccggtgcgacgcgccacggacgcccgcttgccgcgccgccaaccgcgcacggccgcgatcgcggacttgagcccgcggcgacggccggtagccggatcggtgcccaggaaatcgggatccagctcagcgaacatccgctcgctgcgggtctccggagcgttgtcggcgtcgtcgcgcagatacttgttcggcagcgagagcttggccagcgtgcgccacgtcttcgcgtactggaacaggaaagaccctgtggtgtaaggcaagtcgtacttgtcacagacctgacgcacccgcaccgagatctcgtgcaaccggttgctgggcagatcggggtacaggtggtgctcgatctggtgacacaggttgccgctcatgaaccgcaacaccgggccggcctcgaaattggcgctgcccagcatctggcgcaggtaccactgtcccttggtctcgccgatcatgtcggtcttggtgaatttctctgcgccgtccgggaaatggccgcagaagatgacggcgttggcccacacgttgcggatcacgttggccatcgcgttggccttcaaggtggacaggaaggtcgcgccgggcgacagtgacgtcagcgccgggaacgcgacgtagtccttgaccacctggcgacccgccttggccaggaactcgtcgatccgctgccgggcttcctcgtggtccatccggcgcttgaggatcttgccgatctccacgtgctgcaggcccactccccattcaaaaagcaaggccagcaacgtgttccacaccagattgaacaggttgaagcgcttccagcgctggtcgcgggtgacgcgcagcatgccgtagccgacgtcgtcgtccatcccgagaatgttggtgtacttgtggtgcacgaagttgtgggtgtaccgccagtgcttggacgacccgctcatgtcccactcccacgtcgaggagtggatctcggggtcgttcatccagtcccactgcccgtgcatgacgttgtggccgatctccatgttctcgatgatcttggccacgcccagggtcaccgtccccgcccaccacgccgagcgccgcgagctggcggccagcagcagccggccggtcacctccagcgcgcgctgggccgcgatggtgcggcggatgtagcgggcgtcccgctcgccgcgcgagtcctccacgtcctggcggatggcatcgagctcaacggccaggttttcgatatcggcgtccgtcagatgggcgaatacgtcgacgtctgtgatcgccatcgtcgtcatctccctgcggtcgtattgttcggtccgttcatccgtcccagacctacgctatcgtaacctacgacgccgtaggttacctgtgagtagcctttaaatgtcgagcacgcaatccccggatgcggccgacacgcaggtctgcacccgggtccccggctcgtgttcggcgccggtgcgcagatcgcggacgtgcccctcgaccaggccgaccacacacgactgacagatacccatccggcagccgaagggcatttgcaccccggcggcttcgcccgcatccatcaacgacgtcgccgcgtcggcgtcgacgctgcgcccgctcctggcgaaggtgaccatgccgccggcgccggcgggtgcggccttggacaccgcgaagcgctccagatgcaactgctcgccgatgcccgcggccgaccatacccgctcggcggcgttcagcatcccttccggaccgcaggcccaggtctggcgctcgcgccagtcgggcacctcgcggtccagcagggacaggtcgagccggccgcgggtgcgggtctcccgcaactgcaggcgatagccggggtgctcgttcgccagggcggccagctcgccgcggaacatcacgtcggcctcggtgggcgccgagtgcaggtggacgatgtcaccaatctggttgcggcgcaccagggttcgcagcatcgacatcaccggcgtgatcccggagccggcggtgaggaacaggatcgaggcgggcgccgggtcgggcagcacgaagttgccctgcggcgccgccagccggaccacggtgcccggctcgacaccggccaccaggtgactcgacaggaagccctcgggcatcgccttgacggtgatggtcacggtccgcgccgacgccgacgtcgccgggctcgaggtcagcgagtacgaccgccaccgccagcgcccgtcgatcaacagtccgatgccgatgtattggccgggctggtagtcgaagttgaacccccagcccggtttgatcaccagggtcgcggagtcctcggtctcccggcgcacgtcgaccacgcggccgcgcagctcccgcgccgaccagagcggattggccaggtgcaggtagtcgtcgggcagcagcggcgtggtgatgcgcgcggcgagtttgcgcagcgcgtgccagccggggtgccgctccgcccccgcgaccacgggccgcttggtgtcgccgaggttggcggtgatgggcgatgtcgtcttgctcatggtgttgctcatgttggaagctcctgcctcgcgattgcggcgtgcggtcaacgccagagccaaaagctacggtaccgtaacctacggtaccgtaccctcggcgtcgcggccaggcgtgcggttacaacagctccagcaggaacggcagctcctggctggcgtaccaggccaggtcatggtcctgggcgtcgccgacgatcaggtcggcatcctcgtcccccaggtcggcggcgtcgacggcctcgatcgccttggccaccgccggttcggcggcggcgttgtcgacgtaggcggcgatcacgtcctcgatccggaccggcccggccagcctgaccacggcgtcgtccaggtcggggcggtaggtgaggtcgtcgacgtcggccgccagcaccgcgcggcgcggcggcagggcgccgtgttcggcttcgtgttcggcgccggccagcagccgcagcgacgccagcgccgcctcgcgcagcgccacctcggcgagctcgtcgtcgtcgccctcggcgtaggcctcgcgcaacgccggcgtcagcgcgaacgccgtcccgttgaccgcagccaacgagccgtcggcgaccagccgctgcagcatggccagcgtggcggggatgtagacagtggccacggctagatcagcgtggccgcgtagtcgtcgacatacctcgacagctcacgcggcgggcgctggtagttgccggtcacgacgggacgccgcggcagcttgacggggggcgcctcgacggcgtggtaggggatcgtggacaacagatgggccatcatgttcagtcgcgcgtgcttcttgatgtcggattccacgacgtaccacggactctccggggtatcggtgtgcaccatcatctcgtccttcgcgcgtgaatagtcctcccaccggtataccgattccagatcgatcggagacagtttccagcgccggaccgggtctttcagccgcgccttgaaccggcgcagctgttcggcctcagaaaccgagaaccaatatttgcgcagcaatatcccgtcgtcgatcagcatctgctcgaagatcggagtctgccgcaaaaacagcacatactcctgcggcgtgcagaatcccatgaccttctcgatgccggcccggttgtcccacgatcggtcgaacagcacgatctcacccttgctgggcaagtgcgcgatgtagcgctggtaataccattggccgcgttcgcgatcggtgggcaccggcagcgcggcgacgcgggcgacccgcgggctgagattttcggtgatccgtttgatcgcaccgcccttgccggccgcgtcgcggccctcgaagaccaccaccagccgcgccccggaatggcgcacccactcctgcagtttcaccaattccgtttgcagccggaataattcggcttcgtagacggcgtcgggaatcttcaccgcggcccgggccgatttcttcttgccggccttgaggggaacgccgtcatttttcgcgctgctcacagccacgaatgatagccccacgcagggattttcagcgctgtctagcgctgcctaagaccgggcggcctccaccagttcctcgagcgcctggttcagcaatgcgggcagcaggtcgacgtcgctcatcgcttcgcggtcggcgttgatgccgtagtagagcatgccgttgtaggacgtcacgccgatggccagcgcctggttgtgcagcagcggcggcaccgagtaggtctccagcagcttggtgccggcgacgtacatctgcgactgcgccccgggcgcgttggtgatcaacaggttgaaggtgcgcttggagaagctcgggaagctggtcgcgacccggatgcccatggcgtgcagggtgggcggggcgaaacccgacagcgtgacgatggtcctggcgtccaccagatgcgcggccgtcgggttggattcggtggcgtgcgcgatctgggagagccgcaccaccgcgttcggctcccccaccggtaggtcgaccagaaacggcatcacctggctgatcgcctgaccggggccgctgacgtccaggtcgccgtcggcgtacaccgacagcggcgccatcgcccgcaccgtcgcggtgggcgacaccgccaccccgcgggacatcagccagctgcccagggcgccggcgatcaccgccagcaccacgtcgttgacgtcgcagtcgtagcgggcccgcacggtgcggtagtcctccaggctgccgctggccacggtgaaccgccggtggcgcgacacggtggcgttgagcgggctgctgggcgcggtgccgcgggccacgttgcgcacgaaatcgaagacccgccggccggcgtcgaccagctcgccgtagttggtcaccagcccgccgatcgccgacccgacggcctgcagctgcgcgctggggcccaccagccactccccgatcgcgccgaggaccagccgggtgttgcccgggtcgcgttccgggacccagatgtcttcggggaaggccggcgggcgtttggtccgatcggcgatgacgtggttgatctccagcgccgtcatcccgttgatcagcgcttgatgggacttggtgtagagcgccagccggttcttggacaggccctcgaccagatacatctcccacagcggccgcgtcttgtccagcggccgggcggccagccgggcgatcagctcgtgcagctgctcgtcactgcccggcgacggcagcgccgagcggcgcacgtgataggtgatgtcgaagtcgccgtcgtcgatccacaccggccgggcggtgccgaccggcacctcccgcaccttctgccggtagcgcggtatctgcggcagccgctgctcgatggtgtgcagcagcgtctcgtagctcagcccggcacgcgggcggcgcaggatcgccagcgatccgacgtacatgggggtggcggtgttctccagccggtagaacgacgcatccgccggggacaaccggctaaccatgcagcgctgtcctcctggtcagtgggtcgtccgtgcgcgcagcgaccgtatttctcgcccaccgtagtggtccggccggcgcgcccgtcagcgcgggtacgcccgcgagccagttgtgccatgatgaccactgaccaaccaccgtctgccctctctccagcaggcttgcggtccgccgcaagagtccgccccaacagttggagagtgcgcgttgaacaccggtcccgtcgccaacccgtccgacgctttcaccgtggtaccagtcgtcgactacgagccgcaaacccaggacgtgccgcgcgcgctggcgcagtgccggccgtccgcgcgtgcgccgttgcgccgcggcagcggccacgcgtcgccccgcgcctgcggcgggccacccggccgagcggccgcgccgccatccggcgcggtcatgtccgcccagctgcgcgaggccgcggtgttcgccgacgcggcgctgcgccgggtgctcgaggtcatcgaccgccgccgcccggccgcccagctcaacccgctgctggcccccagtctggtggattctgttgtggcggttgggcgttcgctgaccggaccggcgccgggtgccgcggtgctgcgccggatgcggttgcagccggcgggtcacggcgacccgcagacggcggccgaagtcttcggttgctacagccggggcaatcggatgcacgccatcgcctgccgggtcgagcaggtgcccggcgccggcgggacccggtggatggtggtggccctgcacatcgggtgaaccgggcgcgccctcaggtcgccggtgcggccggccgcgggccggtgtagcgggcgagcaccggccccgcgatcgccatgatgaaaacgtaggacgtcgccagcgccgcgaccgcgggcagcgagctgccggccaatccgatgatgatcaacgagaattcgccgcgggcgatcagcgcggtgcccgcccgcaactgcccgcgccgcgccaccccgtcgtgccgggcggcgaagatcccggtggccaccttggtcgccgcggtcgcggcggccaggatcagcgccgcgggcagcatcgggatcagctcgtgcggatccaccgagtagccgatcgccagaaagaagatggcggcgaacagatcccgcagcggcgccagcacctgacgggtccgggtcgcggtctccccggtcagcgtcaggcccaccaggaacgcacccaccgcggccgaggcgtgcagggattcggccatggccgccacgatcagggtgatgccgagcacccgcagcatcagctgttcggagtcgggatgttcgaccagccgctgcacgtggtgaccccagcggtaggacgcggcgaacgccgccaccagcgcgctcaccgccaccaccatgccaacgacggcgtgcagccagccgccgccggacgccagcaccgcgaacagcggcaggtaggcggccatcgcgaagtcctcgagcaccagcaccgacagcaccgccggggtctcccggttaccgagccggtgcaggtcctccagcagccgggcgacgacgcccgacgaggagatgtaggtgacgccggccaggcacaggatggccaccccgtccagtcccagcagccagccggcgatcgcgccgggcgcggcgttcagcacgacgtcgaccgccgcggacggcaagtggtgccgcatgctgctggagaattcggcgagggagaactcgcagcccagggtcagcagcagcaacaccacgccgatgggcgcgctggtggtgatgaactgcccgccggtggccagcggcagcagcccgcccttgcccagcgccaggcccgccagcaggtagacggggatgggcgacaacgcgaatcggcgcgcggcggcgcccaatacggccagagtggccaggagggcgccgagttgcagtagcagcgtccccgaaatctgcaccggctcagcccttgtcgatgatcttctcgacgccggcgataccgtcttcggtgccgatcacgatcagaacgtcgcgggcatgcaacatctcggagggacccggtgaggccagcacttcgtcgtcgcgcacgatggcgacgatggacgccccggtgcgggtgcgggcccgggtgtcgcccagcgggtggtcgacgaacgggctgccggccaggatgtgcacctggcccgtctccagcccgggcacttccttggccagctcggtgaaccgttcggcgatgcgcggcgcgcccaggatctgggccaccgcctcggcctcctcgttggacaggtgcagcaccggccgggcctcgtcgggatcctcgcgcgcgtagacgacgacgtcgaagtcgccgctgcgccgcgcgatgatgccgacgcggtcgcccttgtggtcggtgaactcgtagcgaaggccgaccccgggcagcagcacctccttgacgtccatacgtcaatcctgacaggtcgctttcgccggcgccgaccccgctagggcagaccggcgggttgggtcgggtgccggcgcggccggtgccccagggggaccagcatcggcacccggtgccggtaatcgcggtactggtcgccgagcgcctgcaccaggtcgtgctcctccaggtgcacggccagcaggatgtagccggtcatggcgatcgagaacagcaggtgcccggcggtcatggtgggcgccgcccagaaggcgatgacgaagccgagcatcagcgggtggagtaccatccggtagagcatccgcgcgtgaaaacctatgtggctgtagggttttccgcgccacgcgagatacacctggcggagtccgaacaggtcgaagtggctgaccatgaaggtggcggccagcgcgatcacccagccgagccagaacaacgtccacagcaccagccggccggctggtgctgtcacctcccagatcacggccggcatcgtccgccactgccagtacagcagcaccagcacggcgctggacagcaccacgtaggtgctgcgttcgatcgtggccgggaccagccgcgtccaccacgccttgaaaccgggccgggccatcacgctgtgctgcacgccgaacaggccgagcaacaccaggttgaccaccaccgcctcgccgatcggcgacgacagtccgtgatcgacggtacgcggcacccaaaagtttcccaggaaagcgacgagatacagaaatgcgccgagaaagagcagataagcggcggctccatagccgacgaccagatagcgtttcattagctgattgtgcacccgatcggccgccgggaacatggggcgattgcctcaactgtgcagcggagcggccggcaccagcccgtgctgcagcgcatacatgctggcgccgatccggttcgacacgccgatcttggcgtaggtccgctcgacatggttgcgggcggttttctcgctgatcaccagcgcggcggcgatctccttgttggaggcgccgcgcgcgacgtgccccagcacctcgatctccctgggggtcagcccgtcggggcgcgggttgggccgcggcccgacgggctgaccggcggcgtgcagcaccgcttcggcggcgaccgggtcgagctcgccgcagcgcacccgcccgcgcagccgtcgcgcggcctccgcctccgacagctgctcccggtacggccgcggctcgcggcccgactggtaacacaccgcggcggccagaatgcggtccggcatgcccagcgccgggccggccaggccgcggggatagcccgagccgtcgaggcattcgtggtgattgccggccacctcggccagccgccgcagcccgggaacctggtcgaggatgcgcaccgtcagatacggatgcagccggacccgctcgaactgcgatccgctcaacggccccggccgcgaccagatttggttcgacaccccgatgcggcccaggtcgtggacatggccggcgcgccgggtcagcgccaccgcgtcggcgtccaacccggcggcccgcgcggcttgccccgcgagccgggccaccgcgcgcgaatgcccaagtgtgaacgggcatttcaggtcgacgaagtcgcccagcgcgacgagtgccgcgtccagcgactgttcgtccacccggtggcggtcgggcgcctcgcgcaacgcggccgcccacgcgtcgccggtctgcgggccggccaggatcgcgtcggcgtcccgcagaaagacgtccgcgatcccggggtcgaactggccgccgcgccgggcgccgaccatggccaccgccccggccacgccgtagctgcggtggtgcacctcgaccatgtcggccagctgcgcgatgcgcatctggatcgggatgtcctcaccgcgggcgccggtgggcagcccgccgccgtcgtagcgctcgaaggtgtaggcgagcgcggcttgtacgttggggcccaagccgattcgatcggccagcagggccgccgaggcgcagtgcgagtggatcaaccgggagatgtgaccgcgcgcgttggcgaacagcgtggccatcacgctcagccggtgcgccaacggctggccgcggccgacgttgctggccaggaaccgcaggtacggaatgccggaccagtccaccagatacgagtcgtggcgcacggcgatgtcgtcgccgaaccaccgcgcgtactcgtgcgaatccgcgtggcagccgatccacatgaccagggtggtgtagtacacgcagtcgcgctgctgccggctgagcccgagccggtcgcagagtcgggtcgcgatgagcgccgcccgcagcatgtgctcggcgggctggccgaggccgaggtcgatcgccaccgacagcgccgccagcagctccgcccgcgtcgggagtacggcctgcgccatgagcatcattgtgcccagccgatcggcgcggggtcacccgattgcgacggtgcgcggcgcggcgtgatgacggcccgggtcgaagttctcgaaatgcccgccgccgaccgcgaacaccccgcgctgcgggggccggaaaccggccagccgggcctggcgtcgcagcggcccgaccggtcccaggtccgcgccgtccagcaccgcccgggagtggtgcaccgcccacacctgcgcgggcgcgagcatgaagcgctgaccgttgggcaccgttccgcagagccggacccggccggcccgcagcagcgggccggccgcgcgaccgagcacggccagcacggcccggctggtccacgcccgctgcggcagccgcgcgccgagcgcactcatcagccgggtggcgacggtggcccgcagctcgatgcgccaggcgagcagtcccgggatctcgacgagcagcgaccacggggtaacccaggcgacgtcgatgtcgcattggaccgcgtcgcgggcggtcgccgcgccgaagtagcgggcacagctctgcgggccgggggtggtggcgtagaaggtccacaccccgtcgcggtcgcggtgccacaccgagcggtagccgggcgagaacgaggtcgccggaaactgccgcagcgccaggtaatgcccgctgccgaagggcagccccatcacgccgaaaccgacgaaccgttcgtcgtctccggcgggcagggccgggtcatccaggacggccgtcgcggcgtcgagaggggtgcgtgtcgtggtcatgcatgcatggtgggcgccgacaccgccgccgcgcatggggcgaatgcctcaactcggcacagggcgtgcggcggcagcgcccgcggcggcccggcgcgtatgcctccccggcccgcgcccgcccgagcgtgaaattaggtgcacgctcggcgccgagcgtgaagttaacttcacgctcgagcggagggtgtcgcgagtggccgcgcggaggcggccaaatccggacggaaggctagcggcgcttcaccgatttggggggcttggcgccgcggccctgctggcgcgcggcggcgcgccgctcgcgacggctggcgccggcgggcaccccggccggcgtcttggcgtcgccgccgttgcgctgcacctgcgccgagccgtcctcggacgggccggagtaggtcatcgccggcgcttcgttgtcaattcccttggcgcgcaactgcgttggggcttcgtcacgtgcggccgtcgcggtgccaccctgttcggccggcgcccccagctcggccagcccctcgggcgtctgcaccggcgccacctgcggggcgggcaccgcctcgacggtgacattgaacaggaagccgaccgactcctccttcatgccgtcgagcatggccatgaacatgtcgtagccctcgcgctggtactccaccagcgggtcgcgctgcgccatggcgcgcaggccgatgccctccttgaggtagtccatctcgtagaggtgctcgcgccacttgcggtcgatgacgttgagcagcacgttgcgctccagctggcgcatcgcgccctcgcccgcgatctcctccagctcggcttcccttgtggcataagcacgttcggcgtctttgagcagcgcctccagcagctcctcgcgggtgaggtcgtcgaagccgccgtcggcgtcccggcgggtgagcgtggcatagtcgatgccgaccggatacagcgtcttcaacgccgtccacaacgcgtccaggtcccaatcctcggcgtagccctcggccgtcgcgccgttgacataggcggtgaccacgtcgcggaccatctcgagggcctgctccttgaggttctcgccttccaggatgcggcggcgctcggcgtagatcaccttgcgctgctggttcatcacctcgtcgtacttgaggacgttctttctgacctcgaagttctgctgctcgacctgggtctgggcgctcttgatcgcccgggtcaccatcttggcctcgatggggacgtcgtcgggcaggttgagccggttgagcatcgcctccagcgcggcgccgttgaagcggcgcatcagctcgtcgcccagcgacaggtagaaccgcgactcgcccgggtcgccctgacgcccggagcggccgcgcagctggttgtcgatgcggcgcgactcgtgccgctcggtgcccagcacgtacaggccgccggcctcgatcacttccttggcctcggcggcggcctcggccttgaccttgggcagttcctcgtgccaggccgcctcgtactcgtcgggcgtctcgaccgggtccaggccgcgctcgcgcagccgctggtcggtgaggaagtcgacgttgccgcccagcacgatgtcggtgccgcggccggccatgtgggtggccaccgtgacgccgccgcgccggccggccaccgcgacgatgccggcctcctgctcgtggtacttggcgttgagcacgttgtgcgggatgcgccgcttctggaactggcgcgacaggtactccgaacgctcgacgctcgtggtgccgatcagcaccggctggcccttctggtagcgctcgaccacgtcgtcgaccaccgcgatgtacttggcttcctcggtcttgtagatcaggtcggactggtcggtgcggatcatcggcttgttggtcgggatcggcaccacgccgagcttgtagatctcgtgcagctcggccgcctcggtctgggcggtgccggtcatgccggacagcttgtcgtagagccggaagtagttctgcagcgtgatggtggccagcgtctggttctcagccttgatctcgacgtgctccttggcctcgatggcctggtgcatgccctcgttgtagcggcgaccgtacaggacgcgaccggtgaactcgtcgacgatcagcacctcgccgtcgcgcacgatgtagtccttgtcgcggtggaacagctccttggccttcagcgcgttgttgaggtagctgaccagcggcgagttggccgcctcgtacaggttgtcgatgccgagctggtcctcgacgaactccacccccagctcgtgcacgccgacggtgcgcttgcgcagatccacctcgtagtggacgtccttttccatcagcggggccagccgggcgaattcgaggtaccagttggaggcgccgtcggccggcccggagatgatcagcggggtgcgggcctcgtcgatcaggatcgagtcgacctcgtcgacgatcgcgaagttgtgcccgcgctgcaccaggtcgtcgagcgagtgcgccatgttgtcgcgcaggtagtcgaagccgaactcgttgttggtgccgtaggtgatgtcggcgttgtaggcgacccggcgctcgtcgggcgtcatctgggcgagaatcaccccgacgtccaggcccaggaagcggtgcacccggcccatccactcgctgtcgcgtttggccaggtagtcgttgacggtgacgacgtgcacgcccttgccgccgatgccgttgaggtaggcgggcagcaccgaggtcagggtcttgccctcaccggtcttcatctcggcgacgttgccgaagtgcagcgccgccgcgcccatcacctgcacgtcgaacgggcgctggtcgagcacccgccaggccgcctcccgggccaccgcgaacgcctcgggcagcaggtcgtcgaggctctcgccgtcggcgtgccgcttcttgaactcgtcggtcttggcccgcaactcggcgtcggtgagcttttcgacctcgtcggacaaggtgttgacgtagtcagccacccgcttgagacgcttgagcatgcgaccttcgccaaggcgcagcaacttcgacagcacggtgttgtcctctacggtctgattgcccggctcctgcgcatcgcgctgcgcgctctgcgtcgtcgtcgggccggatcggggtctttggcgacacccatcctaggtgacgtcgctctttggacgccgaacgtcgactcgtggtgcggattcgcccgaaatcgcgcaatagagtcgacgttcggcggacgacgggatcagtcaggccaggcggatcaggccgtagtcgtaggcgtgccggcggtagaccacacagggccgttcggtctgcttgtcctggaagagaaagaagtcgcgcccgacgagttccatttcgtagagcgcgtcgtcgaccgtcatcgggatggccgggtgctccttggtgcgcacgatgcgcccgggctcccggtcgagctcggtgtcgggctccacgccgtcatggtcggccgccggctgcggctcgctgggcagcggcgcgtgcgggggcaccgcggtggcggcggccagcgagaccggggtcttgtcgccgtagtgcaccttgcggcgatccttgacgcggcgcagccggttctccagcttgtcgaccgcggactcgaaggcggcgtagaagctgtcggcgcaggcctccgcccggctgacggggccgcggccacgggcggtgatctccacccgttgacaggacttgcgctgccgccggttgggcgcgtgcttgagttcgacgtcgaagagatagatcgagcggtcgaaccgctcgaggcgggcgagtttttgcgagacgtacagacggtagtgatcggggatttctacgttgcggcccttgaacacgacttcggcggtggccgtcggttggccttgcccgtcggtgctgggcgacgactggtccagaatctgaccggaatccacggatagccttgacatacgtgacaactcgtttctcttttcacgtcgcacgcgccctgcgtgcccggctgatgtgatgcgccgacgaggtgagagcggttcgagactggctaccgccgcaggctgcccgccggagcaaggtgtcgattactcaccccttccgcgtgggtctcaacctggaaatatcgcgaccagtgagtcgaaccagagtcgatgatgttgtcctcgacgttagctcgtgttcggctgccgatgccactaatttcgtcgagctgttgcgtgttcttcacatcgcgattcacgccgccgcgatcgccagcacggcggcgacccgggcccctgccgcgtgcaggacgcgcaccgactcgcgcgccgtcgccccggtggtgacgacgtcgtcgacgaccaggacgtcggcgcccggcagcggcgcgggccggccccgcagcaccacccggccggcgatgttgcgttcccgctcggcggtgcccagccccaccgagtcgcgggtgagcgcccggatccgcaacaccgaggcgacggcgatgtcgggatggcgggccaccgcggcgcgcgccagccgggtgacgggatcgccgccgcggcggcgcgcggccgaccgtcgggtgggcgccggcacgacggtcagcggggtggcgacgatgccccagcacagcagccggtgcaccgcgacggccagggcgcccgccagcggcgcgacgaggtcggcgcggccgtgttccttgagcgccaggagggcgcgccggcgggtgttggcgtagcggccgagcgcgaacaccgggacgcccgggtcgacgcgcgggttcaccacgtgcggttcgtcgggtttgacgaccagctccgccgcgcaggccgggcaccagcgggtcgccggcgccgcgcagccgccgcattcggccggcaggaacaggtcgagcatgccgccagtgtggcgggcgggggtgacaggtggcgccgctagcgatcgccgctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgagcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgcccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcaaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagcccggcagcaccggtgcggcgccgggcaccgtcagcccgggcacctccgaccagccctgctggccgtccgccgacggcgaatactgcagcaccccttggggacccgcgacataggcggtggacgggttggccaccaccgtcgtcaccggcatctgcacaccgtgcggcggggcgtcggagttgaccccgtcgaggttgacgtaggagaccgggtggctggagtcggtgcgagtcaccacgatgtcgtcgccggtgcgccaggacagcgacaccaccgaattgcccagcccgaaaccgagccggcgcggatacgtcagggcgtactggccggcctgggtctgctcgacgctggccaggatcacctggccgccgatcaccatcgcggcgcgggtgctgtcccgggacagctgcaggtcggtgatcggccccgggaaccgagtggccaccgccaccgagtccaccggcagccgggcgggctgcccggacgccggctcctggatcgcccgcagcacgttgttgccgtcgaccaccacccagaccacgtcgtccagcgaccaggtgggccgcgacaggctgtgcccgtcggcggactgcaccgcctcggcgcccagatcaccgatccacaacgaggccgccatgtccggggcgccgcggtgcagcgtcaccaccgacgccacctggcggccgttgcgcgacagcgcggcgccggtctgatcgcccatccgcccgaacgccccgggcaccacgacggtgtgctgcccgtccagcgacaccagtgacccgttcaccagggcatgcagcccggcacccgcgccgtcggcgacgccggggtcggtggcggcgacgtcggaagtggtccagccgtcgcggaaccggtcatccagcggcgcgccgtcggcgttgatcacgtacgggccccggatatcggcccgggccagggtccaaatgatctgtgccgcaaccaattgcctgctgtgcggatcggtggtggacagcttctccaggtcgatgcgcgcgccgccgtagccccgtccgatcccgctcttgccgccgtcggcccgggtcaccggcccgcgcagccgcagcggcggggccagcagattgcgcacggtgtgcgccatctcgggccgcggcccggcgatcagcttggaaaccagctcggtggccagctgatcgtggtcgggcaccgcgacgtagcgcggatcgggcaccacggtcttgccggtcgggtcggcgaaatacagcgtgttgcgcttgtaggtggcctggaactgctgccagtccaggaagaccccgttgggcaggcggtcgatccgccagccgccggaggtcttgaccaactcgatcggccccgggtcgggcaacaccccctcggcggtctcgaacacccccatgtccgacagcgaacccaggatgtcggcccgcatggtcgccgaaacacgttcggccgcacgggtttccacgaacacgacgtggtcgatcagcagcgcgctgccggcgtcgtcccaggcgttggacgccgactgggtgaggaactggcgcgccgccagatgccggttcgcgggatcggctgtggccttgaggaattcgcgcagcaacacgtcggggtccatgcccggggtgggcttgggcaggttcgacggcgccggccgctcgacggtgccgatggcttgcggcgccgacgaactgggcaccccggcgcagccggcgagcagcacggccagcatcagcaggcccaggagcttacgccccatcacagcgacctttcggcgtgctcgcgttggcgcgcacggtctttcgcgtgttgcgggccggtcgacggggactgcccaccggacggggacggctgcgggatcggcttcatcggcagcgggctggtggtcaccttgtggccgcggaccagcggcagggtgagccggaagcacgagccgacgcccggttcgccccacgcctccagccggccctgatgcagccgggcgtcctcgatgctgatcgccaggcccaggccggtgccgccggagcggcgcacccgcgacgggtccgcccgccagaaccggctgaacaccagcttctcctcgccgggccgcaaccccaccccgtagtcgcggacggtgaccgcgacggtgtcctcgtcggcggccatccggatcttgaccggcttgtgctcggcgtggtcgatggcgttggcgatcaggttgcgcaagatccgctccacccggcgggtgtcgacctcggcgatgacctcctcggccggcagctccacctgcagttcgatgccggcgtcctcggccagatgccccacgttgctcagcgcgctctgcaccgtgctgcgcaggtcgaccgcctcgacggacagctcggcgaccccggcgtcgtgccgggagatctccagcaggtcgttgagcagcgactcgaaccggtccagctcgttgaccatcagctcggtggagcgcgccagcgtcggatcgaggtcggcgctgtggtcgtagatcaggtcggcggccatgcgcaccgtggtcagcggggtgcgcagctcgtggctcacgtcggaagtgaagcggcgctgcaggtttccgaactcctccagttgggtgatctgccgcgacaggctctcggccatgtcgttgaacgacatcgccagccgggccatgtcgtcctcgccgcgcaccggcatccgctcggacagatgcccctcggcgaaccgttcggcgatgcgcgacgccgaacgcaccggcaccaccacctgccgcgacaccagcagcgcgatcccggccagcagcaccagcagcacggcgccgccggtgatcatggtgccgcgcaccagctggatggtggcctgttcgttcttcagcgggaagatcaggtacagctccaggttggccacctgggaggaggccgggctgccgacgatcagcgccggcccggagaacccgtcggtgtgcacggtggcgtactggtaggacgcctgcccggccttgacgaagccccgcagcgaagcgggcacctgatcgacggggccggccgtggtggccgcgcgtgggccgtcaccgggcaccatcagcacggcgtcgaaggtgccggccgtccccgcccccgaggctgaatcggtcttagacgtcagcgtgttgcgggccagctgcaggctgctgtccagcgagcgcgcctcttcgccgttgacgatcccgccgaccgtggtgcgggcccgctcgatctgctcgatggcggccttcaccttgacgtcgagcacgcgattggtgacctgggacgtcagcacgaagcccagcgccaggatgaccgccagggacagtcccagggtcagcgccaccacccgcagctgcagcgagcgccgccaggccgtgcccaccgcccggctcaccgcgcccatgccgcgagtcatcggaccggagcgcccccagcggctccgcgtacgtcgccgggagccccacatcatcaatgacgccgcccctcagcatcactccgttctgcatcttcgccggcgcagccggcgatcacggaggtccggccttgtaacccactcctcgaacggtcaacaccacggtcgggttctcagggtctttctcgaccttggcccgcagacgctggacgtgcacgttcaccaggcgggtgtccgccgggtgccgatagccccacacctgttcgagcagcacatcacgagtaaacacctgccgcggtttgcgcgccaacgccaccagcaggtcgaattccagcggggtcaacgagatctgctcgccgttgcgggtgaccttgtgcgccggcacgtcgatctccacgtcggcgatggacagcatctcggcgggttcgtcgtcgttgcggcgcagccgcgcccgcacccgggccaccagctccttgggcttgaacggcttcatgatgtagtcgtcggcgcccgactcgaggcccaggaccacgtcgaccgtgtcggtcttggcggtcagcatcacgatcggcacgccggagtcggcgcgcagcacccggcacacgtcgatgccgttcatgcccggcagcatcaggtccaacaggaccaggtcggggcgcagctcgcgcaccgcggtcagggcctgggtgccgtcaccgatgaccgcagtgtcgaaaccctccccacgcagcacgatggtgagcatctcggcgagcgaagcgtcgtcatcgacgacgagaatcctttgcctcatggagtccatggtgtcaccagatcgggacaaaattggggcgccacacgggcgtttcttctcggatacggccgaatcgtgacaaatctgtgctatccggccgccaaatcggcggccagccgggccgggtcgacgtccgcgtcgacgacccgccaggcaccgccccagcccgcggcggccagctgcgcgtacaccgcgccggtgcgttgctgcagcccgtcgtcgcgttcgtagctgtcccgcgcgcggcccggatcggactcggcccggctgcgggcgcgctcggcggccagctcggccgagaccgccagcagcacctgccggtcgggtgcgggcagtttcagccgcccgtactccagggtgtgcacccaggcgaccgcgggcccgtcggcgtcctggtgcaggcgcgcggcggtgtaggccgcgttggaggcgacgtagcggtccatgatcaccacgtcgtggtcgcggcgcaggccctcgatgtcgccgacggccgcggcccggtccagcgcgaagagcatcgccatcgcgtacaccgacgacgccaggtcgccgtgctcgccgtgcagcgcctcggccgcgatgtcggcggtcacggagcgcccgtaacgcgggaaggccagcgtggccaccgactgtcccgccgcctcgaaggccttgcgcagaccctcggccagtgtccgcttgccggcgccgtcgacgccctcgatcgcgatcagcacggcgcgagcctatcgggccgccgagcgtgaagttatcttcacgctcggcgccgaacgtgaatctaagttcacgcccgggccgccggcgctgtggccgccggcgcccggcagcgcgctcagtagcggtagtggtcggccttgtacgggccgtcgacgtcgacgccgatgtactcggcctgctccttggtgagcttggtcagctcgccgcccagggcctccacgtggatgcgggccaccttctcgtcgaggtgcttgggcagccggtagacctcgttgtcgtattcgtcgttcttggtccacagctcgatctgggcgatcacctggttggagaagctgttgctcatcacgaacgacgggtgcccggtggcgttgcccaggttcagcagccggccctcggagagcacgatgatcgacttgccggtgtccgggaaggtccacaggtccacctgcgggcggatgttggtcttgatggcgccggacttctccagccgggcgatctggatctcgttgtcgaagtggccgatattgcccaggatggccttgtccttcatcgccttcatgtgctcgagggtgatgatgtccttgttgccggtagcggtgatgacgatgtcggcctcgccgatgacgtcctccacccgcttgacgttgtagccctccatcagcgcctgcagcgcgttgatcgggtcgatctcggtgacggtcacccgggcgccctgaccggccagcgactccacgctgcccttgccgacgtcgccgtagccgcagaccagcacgttcttgccgccgatcagcacgtcggtgccgcggttgatgccgtcgatcagcgagtgccggcagccgtacttgttgtcgaacttgctcttggtgaccgagtcgttgacgttgatcgccgggaacgccagatcaccggccgcggcgaactggtacagccgcagcaccccggtggtggtctcctcggtgacgcccttgatcgactcggagatcttggtccacttggtcttgtcggtctcgaagcgcgcgcgcagcaggttgaggaacacccggtgctcggcggagtcgtcctcgtcgtcgggcggcaccacgccggccttctcgtactgggcgccgcgcagcaccagcatggtggcgtcgccgccgtcgtcgaggatcatgttggccggcgcctctgtcccgtccgcgagcggaggccaggtcagcgcctgctcggcggcccaccagtactcctcgagcgtctcgcccttccacgcgaacaccggcacgccccggggctcctcgggggtgccgtgcgggccgacgacgaccgccgcggcggcgtggtcctgggtggagaagatgttgcaggacgcccagcgcacctcggcgcccagcgccaccagcgtctcgatcagcaccgcggtctgcacggtcatgtgcagcgagccggagatgcgcgcgcccttgagcggctgcacgtcgtggtactcccggcgcagcgacatcagaccgggcatctcctgctccgagagctcgatgtcgcggcgcccgtagtcggccagcgacagatcggcgaccttgaactcgatgccgttgcgaacgtcgggggtgagcgcgttttcggtcgtcgtcatgggttctcttcctgttcctgccgtccggggatcactgggtaattagcttaggtatgttcttgcgccactgtagtcgcgggtcggcgccccgccgcggccagggaacgctcacccgacgttgacgacgccgtgccgctcggcgaacggcgtcatcaaccgggccagatcggcggccacgtcgtggtcggcctcgggcggcatcgacacgtagctcagcgccagccgcacgatggcgcgggccagcaccccggcgtcctcgtcggtggtggacacccaggtgtgcgtcagcgccgaggccagccgcgccgacgcgcgggtgatgatgaccgcgctgtcggtggtgatcagctgcaacaggtcgggcttggcgacgccggtgcgcagcgaggtcaccagcgggtcggccgccgcgtcggcgaagaacctgcggaaggcgtccaggaacgactcgtagatgttgccgacgtgggcgtccagggcctcgtggatggtgtcgaccaggcggtcggctaggcgcagcgcgtacccctgcgccaggccttgccgggagccgaactcgttgtagatggtctgacggctgatgccggcggcccgggccacgtcggacagcgtgatggccgaccagtcccgggtcaccagcagatcccgcatcgcatccagcaccgagtcgcgcagcagggcgcgcgacgcctcggcgtacggcatccgcttcacagccgcgacaatatcgggtttgggcatcgggtttcagcccgatcagggccgcgccacttccaccatctcgaagtcgcttttcgccgcgccgcagtccgggcagctccagtcctccgggatgtcgtcccagcgggtgcccggggcgatgccgtcctccggccagcccttggcctcgtcgtactcgaatccgcactgcacgcagacgaacagcctgtagtcgctcatcggttcactcctgtccaatcaggttttcgaaatcgaccttctcgcgcaccgcgcaatcggggcagcaccagtcgtcggggatgtcggcaaacgaagtcccggccggaaagccttcccgcggagcacctttggcctcgtcgtagatgtagtcgcagccggggcagcggtagcgggtcatgccgtcaccgccgggtagcgggccagcagcttggcgcgccgccgcggcgacacgttgacccgggtgatgtcgccgccgtagtgggccagcacccgatggtccatcaccttgcgccacagcggcgggaagtaggtgagcgagatcatcgacgcgtacccgctgggcaggttgggcgagccgtccaggctgcgcagcgtctggtagcgccgggtcgggttggcgtggtgatcgctgtgccgctgcaggtggtagaggaacaggttcgtgacgacgtggtcggagttccagctgtgctcgggcgtgcaccgctcgtagcgcgctttccccgaaggcgagtcgatcttgcgccgcagcagcccgtagtgctccaggtagttgaccgcctcgagcaggctgaagccgaacaccgcctggatgaccacgaatgggatgagccccgggccgaagaccgcgatcagcacgccccacaacacgattgacatcgcccaggcgttgagcacgtcgttggacgggtaggtgagcgggttccacgggttcttgccgagccggcgcagccgttgggcttccagccgcagcgcggagcgcaggctgccgaacacgctgcgcggcaagaactcccagaaggtctccccgaaccgggccgacgccgggtcctccggcgtggccacccgcacgtggtggccgcggttgtgctcgatgtagaagtggccgtagcaggtctgggccagggtgatcttggacagccagcgctccagcgagtccttcttgtggcccatctcgtgcgcggtgttgatgccgacgccgccgagcacgccgaccgacagcgccagccctagcttgcccgcccagccgaggccgccgtggaagcccagccagctcaggtcggtggcggtgaacaggtaggcgcccaggatcacgctcaggtactggaacgggatgtagacgtaggtgcagtagcggtagtacttgtcgttctccagccgctccatcacctcgtcgggcgggttctggccgtcggggccgaagcgcaggtcgaggatcggcaacaggacgtagagcaggatcggcccgatccacagcggcacctgggcggcggcgtgccagcccagccggttcagggcccagaccagcggcagcatcacgaacagcgccgtcggcgcgatcagccccatcagccacagccggcgctttttgtcccgccaggcggccggatccgagggttgttgcaggtcaacggtggtcatttggaaacctcctcgtgagtcacaccacgttggaggttgacaataccggcgtctacgtctcctgtctagacaaaaggtgtccgtttgtaaagccaggtggctttgagtggctttaagtggctttacggcaccgggctgttggggtcggccgccagcgcgtcgctgcggtcgggttcgccggcgtcgcgacggccctgcaccgagtgccagtagccgtagccggcgtagatcgccgtgcccaccaccagccagatgccgaaccggacccaggtgagcgcggtgaggttgagcatcagccacacgcaggcgccgatcgaggcgatcggcagcaccggcacccacggcgccttgaagccccgctccaggtccggtcgggtgcggcgcagcaccatcaccccggcggagaccaggacgaaggcgaacagcgttccgacgttgaccatctcctcgagcttggtgatcgggaacaccgacgctgtcaccgccaccaccagggcgaccagcacggtgatgcgcaccggcgtgccccgcgacccggtcttggccagcgcccgcggcaacagcccgtcgcgcgccatcgcgaacagcacccggcactggccgagcatcagcaccatcacgaccgtggtcagcccggccagtgcgccgatggagatgatcttgctcgcccagtggatgccgttggcggtgaaggcggtggccaggttggcctgcccgcggcccggcatcgtcttgagttgggtgtaggacaccatgccggacaacacgacggcgaccgccacgtagagcagcgtgacgatgcccagcgacgccaggatgccccgggggacgtcgcgctgcggatgcttggtctcctcggccatggtggccacgatgtcgaacccgatgaacgcgaagaacacgatggacgccccggccagcacgccgtaccagccgtagtggctggtgtgcgccccggtcagcagcgacagcaccgactggtcgatgcccttggcctggccgccggcctccggcttggggatgaacggcgagtagttggcgcgcttgatgtagaagacgccgaccaccacgacgaacaccaccaccgacaccttgatcccggtgatcaccgcggagaacctcgacgacagcttggtgcccagcgcgatcagggtggccaccccaccgacgatcaccagcgcaccccagtcgagctgggcggccccgaatttgactgtgccgccggagaatccgaacaccgtgcccagatagctggaccagcccttggccaccaccgcggcgccgatggccaactccagcagcagattccagccgatgatccaggccaggaactccccgaaggtggcgtaggagaaggtgtaggcgctgccggccaccggcagggtggaggcgaactcggcgtagcacagcgccgccagcgcgcaggtgcccgccgcgatcacgaacgacacccagatggccgggccggtgatgtcgccggtcgtcgacgcggtgacggtgaagatgccggcgccgatcaccaccgcgacgccgaacacgaccaggtcccaccaggtcaggtccttgcgcagccgggtgtccggctcgtcggtgtcggcgatcgactgttccaccgacttcgtccgccatcgactggccattcaaccgccctttcccaacgctgggagccattggtccgtcacagtactgggtagtctccgcagatgccggacggcaaagcaaacgcgcgggagcacgcgctggtcatcgggggaagcatcgccggcctgtgcgcggcgcgggtgctgtcggagtcgtattcggcggtgacggtctgcgagcgcgacgagttgccggccgcgccggccagccgggcgaccgtcccgcaggaccggcacctgcacctgctgatggcgcgcggggcgatcgaattcgagaagctgtttcccggcctgctcgacgatatgacggccgccggcgtgccccggctgcacaaccggcccgagtgcatccatctgggcgccgccggccacgtgctgggcaccgggcaaaccctgcgcgacgagttcaccgcctacgtgcccagccgtccgcagctggaatggcagctgcgcaaacgggtgcacgccatcggcaacgtgacggtgctgcgccgctcggtggcccagccgcggttcgacccggcgcgagcgcgggtgaccggggtgtggctggacccggtcgccggcgggtccgcggagttcgtcgccgccgatctggtggtcgacgcggcggggcgcggcacccgattgccggtgtggttgtcgcagtggggttttcagcgcccacccgaagaggtgatcgacatcggcatcaactacgccacccagcacttccacatccccgacgggctgatcgcccagaaggtagtggtggccggcgcctcgcacgacgagccgctggggctgggcatgctgtgctacgaggaccgggtctgggtgttgaccacgttcggggtggccgacgccaaaccgccccgcacgttccccgaaatgctgacgctggcgcgccgcttgctgcccgcccacttcggcgacgcgctggcccgggccgagccgctgggcgatcccgcgtttcacgcctttccggccagccggtggcgccgctacgacaagctggaccgcgtcccggccggcatcgtcgccctcggcgatgcggtggccagcttcaaccccaccttcggccaggggatgacgatgaccgcgctgcaggccggtcatctgcgccgcgcgctgcgatgccccgacgaccggctggccgcggcgctgtaccgggccaccgccaggaccaccttcccggtgtggacgatgaacgccatcggcgacgtcaccttccaccacgccaccaccaaacgacccgccccgtggtggtggcgaccgtcgggcgcgctgttcgaccagttcctgggcgccgccgagaccgaacccgttctggcggaatggtttctgcgccggttctcgctgctggacagcctctacctgatcccgccgccccgcatcgtcgggcgcgccgtcgggcacaacatgcggctgtggctggggcagcgccgccgggcgggccggccggggaccgctacagcccgaccgtcgccctgaacagcttggtgggttcgtgggcgaccagccggatcggggcatcgtcggcggccacccaggcggccatgccgcgcttgagccgcagcgagccggatttgccgtgcacggtcgtgcagccctggatgcacagcaggatctgcgggccgtcgtggctgcaggtggcgtccacctcgtggccgacgtactcgtcctccagctccaacagcgcgacggcgaactcgtcggtcggggtctcatagatccgcccgaagccctcgcgccgcacgcgcgggcgcagctggtcctcggtggtgggcgcgaagtcgagcacccgcagcagctcgggcacgtcgacgtgcttgggggtcaggccgccgcgtaacacgttgtcggagttggccatcacctccacggcgaagccccgcagataggtgtgcaggttgccggccgagacgaagatggcctcgcccggggccaggctgacccggttgagcagcaacgcagccagcaccccggcgtcgccgggatagcgctcgcccagctcgagcacggtcttggcctcggccgcgaattccgttgcgcccgaactgagataggcgattgcgccgtccagcacggcgggcaccagcacgtcgatgtcgggctgcggggcggtgatccaggtggtgaacagcgcgcgcaggccgtcggcgtcggactggtcgcccagcaactcgatgaagggatcgagatccgagacggccagcgcccgcagcagctcgacggtgcgcgacgccgggcggaacccggccagcgcctcgaacggatacagcgcgaccagcaactccggcttgtgcgaggtgtcgcggtagttgcgcaccggcgagttcagcgggatgccgagccgctcctcgcgcaggtagccctcggccgcctgctcggcgctcgggtgtgcctgcagcgacagcggctcgtcggcggccagcaccttgaccaaaaacggcagcacgtcaccgaaccgggcccgcgaccccggaccgagctgtccctccgggtcggcgcgcagcgcgtcgagcaacgtgatctcgccgttgtcggtctccagccaggccgggtcgcccgggtgggcgccgaaccagagttcggcctccggatgcgccgccggcaccggtcgttcggtgaattcggcgatggcggtacgcgaaccccatgcgtatgttctcaaagccccgcgaagcagctccactgttctatctatccccgcaccagtcgcatgtaaacggcggccatctccagccggacggccagcaccgccagctgctgctcggtccgcccgggcccgccgagtgcgggtgacacgccggagccggccgagccgccggggccgtcgggcacatcctcggcggccagcaggtacacgtcgtcgagcccggccgtgcgggcggccaccaccgtctgctcggcggccagcaccaccgccagcacccgcagccggggtggcagcggcccgtcgatctgctcgtcgtggaacagcgcggcgtccggatcctccagggcgcgcggcaccgccgcgcgcatggcgaccaccgcgtcggccagcccggtggccggggtcacctggttggccacccgcaacagcacggagctgccgtgccgggccagcgccagggtcgccgcgctgtcgccggccagcgcgacctggcgatcggcgatccgcgcggccagcagcttggccgggttggtgaacagctcgcgcccggcgctgttgcgcagcgcctcggcgtccagctcgtcggcgagcagccccaggtcgacgctgggccgcgggtccacggcgtggaccaccgccagcccggcggccaaataccggcacaggccgaactcgtcgggcacccacagtcggggcgccagcacggcggcgcggcccgcggtggaatcgcgcagcggtccctcgtacggcgcgacgaccaccacccgcgcgccgcggcgcaccccggtcgcggcggcggcgacgagcgccgggtcgccggggtcgtcgccggcgacgaccagcacgtcgagcgggcccacccacggcggcgcctcgccggccagcgcgaacggctgcgaggccactcccccgagcgtcgccgacagcatcaccccggcggtctcggcggttccgcggccggccacccagatcacgctgcgcggccggtcctcgacccgcagcggctccagcgcgccctcctcgaccgcggtggcgatggcccgcacctgcgcgccggccgacgacgcggcccgcagcaggccgtcgcggtcggcgctcagcaggccctcggtgtcctccagatcgattgcgcgggtggcgttcacggcgccgcccccgcgtccgcctcggtcgtcgttcccgcggtgatcgcggcgatctcggcgctgatctgggcgaccaccgcggcgacgtcctctgccgtgcggccctccacgttgagccgcagcagcggttcggtgttggagctgcgcaggttgaaccagctgccgtcgcccaggtccacggtcaccccgtccacgtggtccagggagtggatccgggtgccgaacgacctcagcaccgcttcggtgcactgcccggcgtcggcgacggtgaagttgatctcgccggacgactcgtagcgctggtagtccgcggtcagctcggacagcgggcggtcctgttcgccgagggcggccagcacgtacagcgcggccagcatccccgagtcggcgccccagaagtcgcggaagtagtagtgcgccgagtgctcgccgccgaagatcgcgccggtgtcggccatcagcgccttgatgtaggagtgccccacccgcgagcgcagcggtgtgccgccgcgctcgctgaccagctcgggcaccgcgcgcgaggtgatcacgttgtggatgatcgtcgcgccgatctcgcggccgagttcgcgggcggccaccaggctggtcacggtcgacggcgacaccgggttgccgcgctcgtcgaccacgaagcagcgatcggcgtcgccgtcgaaggccaggccgatgtcggcgccggtctcgcgcacgtaggcctgcaggtcgaccaggttggccgggtccagcgggttggcctcgtggtgcgggaaggagccgtcgagctcgaagtacaagggcgccaacgtgatcgactcgatcgggccgagcaccgcgggtgtggtgaggccggccatgccgttgccggcgtcgacggcgacccgcagcgggcgcagcccggaggtgtctaccagcgagcgcaggaaccgcccgtagtcggccagcacgtcgcggtcgccgaccgatcccggtggcccgtcgtagtcctcgacgccggcgatcacgtcgtcggcgatggtgcgcaacccgctgtcggcgccgaccggccgggcgccggcgcggcacagcttgatcccgttgtaggccgccgggttgtggctcgcggtgaacatcgcgccggggcagtccagcaggccggaggcgaagtagagctgatcggtggacgccagcccgatgcgcaccacgtccagaccctgcccggtcaccccggcggcgaacgcggcggccagggtgggtgagctgtcgcgcatgtcgtggccgatgacgacctggccggcgccctcggcgcgcatcactttggcgaaggccgcgccgaggtcggcgaccagcggctggtcgagctcttcgccgaccagcccacgcacgtcgtacgccttgacgacacggtggacagtcgcggcgggccgggacatgcgggactcctgacgacgtgaactcttggccgccagcctatcgggccggggagaacaccggccgccgcggtgcgcgcggattcgggtgcgcccccatcgggtgcggcccgggtcagtcgctggggtcgggcagcacccgcagatgcccgcggcgccgtccggaacgttgctcgggcggggcgatcaggctgctgctcggcgcggtggcctgggcgccgccggggtgaagatgcggatcgccgaagccgtttcggggcaccgccgcaccggcgtagggcagcgtgcgctcggccgaaccgccttcgcggaccgcgtcggcgagggcgaccaggtcgtcctcgtcggggtgggtgggcagcggcccggcgtggcgcaccaggtcccatccgcgcggggcggtgatccggccggcgtggttgacgcacaaatcccaggaatgcggttcccgtgcggtcgccagcgggccgacgactgccgtcgagtccgagtagacgaacgtcagggtcgccacggcgtagtgcgggcacccgggccggcaacagcgacggggaacgttcacgctcgaaaggctatcgtgcgcaaacgccgccgaagcgccggacacgcgcaacgccgcggcccccgatgtgcaaccgttaccatcggcccgatgagtgaatcccgtggcgattcgcgcagctccggccgaagcggccggttttcgcgacgatcggctccgcgccggctctcgcgcaggggccgcgacatgcgcggcccgctgctgccgcccaccgtaccgggatggcgcagccgcgccgaacgcttcgacatggcggtgctggaggcctacgaacccatcgagcgggactggcaggaccggctggccgacctggacgtggcggtcgacgagatcccgcgcatctcggccaaggatcccgacagcgtgcagtggccgccggaggtgatcgccgacggcccgattccgctggcccggttgatccccgccggtgtcgacatccgcggcaacgccacgcgagcgcgaattgtgttgttccgcaagccaattgagcgacgggccaaggacaccgtggaactcggggaattactgcacgaaatcctggtggcccaggtcgccatctacctcgacgtggaaccctcggtcatcgacccgacgatcgacgacgactgacccccggtcgttgcgggagcgggtcagatgatgccgcgcttgaggcggcggcgttcgcgttcggacagaccgccccagatgccgaagcgctcgtcgtgctcgagtgcgtactccaggcattcgtggcgcacctcgcagcccaggcagatcttcttggcctcgcgggtggagccgcccttctccgggaagaaggcctccgggtcggtttgcgcgcacagcgcccggtcctgccactggtcggcgacgggcgccggcagcggctcgggctcgaatgcgactggcgcatcaggaaccacggtcaagtgcggccggacgggacgggccggcgccgagtcgatcggggtgtgcggcgtgcccgccatggcgcctcgaagattttcgtaagacatacggtcgtccgcctcctcagcttgattggagtgtgattggttcccactgttctgatgtacagacaattcgaacaagtgatcgaatctcggtctgcgacaccggagtcggccggccaaccgggaaatgacactgatgtgattagacacgggttgacctgccgggtcaagcactttggcgcatttccataccatctcgtgatcgaatttcggcgtttctgttgttttgcgccttcggcgtgtcgatcacaccgttcacaatttcccaccagcttcccgacaagcggtgtgcaacctcaactttgaggcgcccgcgacgggcccgacaccgcagcgtcgccgggcagtactgtcgtgctctgtgaggctcaagtgaaggtcaccgttctggtcggtggggttggcggcgcccgcttcctgctgggtgttcaacagttgttcgggctgggtcagtttcgtgcgcaacggcatacgcacgggcgcccggacacggcggcgggcagccacgagctgacggcgatcgtcaacattggcgatgacgcctggatccacggactgcgcgtctgccccgatttggacacctgcatgtacaccttaggtggaggtgtggacccggagcgagggtgggggcaccgcgacgaaacctggcacgccaaagaggaattggcgcgctacggggtgcagccggactggttcggtctgggcgaccgcgacatcggcacccacctggtgcgcacccagatgctcaacgccggctacccgctgacacagatcaccgccgcgctgtgcgaccgctggcaacccggcgcgcggctgctgccggtcagcgacgaccggtgcgagacacacgtggtgataaccgatcccgacgacggcagccggcgggccatccacttccaggagtggtgggtgcgctaccgcgcccaggtgcccacccacagcttcgcgttcgtcggcgccgaaaaggcagccgcgacaacggaaaccatcgccgccatcgccgacgccgacgtcatcctgatcgccccgtccaacccggtggtgagcgtcggggccatcctggccgtacccggcgtccgcggcgcgttgcgggcggccggcgcgccgatcgtcggctactccccgatcatcggcggaaagccgttgcgcggcatggccgatgcctgcctgtcggtgatcggggtggaatccaccgccgaggccgtcggccgccactacggcgcgcggcggggcaccgggatcctggattgctggctggtgagccaggacgaccacgccgacatcgagggggtggcggtgcgcgcggtgccgctgatgatgaccgaccccgcggcgaccgccgagatggtcagcgcggggctgcagctggcgggcgtgacgccgtgagtcccgccggcgagcacggcaccgccgccccgatcgagatcctgccggtggccgggctgcccgaattccgccccggcgacgatctgggggcggccgtcgccaaggccgcgccgtggctgcgcgacggcgacgtcgtcgtcgtcaccagcaaggccgtctccaagtgcgagggccggctggtgccggcgccggccgatcccgaggaacgcgatcggctgcggcgcaagctggtcgacgaggaagccgtccgggtgctggcccgcaagggccgcaccctgattaccgagaaccggcacgggctggtgcaggccgccgccggggtagacggatccaacgtcggccgcgacgagctggcgctgctgccgctggaccccgacgccagcgccgcggcgctgcgcgcgcggctgcgcgagctactgggcgtcgaggtcgccgtgctggtcaccgacaccatgggccgcgcctggcgcaacggccagaccgacgccgcggtgggggcggcgggactggctgtgctgcacggctattcgggtgcggtggatcagcacggcaacgagctgctggtcaccgaggtggcgatcgccgacgagatcgccgcggccgccgatctggtgaagggcaaactgaccgcgatgccggtggcggtggtgcgcgggctgtcggtgaccgacgacgggtcgaccgcccggcagttgttgcggccgggcaccgaggacctgttctggctgggcaccgccgaggccatcgagttgggccgccgccaggcgcagctgctgcgccgttcggtgcgccggttcagcgccgagccggtgcccgcggagctggtgcgcgaggccgtcgccgaggccctgaccgcgccggccccgcaccacacccgcccggtgcggttcgtctggctgcagaccccggcggtgcggacccggctgctggacgcgatgaaggacaagtggcgcgccgacctggccggcgacggccggcccgccgagtcgatcgaacgccgggtggcgcgcggccagatcctctacgacgcgcccgaagtcgtcatcccgatgctggtccccgacggcgcgcacagctatcccgacgccgcccgcaccgacgccgagcacaccatgttcaccgtggcggtcggcgcggccgtgcaggccctgctggtcgggttggcggtgcgcggcctgggcagctgctggatcggctccacgatcttcgccgccgacctggtgcgcaccgagctcgggttgcccgccgactgggagccgttgggggccatcgccatcggctatgccgccgaacccgccgggccgcggggtccggcggaccctggggatctgctgatccgcaagtgatactgagcgcgtgacgacgttcgcgggcaaggcggcggcctcggccgacaaggtccgcggcggctactacacgccggcgccggtggcgcggttcctggcccactgggtgcgccgggccgggccgaggatcgtcgaaccctcctgcggcgacggcgcgatcctgcgcgagctggcccggctcagcgaccgggtgcacggcgtcgagctgatcccgcacgaggcggccaaggcccggcggttcgcaccggtgtccgccgagagcctgttcagctggctcgccaccgccgaggacggcggctgggacggcgtcgccggcaatccgccctacatccggttcggcaattgggcgtcgccgcaacgcgatccggcgctggcgttgctgcggcgcgagggtttacggccgacccggctgaccaacgcctgggtgccgttcgtggtggccggcaccgtgctggtgcgcgacggcggccgggtggggctggtgcttccggccgagctgctgcaggtcggctacgccgcgcagctgcgcgagttcctgctgagccgattccgcgacatcacgctgctgaccttcgagcggctggtgttcgacggcgtcctgcaggaggtggtgttgttctgcggcgtggtcgggacgggtccggcgcgcatccgcaccgtgaccctggccggcgcggacgccctggcggacatcgacgtcgagcgcctggcgtccgcacccgcgctgctgcacgagcacgagaagtggaccaagtactttctggacccggccgcgatcgagctgctgcgcgcgctcaaggcctcggcgacgctgacccggctgggcgcgctcgccgaggtggacgtgggcatcgtgaccggccgcaacgcctttttcaccttcaccgacgagcaggtgaccgcgttggggctgcgccggcactgcgtgcccctcgtctcgcgcagcgcccagctgtccgggctgatctacgacaccgattgccgggcaagcgatctcgccgcccggcagcgcggctggctgctcaacgcgccgcgcgagccggccgatcccgcgttgaccgcgcacatccgcgccggggaggcggccggggtgcaccgcggctacaagtgctcgatccgcacgccgtggtggagcacgccgtcgctgtggcagcccgacctgttcctgctgcgccagatccacgccgcgccccggctgacggtcaacgccgcggggcccaccagcaccgacaccgtgcaccgggtgcgggttgggccgggcgtcgacccggcggcgctggccgcggtgttccacaacagcgtcacgttcgcgttcgccgagatcatgggccgcagctacggcgggggcgtgctggagctggagccgcgcgaggccgagcagctgccgctcccccggccggagtgcgcggacgccgatctggtcggcgatgtcgacctgttgctgaaggccggcgagctggacaaggcgctggacgtcgtggaccgccgggtgctgatcgacgcgctgggcgtcccgccccgggcggtggcggactgccgcgcggcctgggcgtgtctgcgggatcgccggaaacggcgggcatcccggtgagcgtgcgcgactcggtgctggcgctgctgacgcagtgggatccgcccgatgcggcccaggattcgttgcggcacgcggtgttggcgttcgtgcacgcccgccccgacgcgtgccggcgggagtgcgagcccgggcatgtcaccgcgtcgacgctggtgctcgatcacaccggcgaccgggtgctgctgaccctgcaccgccggctgggccggtgggtgcagctgggcgggcactgcgacgacgacgccggcatcgtcgcggcggcattgcgcgaggccaccgaggagtccgggatcgacgggctgcggatggcgcccgggttggccgcggtgcacgtgcatccggtgacctgctcgctggggctgcccacccggcatctggatctgcaattcgtcgcgcacgcgccggccggcgcccggatcgcgatcagcgacgagtccgaggacctgcgctggtggcccgtcgacgggctacccgcgggcaccgatcacgcgctggcctatctggtcgcccaggccacgcgagcgtcacgctagcgtggccgccggcgccgggcgtcacgctggcgtgacgcccggcgaaagcgaacgcgagagcgaacgcgaaagcgaacgcgagcctcagacgtcggaggagtagcgaatcccgccgtcggggatcgacacgccgggccacacccgggcgccgcgcagcagctcgcagcgcgccccgatgtcggcgccgtcgccgatcaccccgtcgcggatcagcgcccgcgggccgatgcgcgcgccgaacccgacgatcgagcgctcgatcacgctgccggcctccaccttgacgccgtcgaagatcaccgcgccgtccagccggacgccggggccgatctcggcgccccggccgacgacggtgccgccgatcagcacggcgcccggcgacaccgccgcgccgtcgtgcaccagctgctcgccgcggtggccgtgcagggccggcgacggcgcgatgccgcgcaccagatccgccgagccgcgcacgaagtcctcgggggtgcccatgtcgcgccaataggtggcgtcgacgtagccgcacaccttgacatcgggatcggacagcagcgcggggaacacctcgcgctccaccgacacctcgcggccgcgcgggatccggtcgatgacgcggcgggcgaagacgtagcagccggcgttgatctggtcggtcggcgggtcctgggtcttctccaggaacgcggtgacccggccgtcctcggtggtcacgcagccgaacgcgcgcggatcgctcacccggaccaggtgcagggtgacgtcggcctgctgcgcggcgtggaagtcgagcatctggcccaggtcggcaccggagagcacgtcgccgttgaacaccatcacggtgtcgtgccgcagctggccggcgacgttggcgatgccgccgccggtgcccagcggccgctcctcggtcacgtactcgatctgcagacccagcttggagccgtcgccgaattccgcctcgaacaccgcggcctgatacgacgtgctcaggatgacgtgctcgatgccggccgcggcgatccgggacagcagatgggtgaggaacggcagcccggcggtgggcagcatcggcttgggcgccgacagggtcagcggccgcagccgggtgcccttgccgcccaccaggatcaccacgtcgacttcgggagttcccacctcagtgccgcccttctacccgccgcccggactcgcgcagcgcgctgcgcaccatcagccgggcgcgcaccgccagcgacgcgcgcagcgcccagcgcagcggcgcgcgcatccaaccggaataccggtcggccagaaacatataggtgctgcggtggtgggcggccaggtggctggccgggtcggccccggtggagtggcccttgtggtgcagcacctcggccgacggcacgtagaccgacagccagccggccttgcccagccggtcgccgaggtcgacgtcctccatgtacatgaagtagcgctcgtcgaacccgccgacccgctcgaatgccgagcggcgcaccagcaggcacgaacccgacagccagcccaccggccgctcgctgggctccagccgctcctggcggtaggccgtcgaccacgggttgttcttccagaacggcccgacgaccgcgtgcatgccgccgcgcaccaggctgggcaggtgccgcgccgacgggtacaccgacccgtcggggtcgcgcaccagcgggcccagcgcgccggcccgcggccagcgcgccgcggcgtccagcagcgcgtcgatgctgccgggcccccactgcacgtccgggttggcgacgatcacccactcgccgccgcgatccagctgtgccacagcacgattcaccgcggtgccgtagccgaggttggcgccggtgtgaaacagccgcacgttggggtagcgctcgacggcggcctgcggcgtcccgtcggtggagccgttgtcggccagcagcacgcacacctcgcgttcggtggccagcgacagcgacgccaggaagcgctccaggtgcgggcccggtgaataggtcaccgtcaccaccggcagcacgtcagtcacgcgtagagggtaacggtcgatccgccgcggccgggctaccagcgttggtgagcgcggcgacaagcgcagggcgccagggccttagcgggcgcagcccggccgcggcggactcgcggctgcccagcgccgagtaggtcggccgcggcgccggccggggaaagtgctcggtgcccaccggccgcacccgcgccgggtcggcgccgcattcctcgaagaccgcgcgggcctgctcgaagcgggacaccgcgccctcattggcggcgtgcaggaccggcccgggcacccggtcgtcgacgatctgcagcaacgcggccgccaggtcgccgacgtaggtcggcgacccgatctggtcgtcgaccacctgcaccgggccctcccccgcggccagccggcgcatgacggcgacgaagtccttgccggtgccgccggtgtagacccaggcggtgcgcaccacgacgccctgcgcgggatccggcagcgccgccagcactgcccgctcccccgcgaccttgctgcgggcgtacacgccctgcggggcgacggggtcgccgggctcgtaggggcgcggccggtccggggcaccggccggggactcgccgccgaacacgtagtcggtggagacgtggagcagccgggcgccggcgcgcgcgcaggcccgcgcgatatgcccggggccggcctcgttgaccgcgaaggcgcccgcctcgtcgctctcggcgccgtcgacgtcggtgtaggccgcgcagttgatcaccacgtcgccgggccgcacgatgtgttcggccgccgccgggtcggtgatgtcccactgcgcggacgtcagcgccaccacgtcacggccctgaccagccgccagcgcgctcaaatagccgcccagctgcccaccggcgccggcgatcacgatcctgcctgacatggttcgagtttggcatgaggcctcgggccgccgggacggccggggcacgcgggcgccggctacccgtgaagccagtgtgtcgcaagtaatgtagtgggatgcctgtgcaacgtgtggttcgtgtgattgcaaccgcgctgacgctcgcggtcgtgctcggcaccgggatcgcgtggagcaacgtccggtccttcgaagacggcatctttcacatgtcggcgccgtcgctgggcaagggcggcgacgacggcgcgatcgacatcctgctggtgggcctggacagccggaccgacgcgcacggcaacccgctgtcgcagcaggagctggagacgctgcgggccggcgacgaggaggccaccaacaccgacaccatcatcctgatccgcatccccaacaacgggaagtcggcgaccgcgatctcgatcccgcgcgactcctacgtcgccgccccggggctgggcaagaccaagatcaacggtgtctacggtcagacccgggaggccaagcgcgccagcctggtcaaggccggcgactcggccgaagacgccgcggcccagggcaccgaggccggtcgtgaggcgctgatcaagaccgtcgccgacctcaccggcgtcaccgtcgaccactacgccgagatcggcctgcttggtttcgcgctgatcaccgacgcgctcggcggcgtcgacgtgtgcctcaaagagccggtgttcgaaccgctttcgggtgccgacttcccggccggcccgcagcggctcagcggcccggaggcgctgagcttcgtgcgccagcgccacgaactgccgcgcggcgacctggaccgggtggtgcgccagcaggtggtgatggcctcgctggcgcaccgggtcatctccgggcagacgctgtccagccccgccacggtcaagcggctggaggccgcggttcagcgctcggtggtgatctccgcgggctgggacgtgatggacttcgtgcagcagatgcagaagctggccggcggcaacgtcgcgttcgccaccatcccggtgctggacggcgccggctggagcgacgacggcatgcagagcgtggtgcgggtggacccgcaccaggtcgccgactgggtgggcagcctgctgcacgaccaggagcagggcaagaccgaggagatcgcctacaccccggccaagaccaccgccagcgtcgtcaacgacaccgacatcaacggtctggccgcggccgtctcggatgtgttgagcgccaagggctttgccaccggcacggtgggcaacaacgacggggggcacgtcaagaccagccaggtgcgcgccgccaagagcgacgacctgggcgccaaagaggtgtccaaggaactgggcgggttgccggtggtggccgacagctcgctggcgccgggcgcggtgcgggtggtgctggccaacgactacagcggtcccggctcgggcctgtcgggcaccgaatcgatcatgcccgccaaggtgtccaccgccggcgcggtgagcaccaacgacaaggcgcccgcgccgtcgccgatcctgaccgccggctccgacaagccggagtgcataaactagcgccggtgcgccaatcgagcacgctgtccgcggcgatcctggatcccatgctgcgggccgacccggtcggtccgcgcatcacctactacgacgacgcgaccggcgagcgcatcgagctctccggtgtgacgctggccaactgggccgccaagaccggcaacctgctgcgcgacgaactcggcgccgggccggccagccgggtcgcgattctgttgcccgcgcactggcagacggcggcggtgctgttcggggtgtggtggatcggcgccgaggcggtgctcgccggcccggccgatctggccctgtgcacgccgccgcggctggacgaggccgacgccaccggcgccggcgaggtggcggtgctgtcgctggatccgttcggccgcccggtgagcgacctgccgatcggggtgaccgactacgccaccgcggtgcgggtgcacggcgaccagatagtgcccgagccgcgaccgggcccggcgctggacggccgctcggtcgaccaggtgctgcagcagtgccgaagttccgcggcggcacggggtttgacggcggccgaccgggtgctttccagcgcgtcgtggccggatcccgacgcgctggtggacgggctgctggcgatcctggccgtcggcggctcgctggttcaggtggccaatgccgacccggcggtgcagcagcgccggatcgaatccgagaaggtcacccgggtgctgtgagcacccgccttcgggcggcccgatacatattgatatcgctatatttcaatgttaacgtcgtgcgagcatgggctgaacgcgcacacgacaggaaggttgcggcaatggcggtctacgggctgttggcgaaggcggcagggacggtggtcaccgggttggtcggcgtgacggcctacgaggtggtgcgcaaggccgtggccaaggcgcccctgcacgagacggccgtcaagggggccgaactcggactgcgcggcacccgcaaggccgaggaggccgccgagtcggcgcggctcaagctggccgacgtgatggccgaggcccgcgagcgcatcggcgaggagacgcccacgccctcgatcgccgacacccacgaccacgagcactgaccgcgcgtgatgaatctcgcgtcggtccgcgccatcggcgacgagggcctgacgaaagaccctgcgctgcaagtcatgtcggatgcggccggacggatgcgggtgtcggtcgggtgggtgcgcgccgactcgcggcgcgccgtggcggtcgaagaggcggtggccaagtgcgacggcgtgcgggtggtgcacgcctacccgcgcaccggctcggtggtcatctggtattcaccgcggcgctgcgaccggtccgcggtgctggccgccatcggcgaggccgcccacgtcaccgccgagctgatcccggcccgcgcgccgcactcctcggagatccgcaacgccgacgtgctgcgcatggtgatcggcggcgcggcgctggccctgctcggcgtgcgccgctacgtgttcgcccgcccgccgctgctgggccccagcggccggctgttcgccaccggcgtcaccgtgttcaccggctaccccttcctgcgcggcgcgctgcgctcgctgcgctccgggcgggccggcaccgacgcgctggtctcggcggcgaccgtggccagcctggtgttgcgcgagaacgtggtcgcgctgaccgtgctgtggctgctcaacatcggcgagtacctgcaggacctgacgctgcgccggacccggcgcgccatctccgagctgctgcgcggcagccaggacacggcgtggattcgcctggagcacaacgagattcaggtggccaccgacaccctgcagatcggtgacgaggtggtggtgcacgaccacgtcgccatcccggtggacggcgaggtgatcgacggcgaggcgatcgtcgaccagtccgcgatcaccggggagaacctgccggtcagcgtggtggtcggaatgccggtgcacgccggctcggtggtggtgcgcggccgcctggtggtgcgcgcccgcgccgtcggcaaccagaccaccatcgggcgcatcatcacccgggtcgaagaggcgcagcacgaccgggcgccgatccagaccgtcggcgaaaacttctcgcgccgtttcgttcccacctcgttcatcgtgtcggccatcaccctggcggtcaccggcgacgtccgccgggccatgacgatgctgctgatcgcctgcccgtgcgcggtcgggctggccaccccgacggcgatcagcgcggcgatcggcaacggcgcccggcgcggcatcctgatcaagggcggctcgcacctcgagcaggccggccaggtcgacgcgatcgtcttcgacaagaccggcacgctcaccgtcggccggccggtggtcaccaatatcgttgccatgcacaaggattgggagcccgagcaggtgctggcgtatgccgccagctccgagatccactcccggcacccgctggccgaggcggtgatccgctccaccgaggaacgccacatcaccatcccgccgcacgaggagtgcgaggtgctggtcgggctgggcatgcgcacctgggccgacggccggaccctgctgctgggcagcccgtcgctgctgcaggccgagaaggtcaaggtgtccaagaaggccaaggagtgggtggacaagctgcgccgccaggccgagaccccgctgctgctcgccgtcgacggcaccctggtcgggctgatcagcctgcgcgacgaggtccgtcccgaggccgccggtgtgttgaagaagttgcgcgccaacggtattcggcggatcgtgatgctcaccggcgatcatcccgacatcgccgcggtggtggccgacgagctcggcatcgacgagtggcgcgccgaggtgatgccggaggacaagctcgccgcggtgcgcgatctgcaggaggagggcttcgtcgtcggcatggtgggcgacggcatcaacgacgcgccggcgctggccgccgccgacatcggcatcgcgatgggcctggccggcaccgacgtcgccgtggagaccgccgacgtggcgctgtccaacgacgacctgcaccggctgctcgacgtgcgggacctgggctcgcgcgccgtcgacgtcatccgggagaactacggcatgtccatcgccgtcaacgccgcggggctgatcatcggcgccggcggcgcgctgtccccggtgctggccgccatcctgcacaacgcgtcgtcggtggcggtggtggccaacagctcccggctgatccgctaccggctgaactgacagccgcactccccgccccgccaggcccgcacgccctgccacacggcgccgccagtccgccccgtgcgcggcagccagggcggggggccgggcggcgggatgcgcccggccgccggtagttattgtggctaacggtagagcggaaggggcttcctcgatggcgcgcaccgacgacgacacctgggacctggccaccagcgtgggcgcgaccgccaccatggtggccgccggacgggcccgggccacccgggacggcctgatcgacgacccgttcgccgagccgctggtgcgcgccgtgggcgtcgacttcttcacccggtgggccgccggcgaactggacgccgccgacgtcgacgtgcccggggcggcgtggggcatgcagcgcatgaccgacatgctcactgcccgcacccgctacatcgacgcgttcttcgccgaggcgggcgccgcgggaatccgacaggtggtgatcctggcctccggcctggatgcccgcgcctaccggctgccctggccggcgggcaccacggtgttcgagatcgaccagccgcgggtgctcgagttcaaggccgccaccatcgcccagctcggcgccgagcccaccgcgccggtgcgcgccgtcgcggtcgacctgcgccacgactggccgtcggcgctgcggcaggcgggcttcgacgtcgggcgccccgccgcctgggccgccgaggggctcctcggcttcctgccgccgcaggcccaggatcggttgctggacaacgtcaccgcgctgtccgccgacggcagccagttggtggccgaggtcttcgccaacaccggcgccagcggggacgccttgaatgcggccggcgaaaagtggcggcggcacggcctggacgtcgccctggacgacctgggcttccccggcgagcgcaacgacccggccagttacctgcagcagctgggctggcagccggtgcgcacaccgctgaaccagatgctggccaacaacgggctgccgctgcagtcgaccgagcccggcgcgccgttcgcccagaattactactgcaccgcggtgctgaacaaggcaggttaggaacccaacgcatgccacacgagacgccgaacggcaagccccccaagccccttgacggattccgggtgctcgacttcacccagaacatcgccgggccgatggccggtcaggtgctggccgacctgggcgccgaggtcatcaagatcgaggcgccgatcggcgaggcggcccggcacatcaccgccgtgctgcccggccgtccgccgttggccaccctgttcctgccgcacaaccggggcaagaagtcggtgctggccgacctgcgcgacgacgaggccaagcagcggatcctgcgactggtcgacaccgccgacgttgtgctggaagggtttcggcccggggtgatggaacgcatgggcctgggccccgaggagctgcagggccgcaaccccagactcgtctacgcccggctgtccgcctacggcggcaacggcccggagggcagccggccgggggtggacctgatggtggccgccgagtcgggcatgaccaccgggatgcccacccctaccggcaaaccccagatcatcccgttccagctggtcgacgccgccagcgggcacgtgctggcccaggcggtgctggccgcgctgctcaaccgggagcggcacggggtggccgacgtggtgcgggtcgcgatgtacgacgtggcggtcagcctgcaggccagccagctgaccatccacctcaacaagccgaacgccgaccacaagccgagcgattcggcgtcaaaacccaagcggcgcaagggtgttggtttcgccacccagccgtcggacgcgttcaaggccgccgacggctatttggtgatcagcgcgtacgtgcccaagcactgggacaagctgtgcgaggtcatcggccggcccgacctgcgcgacgacgaacggttcgccgaccagcgctcccgcgcgctgaactaccccgagctgaccgaggagctggagaaggcgctggccgccaagaccgccgacgaatgggtccggctgctgcaggacgccgggctgatggcctgccacgcctacacctggaagcaggtggtgggcaccccgctgttcgccgagaacgagctcgccctacaggtcggcgagggcgccgatgccgtcacggtaatccgcactccggcaaggtattccagcttcgaggccgcgtcggccggctgggccaccgaccctccccccgcgctgggtcagcacaccgaggagtacctgggcgcaccgcagaccgcgtcgtgagcctcactgcaccagcttgaccacccggtcgtcgccgcggtcggcgacgtagacgctctggtccctgtccaccgccaccgccaacggcgtgttgagcgcggtgaacggcagcacggtgccgctggtggcgcccggcgggtacttcatgacgtcgttcttgtcgtgctcggtgacgtagacggtgccgccgttgtccaccgcgatgccccacggcaccgacaggtcgtgaaagggcaactccgactgggtgttcgacgcggcgtcgagcttcaccacccggttgttgtcggtgtcggcgacgtagacgttgcccgccgggtcgacggccaccccgtccgggttgttcagcccggtgaacggcagcaccgtctggttctgcgatcccgccgccagcttcagcacccggctgttgccgcggtcggcgacgtacacgccgccctggctgtcgacggccaccccctccgggtagttcaaaccgctgaagggcagctccttttgagagttggagccggcggccatgctgagcacccggttgttgaagtcggcgacgtagaccgtgccggcgccgtcgacggccagcccctgcggctggtagagcccgttgaacggcagtaccgtcgtggcgcccgagccggccgccagcttcaccacccggccgtacatgccctcgctggtgacgtagacgttgccggtgccgtccagcgtcacgccgcccggggagaggcggaagtcaatgccgttgaagggcaacacgctttggccgccggcctgcttcgcgggtcccgacgatgcggtggacaggtagccgacgaccgccaccacgaaggcgaccagcgcgaccagggcgacggcgccgacgatgatccactgtttgcgcttgttgtcggtcggggccgcgggacgcccgaagtccgggccgggcgcatacacgcgaccggaacccgttggggcggcgcggatcagccccgagctcggagcgcccgcccgggcgggcgacgggccgacgacggtctccgcgctcggcgacggggcgaacgagtccggccagtgcgtcgagcgctgctcggccgcgcccgcgcccagggccgcgatctggccgtcgcgcaggatcgtggcggccttgcgctgctcggacgtggtgagcgcctcgtgcgcggcggcggcgaattcgcccgcggtgcggtagcgatcctcggggcgtttggccatgcccttggcgatcacccggtccagggcgggcgggaacgcacccgggcgcagctggctcagcggcggggccgtcttcgtcaggtgcgcggcgaccagccgctcgaccgtgtcggcccgatacggcggcaccccggtcaggcactcggtcaacacgcaggccagcgaatagatgtcgacgctgttggtgacctcgtcgtcggtgaaccgctccggagccatgtagtagtacgttccgatcgccgtcccgacctgggtcagccccgggtcggacgcggcccgcgcgatgccgaagtccgccaggtaggcgaagtcgctgggggtgaccaggatgttccccggcgtgacgtcgcggtgcgtcaccccggcggcatgcgcggcgtccagcgcggcggcgacctggcggatgatggcgatcgcccggggcggggccagcggcccctcccggtgcagcagcgagcccagatcgatgccgtcgaccaggcgcatctccacgaagaaccgcccgtcgatctcgccgtagtcgtggatcggcaccacgtgcggttcggtcagccgtccggcgatgtcggcctcgcgctgcagccgcgcgctgaactcggggttcccggagaactgctgcgagatcagcttcagggccaccagccggtgcttgcgggtgtcctcggcctcgtacacctcgcccatgccgccctggcgcagcagccgcaccaggcggtacgggccgaaccacgacccgacctgcgcggccggcccgttatcgctcaccgtcgagcctccttcgctcgtccgtcacacccgtcacgttcagtcacgtcgtcaggaaatcgcattgaccgcgctcgacagcttcgccgtgaacgaacccggcagcgggatggaaccgtactggtccagaccgtcctggccgggaccgatcgcggcctgcatgaacgccttcaccgcggaccccgtcgccgcgtccggatatttcgagcagacgatttcgtaggtcgccagcacgatcgggtacgcgccctgctgggtgggccggtagaacgacgaggtgtccagcaccaggtcgttgccctgcccctgaaaggtggccccggcgatggtcttttcgacggactccttggtgatgggcaccgcgtccggccccgccgaggtgatgatcgacgccatgctcagctgcttgccgaccgcgaacgaccactcgttgtaggtgatcgacccctcggtgttctgcagcagcgccgaggtgccgttgttgccgctggccccctgcccgacgccgccggtgaacatctcgctggtgcccttgccccaggcgccgttggacgccccgtccaggtacttctgaaagttggcggtggtgccggacttgtcgctgcggaagatcaccgcgatgggcgtcgacggcaggttgaggcccggattgaccgccttgagcgccgggtcgtcccacttggtgatggcgccgttgaagatcttcgcgacggtcggcccgtccagtttgagcccgctcaccccggtgaggtggtaggtcaccgcgatcggaccgaacacggtcggcaggtcccaggcgggcgaattgcaccgcgccgccgcccggtcggtctggccggtggtgcggtccagcgggatgtccgaacccgcgaggtcggtctgattgttgaggaactgcgtgacaccggcgccggagccgttcgcgttgtagtccagcgtgtagcccgggcaggcccggacgtaggcgtagacgaattgctcgatcgcgttctgctgggcggtggacccgctgtccttgagcaccttcttaccgccgcagtccacgtgcgcgcccgaccccgacgacgacttggagtcgccgccgcaccccgtcagcgtcaacgcggcggcggccagcaggctcagtacggcgccagatcgagcgaaactcacgcaactcctcccgcccccgacggccggggccaccaaaagttaatcaatcgtgaatatacaaacccttgacaaaggctgagaggtgaataaggggtgaatgagtgccgggcgcacgcccgggaccggccggcgctcaggcgctgggcagccgcaccacctgaacgaagaactcgtcgatctgccggaccgccttcatgaactggtccaggtcgaccggtttggtgacgtaggcgttggcgtgcagcttgtagctcttcaggatgtcctcctcggccgaggaggtggtgagcaccacgaccgggatctgggccaggtcggggtcggacttgatcttctccagcagctggcggccgtcgtatttgggcaggttcaggtccagcaggatcaggtcgggccgcggcgcgtcggcgaactcaccgcgccggtacaggtagttgaggccctcctcgccgtcgtgcgccacgtgcagcctgttgttgagtttgttgtgctcgaaggcttctcgcgtgatcagctcgtctccggggtcgtcctcgacgagcaggatgtcgatggctctaccggccgttgtcattgctgcgctccttccaaagcgactgcgtccgtttcgtcgacgggtccgggcatgggcaaactgaattcgaatcgggtcccgtcggtgtaggacgtgtcgatccggacggtgccgccgtggtgctcgacgatcttcttcaccaacgccaggccgaccccggtgccggcgtacacctcccggccgtgcagccgctggaagatgacgaagaccttgtcggagaactcctccgggatgccgatgccgttgtccgacacgctcagcagccactcgccgtcgtgggtgccttcgccgggggcgcattcgatgacgacgcggggccggcgatccttgtgccggaacttgatcgcattgccgatcaggttctgccacaacatggtcagcagcatcgggtccccgacgatccgcggcagttcggcggggcgcacgatctcggcgccggtttcctcgacggcggcggccaggttggccaggccggcgtccagcgtggcatccagctgcacctcggcctcggtggtgcccagccggcccacccgggagaaggtgagcaggtcgttgatcagcgcctgcatccgtttggcgccgtcgaccgcgaacccgatgtactccaggccgcgctcgtcgagctggtcgccgtaccggcgctccagcagctggcagaacgacgccaccttgcgcagcggctcctgcaggtcgtgggaggcgacgtaggcgaactgctcgagttcggtgttggagcgccgcaattcggcggcctgctcgtccagctgctcctgggccgaccgcgacatgtcgagttcttcgaccatgcgcttgcgcatgttctccacgtcgatggccatgtcgcgaatatccttgggccgcttgggcgcaacgatcgtttcgacgaagttgccctcggtgatgcgccggcaggacgcggccagctgcgcgatcgggcgggtgatggcggcgcggctgaacaagcccaggaacagacccgtccccaaaatggccagcaccatggcacccagcacccagtcgcgccagccgttgatctcgtgcagctcggcggtcgcactcgccgccgcctgcgccagatgcatgttctgggtctcgaaaagcgctcgcagatggtcgaatttggccttgccgaggtcggcggtcggggcgctgacgacggcgggggccctgggggtgacgctggcgatgacgggttcggcgtagttggtgcgccagtccgcggcggccgactccaccgcgtccaggtcggcgatcagctcggtgttgccggcgttgccgcccaccagccggcgaatctcgtcggcggccgcctgctcggtgcgctgcccgtcgtagtagggcgccaggaactgccggtccgcggcgatcaggtagccgcgcaggccggtttcctggtcccgcagcgccgcctgcagccgggccgccgcgacccgcgccggcccgacaccgtcggccacctgccgcgacacctggtcggtgcggtgcagcagcaccgccccgaccagcaccgtcgtgcccatgatccacagcaccagggccagccatccccgcacggtcagctgcgtgagccggagcggacgcggcgcggtcacgtgatggtcctctcgacgcggagcacggcgatgtcatcggtgaggccgccgcgcggctgggccagtcgctgggcgccgtcgatcagggcgtcgacgaacgccgggccggagcgatcgacctgcgagcgggccagggcgagcaggccgtcctcgccgagccgttgggtcccctgccccgaatacccctcgtagagcccgtcggtgagcaacagcaggccgtgccccgcgggcagccgcagctggtggcgcggccagtcgtcggcgcgcagcccgagcgccggcccgcccggcggttcgacccattccacggtgccgccgccctgcagcagcatccccggatggccggcgcggatgacgctgacctcgggccgctgcggcgagatctccaggctgagcacggtcgcgaagatcccggtgccggtgcgttcggagtgcagcacccgctccagctggcgcatcagttcgacgccgtgcacgccggccagggtgagtgctcggaacgcgatccgcagcgccgcccccaagggccgcctcatgcgggccgtgcccggcgacatcgccgatcagcacgtgcaccacccgatccggtgtctggaccacgtcgtagaagtcaccgcacagcagcgcgtcctcgcggctgggccggtaccgggcgacgatgtccacgcccgggtcgtccagcagcagcggggagggcagcagcccgcgttccagcagcgcgttctcccgcgcccgcagctgggtggcgtgcaggtcggcggcgatcagctcggcgcgtttgcgctcgatcgcatacagcagtgcgcggcgcagcatctccggctccacccggcccttgaccaggtagtcctgggcgccggcggccaccgcggaggccccgaagtactcgtcgttcagcccggtcagcaccacgatcgggacggtggcgtcgagcttggcgattcggttcaacgcgtcgatcccgctggggtcgggcaggtgcagatccagcagcacgcaatcgggccgggtggattccagctcgcgttcggcgtgcgccatcgactgcgcccacaccacccggatgtcggtgaccgcgtcggtgacgagttcctccaccagcaccgcgtcgccgcggtcgtcctcgaccaacaacaccgacaacggcttcagcgactgccgctgcgcggccggcgtgaccgcggcctgcgctggtatcaattcccggccatctgtggacgggcatgggaagtcacgttctgcactgcagaccccctggccgcgatgagacccattgctgtgtggcggtgcgtggacgggtggccggtgcctgtttaccggccgtcggtctggacttcacccaccggggaaatcctatgcggtaccgctgggcttttcccaacagccacgcgcaacgctcagcgcaacagcgcccgcgacatcaccacccgctgaatctgattggtgccctcgtagatctgggtgatcttggcgtcgcgcatcatccgctcgaccgggaagtcctgcgtgtacccgtagccgccgaacagctgcaccgcgtccgtggtcacctccatcgcgacgtcggacgccaggcacttcgacgccgcggagatgaaccccaggtgcgattcgccgcgctcggcgcgggcggcggcgtggtacaccatcagccgggccgactccaccttcatcgccatgtcggcgagcatgaactgcacaccctggttgtcgctgaccggtcggccgaactgcttgcgctccttggtgtatgcgatggcggcgtccagcgcgccctgcgcgatcccgacggcctgggcaccgatggtgggccgggtgtggtccagcgtcgccagcgcggtcttgaagccggtgcccggctcgccgatgatccggtcgcccgggatgcggcagttctcgaagtacagctcggtggtcggcgagcccttgatgccgagcttcttctccttgggcccgacggtgaaaccctcgtcgtccttgtgcaccatgaacgacgagatgccgttggcgcccttgtccggatcggtcacggccatcaccgtgtaccagctcgacttgccgccgttggtgatccagcacttggcgccgttgaggatccagtcgtccccgtcggcgcgggcccgggtgcgcatcgacgccgcgtcgctgccggcctcgcgctcggagagcgcgtaggacgccatcgccgagccgtccgcgatcgacggcagcacctgcttcttcagctcgtcggagccgcgcaggatcagccccatggtgcccagcttgttgaccgcggggatcagcgacgccgaggtgtcgacgcgggcgacctcctcgatgacgatgcaggccgccaccgagtcggcgccctgcccgccgtactcctccggcacgtgcacggcgttgaaccccgccgcgttcaacgcctccagcgcctcctgcgggaaccgggagttctcgtccacgtcggcggcgtgcggagcgatctccttttccgccagcgcccggatcgcggcacgcagctcctggtgctcctcgggcagttggaacagatcgaagtcggggtttccggcccatccagccatctctaacgcctcctagtgctactgaccggtaactttaccgtgcagcctttgcagcgcctcatccttggcccgcacgctgtcggccagctgggtctggaactcgacgatgcgggcccgcagccccgggtcggaggcgccgaggatgcgcaccgccagcaggccggcgttgcgggcgccgccgatggagacggtggccaccggcacccccgcgggcatctgcacgatcgacagcagcgagtccagcccgtccagccggcccagcggcaccgggaccccgatcaccggcagcggcgtcgccgaggcgaccatgccgggcaggtgggcggcgcctccggcgccggcgatgatcacctcgatgccccgcccggcggcgtcgcgcgcgtagtcgaacatcacccccggcgtgcggtgcgccgagaccacccgcacctcggcgggcacgtcgaactcggccagcgcggccgcggcgtcggccatcaccgaccagtcgctgtcgctgcccatgatcaccgcgacgcgaggagcttcggtcacgctcattgatgccgctcctgttcgtgtgggtcccatccgtccgtccactgcccgtgggacagccagtgcgccgccagctcggcgcgccgccgcagcgcggccagcccggccgtgtcggcggcggggaagtcgccgaggaagttgatgtgaccgaccttgcggccggggcgttccgccttgccgtacaggtgcacccgggcgtcgggcatgcgcgcgaacaggtggtgcagccgctcgtcgacgctcatccgcggccgctcccgggcgcccagcacgttggccatcacggtgaccggcgccagcgcgtcggtgtcgccgagcggatagtccagcaccgcgcgcaggtgctgctcgaattggccggtccgcgacccgtccatggtccagtgcccggagttgtgcggacgcatcgccagctcgttgaccagcagcgcgccgtcggtggtttcgaacagttccacggccagcacgccgaccacgccgagctcgccggccagccgcagcgccagccgttgcgcgtcggcggccaggtcctcgcccaggccgggtgcgggcgcgatcacctgcacgcagatgccgtcgcgttgcaccgtctcgaccaccggccacgccgcgccctgcccgaacggcgaccgggccaccagcgcggacagctcccggcgcaggctcacctgttcctcggccagcaccggcacgccgtcggccaggaaggcggccgcgatctcccgggcgtgcaccgggtcgcgggccatccgcacgccgcgcccgtcgtagccgccgcggaccgccttgaccaccaccgggccgccgacccgccgggcgaaggcgtcgagctcgtcgagactgttgatctcggcgtaccgcggcaccggcacacccagggattccagccgccgccgcatcaccagcttgtcctgcgcgtgcaccagggcctgcggcggcggcgccacgttgacgccctcggcgaccagcttgtccagcagttcgcccggcacgtgctcgtggtcgaaggtcaacacgtcggcgcccgcggccagccggcgcaggtcctcgaggtcggtgtgcgagccgatcaccacgtcggacgcgaccagcgcggccgactcgtcggcggcggtggccagcacccgcagcgactggcccagcgcgatcgcggcctggtgggtcatccgggcgagctggccgccgccgaccatggcgacgacgggaacggcgcggggaacggctcggggcgccgctttcgcggaggcggcgcccggcgggcgggtactcggcacggccatcatggtgtcacggcgaacaaccgggtgctaaatgccggcggccgccgtgttgagcggggctgacacagaattgttatgtacgattttgcgtcgattttgtgtccgtccgtagactgacgtgttgtgtccttcgccgaagccacgatcgcgcgtttgcccaggcttttgcagccctatttgctacgccaccacgagctgatcaaattcgccatcgtcggcggcaccacattcgtcatcgactcggcgattttctacacgctgaagctcaccattctggagcccaaaccggtgaccgccaaggtgatcgcgggcatcgtggcggtcatcgcgtcctacgtgctgaaccgggaatggagcttccgcaatcgcggcggccgcgagcgtcaccacgaggcgctgctgttcttcgcgttcagcggggtcggggtgctgctgtccatggcgccgctgtggttctccagctacgtgttgcagctgcgccagcccacggtgtcgctgacggtggagaacgtggccgacttcatctcggcctacatcatcggcaacctgctgcagatggcgttccggttctgggcgttccggcgctgggtattccccgaccagttcgcccgcgaccccgacaaggcgctggagtccgccctcaccgccggcggtatcgccgagatcttcgaggacgcgttcgaggacgacggcggcaacgtcacgctgttgcgggcctggcgcaaccgggccggccggctgactcagctgggcgattcctccgaacccagggtgtcgaagacctcgtgatacagcagcgcgtgcacctcgcgcagccgcggaatgtcgtggaactccaacggatcctgtgacgccgactcgatgatcagcgtgccggtgcgcagcatccgctcggtgatccggtcgcggaactccacgctgttgatccgggccagcggaatgtcgatgccggtgcgggtggccacgccgtgccggaacatcacccgccggttggtcaccacgaaatgggtggtcagccagccgaagaagggccacagcgtcagccagccgacgatcaccagccagatcccccagatcacgccgtggatgatgttcttggcgagctgctcgaagtgcgtcgagtcgaggtaacccgagccgaacgccgccaacccggtgccgaggacgagcaccagcaccggcccgatcagccgcttccagtgcgggtggcggtgcacgatgacgtgttcgccggcggccagaacgttatccgggtagcccatgcccgccgaccttagccgggcccggtgccgggcgggtgcggctagcgcagatgcaccacgtcgccggcggcgacgacgacggtttgcccgccgctgtccagacacagccggccctggtcgtcgatgccgctggcggtgccctcgacgtgtttgccgccgggcaagtcggcgcgcacccgggtgccgatggtcaggctgcgggcccggtagtcggcggccagcgcccagtccgccccgcgcgcggcctgccagctgacgatgcgccggccgagctcgcgcaacagcccggacaccagcgcggtgcggtcgggcgcggccaccccgaggtcgagcagcgaggtggcgccggggccgtcgatctcgtcggcggactgagtcacgttgagccccaagccgataaccaccaccggcttggacacctcggcgaggattccggccagcttgcccggcgtgccggccggcccggccagcacgtcgttgggccacttcagcccgaccgccacccccgccggctgcagcaacggggccaccgtgtcgaccacggccaccccggtggccagcggcagccagccccacccggcggccgggacgtcgacgacgctgaccccgaccgacatggtgacctgggcgcgcggcgtggccgaccagccccggccgtgccgcccccgcccggcggtctggtgctcggcgatcagcaccgccccggcgacgtcgtcgcccgccgccgcgcgcgccagcaggtcggcgttggtggagccggtctgctcgacgacgtcgagccggcgccagcccagcccggtgccgatcagttcggcgcgcagcgcggcggcgtccaacggggctcgaagccggtctcggtcggtcaccggacccagcctagaactcacggccggcggtcgcgcatgtccagcacggccagatggctgaacagcatgctggttccgatcgggttgccgccgccgggataggtggtgccgctgggggcggccatggtgttgcccgccgcgtacagcccggggatgggccggccggcggtgtccagcacgcgggccgcggtgtcggtgcgcagaccgcccttggtgcccagatcggagacgccgaacgcggcggcatgatacggcggtgtgtcgatgggcaccagcggggaggcgcccgccgagaaggcccggtcgaacgcctcgtcgccccggccgaagtcctcgtcgacgccggcggcggcaaacccgttgaaccgcaacaccgttgccgtcagccgctgcgcgggaacgccgatcttggcggccagctcgggcaggttgtccgcggtgtgccacaagccggcggcgacgtatttctcggtctcgacgagggagacgttggtcgccttcaccggcggcaccgcaccctccttgtcgtcgtagatcatccagtacggcagcctgagcgacccgtcccgcagttgggccaggatctgccggccggcccggtcgtaggccatggactcgttgacgaaccggtcgccggactggttgacaaagatgccgccggtgaaccacagcgcgaacgccgagcggccgtcgggatgggtcaggcccggcgaccaccacgcctggtccagcaggtcggtgtcggcgccgacggcgatgcccgcctgcagcgccaggccgcgacttcccgggccgcccatggtgtctcgcgcctgccccggcaccccgtaggcgcggcgcaagtccgggttggcctcgaagcccccggcggccagcagcaccccgcgccgggcgcggacggcgcggcgctcaccgccggtctcgaccaccgcgccgaccacccggccgtcgctgcgcacgagctcaaccagtgcggtgtcgcgtcgcagcgtggccgtcgggaactcgccgatggcccgcaggaatcgcgcaatcagggcgcggcccccgaggtagtagtcggacggcggttcggcgccgagccggtcggtgtccaagggcccgcggatcagcgtccggaattcgggggcggcggccaccggcagcggcttggcggcgatgtggcgttggccgtccagccgcgccttgggcgccttgccgtagtagtcgggccagggcaacggcacgaacgccaggtgcgggtcggcctccaggtattcgatcagcggggccccgccgcgcacataggtttcctgcagctcgcgcggggtgcggtcgccgaccacggcgtggtagtaggtgagcgcgtcctcgatggtgtcgtcggtgcccgcgcggatcagcaccggattgcacgggaaccagacgccgccgccgcccgaataggcggtcgtgccaccgaattcgacgtcgcctcgacgagcagcacctcgaggccctcgcgcgccgcggtgtaggcgccggtgacgccgccggcaccggatcccgccaccagcacgtcgcactccgcggtccactgcaccgtgcccatagtcagcgcagcctatccgcgccgctaagctcgtctcccatgacgagcgttaccgaccacaccgccgaacccgccgcggaacactccatcgacatccacaccaccgcgggcaagctggccgagctgcacaagcgccgcgaggagtcgctgcacccggtgggtgaagaggccgtcgagaaggtgcacgccaagggcaagctgaccgcccgcgagcggatcctggccctgctcgacgaggactcgttcgtggagctggacgcgctggcccggcaccgcagcaagaacttcggcctggagaacaaccgcccgctcggcgacggcgtgatcaccggctacggcaccatcgacggccgcgacgtgtgcatcttcagccaggacgccaccgtgttcggcggcagtctgggcgaggtgtacggcgagaagatcgtcaaggtgcaggagctggccatcaagacgggccgcccactgatcggcatcaacgacggcgccggcgcccgcatccaggagggcgtcgtctcgctgggcctctacagccgcatcttccgcaacaacatcctggcctcgggcgtcatcccgcagatctcgctgatcatgggcgcggccgccggcgggcacgtctactcccccgccctgaccgacttcgtcgtcatggtcgaccagaccagccagatgttcatcaccgggcccgacgtcatcaagaccgtcaccggtgaggacgtcaccatggaggagctgggcggcgcacacacccacatggccaagtcgggcaccctgcactacgtggcctcgggcgagcaggacgccttcgactgggtccgcgacctgctcagctacctgccgcccaacaacgccaccgacccgccccgctacgccgagccgcacccggcgggggccatcgaggacaacctcaccgacgaggacctcgagctggacacgctgatcccggactcgcccaaccagccctacgacatgcacgaggtgatcacccggatcctcgacgacgacgagttcctggaaatccagggcggttacgcgcagaacatcgtcgtcgggttcggccgcatcgacggccggccggtcgggatcgtggccaaccagcccacccagttcgccggctgcctggacatcaacgcctcggagaaggcggcgcggttcgtgcggacctgcgactgcttcaacatcccgatcatcatgctggtcgacgtcccgggctttctgccgggcaccggccaggagtacaacggcatcatccggcgcggcgccaagctgctgtacgcctacggcgaggccaccgtccccaagatcaccgtgatcacccgcaaggcctacggcggcgcctactgcgtgatgggctccaaggacatgggctgcgacgtcaacatcgcctggccgtcggcgcagatcgcggtgatgggcgcctcgggtgcggtcgggttcgtctaccgcaagcagctggccgaggccgcgaagaagggcgaggacgtcgacgcgctgcggctgcagctgcagcaggagtacgaggacaccctggtcaacccgtacgtcgccgccgagcgcggctacgtcgacgcggtgatcccgccgtcgcacacccgcggctacatcgccaccgcgctgcggctgctggaacgcaagatcgcccatctgccccccaagaagcacgggaacattccgctatgagttccgccacgagtgacgaaaacggttcggccgcaacagaagccgcgccgcacgagccgcacatccagatcctcaagggtgaacccaccgtcgaggaggtggccgcgctggtcacggtgctgggatgcgtcggcggcgcgccggagcccgagcagcccgagaagacccgctggggtcttccggtcgaccggctgcgcttcgcgatgtccaactaccagcggctgaccatgcagcagatgacgcacctgaggcgttgacccgcctggtgctggcctcggcctcggccggccggctcaaggtgctgcgccaggcgggggtggatccgctggtcgtggtgtccggggtggacgaggacgcggtgatcgccgcgctggggccggatgcgtcgccaagcgccgtggtgtgcgcgctggcgacggccaaggccgaccgggtggccggcgcacttcaggccggcgtcgccgccgattgcgttgtggtcggctgtgattcgatgctgttcatcgacggcgggctgtgcggcaaaccgggctcggccgacgccgcgctgcgccagtggcgccgcatcggcgggcggtccggcgggctgtacaccgggcactgcctgttgcggctgcgcgacggcgatatcacccaccgcgaagtcgaatcagcttgcaccacagtgcatttcgcctctcccgtcgaggcggatctgcgggcgtacgtggccggcggggagccgctggcggtggccggcggcttcaccctggacggcctgggcggctggttcgtcgacgggatcgacggcgacccgtccaacgtgatcggcgtcagcctgccgctgctgcggaccctgctgacgcgggtggggttatcggtgtccgcgctgtgggcggccgactgacgcccaacgtcgagccaactgacgcccaacgtcgagttgttgggccgaaaacccgaaattcccgacaacaagtcgacgttggcgcgccgtgccaccgacaaagtcgacgttgggccccgagcaacgagatgggtaggctcgaaaccgtgccactaccgcccgatccacacccgtccctgcaggaatacgcgcaccccgagcgcctggtgaccgccgactggctgtcggccaacctgggcgcccccggcctggtgatcgtcgagtccgacgaggacgtgctgctctacgacgtcggccacatccccggcgcggtcaagatcgactggcacaccgacctcaacgacccgcgggtgcgcgactacatcgacggcgcgcggttcgccgagctgatggaccgcaagggcatctcccgcgacgacaccgtggtgatctacggcgacaagagcaactggtgggcggcctacgcgctgtgggtgttcaccctgttcggccaccccgacgtgcggctgctcaacggcgggcgcgacctgtggctggccgaacgccgcgagaccaccctggacgtgcccaccaagacctccaccggctaccccgtcgtcacccgcaacgacgcgcccatccgcgccttcaaggacgacgtgctggccatcctgggcagccagccgctgatcgacgtccgctcccccgacgagtacaccggcaagcgcacccacatgccggagtatcccgaggagggcgtgctgcgcggcggtcacatccccaccgcccggtccatcccctgggccaaggcggtcgacgagagcgggcgtttccgcagccgcgcggaactcgaggagctctacgggttcctccggcccgacgacaagaccgtggtgtactgccgcatcggcgagcggtccagccacacctggttcgtgctgacgcatctgctgggcaagccgggggtgcgcaactacgacgggtcgtggaccgaatggggaaacaccgtgcgcaccccgatcgtggcgggcgaggagcccggtcaggcgccggcgggagtgtgacggcggcgcgatgagcatccccgcgccgctggccgaagtggtgtccgacttcgccgaagtgcagggccaggacaagctggcgctgctgctggaattcgccaacgaactccccccgctgccgccggagctcgaggaggcggccatggagccggtgcccgaatgccagacgccgctgttcatgcacgtcgatgccagcgaccggaaccgggtgcggctgcacttttccgcacccgccgaatcgccgaccacccggggcttcgccgcgatcctggccaccggtctggaccgccagcccgccgccgacatcctcgcggtgccagaggatttttatgatgacctcgggctggccgcgctgatcagcccgctgcggttgcgcggcctgtcggcgatgctcgcccggatcaagcgcaggctgcgcgagtcgcccggctaaatccggaccgcctgcatcggcccaacggtgcggcgcttagacttccggagaactcgtagtaagaaattctcttagagaagccccgcagcaatacgtctgccgatatgccaaacaggaggcgcagtggccagtcacgccagctcgaggatctccaaggtgctcgtcgccaaccgcggcgagatcgctgtccgggtgatccgcgcggcccgcgatgcgggcctgtccagcgtggcggtgtacgccgaaccggatgccgacgcgccgcacgtccggctggccgacgaggcgttcgctctgggtggtcagacgtcggccgagtcctacctggacttcggcaagctgctcgacgcggccgccaagtccggggccaacgccatccaccccggctacggcttcctgtccgagaacgccgacttcgcccaggccgtgatcgacgccgggctgatctggatcggccccagcccgcagtccatccgcgacctcggtgacaaggtcaccgcccgccacatcgccgcccgcgcgcaggcgccgctggtgcccggcacccccgacccggtcaaggacgccgacgaggtggtggccttcgccaaggagtacggcgtgccgatcgccatcaaggccgcgttcggcggcggcggcaagggcatgaaggtggcccgcaccatcgaggagatccccgagctctacgagtcggcggtgcgcgaggccgtcgcggcgttcggccgcggcgagtgcttcgtcgagcgctacctggacaagccgcgccacgtcgaggcccaggtgatcgccgaccagcacggcaacgtcgtcgtcgccggcacccgcgactgctcgctgcagcgccggttccagaagctggtcgaggaggcgccggcgccgttcctgtcggacgcgcagcgcaaggagatccacgagtcggccaagcggatctgcaaggaggcccactactacggcgccggcaccgtcgaatacctggtcggccaggacggcctgatctccttcctggaggtcaacacccgtctgcaggtcgagcacccggtcaccgaggagaccgccggcatcgacctggtgctgcagcagttcaagatcgccaacggcgacaagctggacatcaccgaggacccggagccgcgcgggcacgccatcgagttccggatcaacggcgaggacgcgggacgcaacttcctgcccgcgcccggcccggtcacccgctacgacattcccaccgggcccggggtgcggctggactccggcgtcgaggccggctcggtgatcggcgggcagttcgactcgatgctgtccaagctgatcgtgtacggcgccgaccggcagcaggcgctggcccgcgcccgccgcgccctggacgagttccacgtcgagggtctggccaccgtcatcccgttccaccgcgccgtggtgcgcgacccggccttcatcggtgacgacaacgggttcgcggtgcacacccgctggatcgagaccgagtggaacaacaccgtcgagccgttcaccggcggcgagcccctggacgacgaggacgcccgcccccgccagaaggcggtggtggaggtcggcggccgccggctcgaggtgtcgctgcccggggatctggccctgtccaacgggggctcggccgacccggccggcgtgatccgcaagaagcccaagccgcgcaagcggggcgggcacggcggcgcgacggcctccggcgacgcggtcaccgcacccatgcagggcaccgtggtcaaggtcgcggtcgaggagggccaggaggtctccgccggcgacctggtggtggtgctcgaggcgatgaagatggagaacccggtcaccgcgcacaaggacggcgtcatcaccggccttgcggtcgaggccggcgccgccatcacccagggcacggtgctcgccgagatcaagtagggctccggcgagagatttcaccgacggcgttgtcgggcccgggcgccgggagtagggttaccggcagggttgagttcacagccgcccgggatgcgtcggtgacgtggaggcaggctgaattccctgcccccgccgaacttttccggcatcgccgacgtgttccacagcacgatctccgcacgggatggagtcagcgatgtctgtggcccaatcttggcagcaaagccgcaccgcacagttcacggcgcggtgggggctgaccgggaccctgatcaccgtcgacggcgaactcgacgccgccaacgccgatcagctcgccgcctacgtgcaacagagcgtcaaccgttcccgccgcgtgatcctggacctgcgtggcctgaatttcattggcaccgcaggtttttcggccctgcatcggatcaacgtgatctgctcggcggcccagacgtcgtgggccatggcgcccagccccgcggtggcgcggctgctgcggctgtgcgacccggacggcaccttgccggtgaccaccccgaaggccgagccgctgctggagccgcggcgggccaacgacgacgaatcgcccgggccgctactgcaattggtcacgaagccgcgttagcgacttggccagcagccgcgacacgtgcatctgcgagatgcccacccgctcggcgatctgggtttgggtcatcgactcgaagaaccgcaacaccagcacggtgcgttcgcgttcgggcagcgcctcgagcaacggccgcagcgactcctggtcctcgatccggtccagcccggtgtccacgtcgcccagcgtgtcggcgatcgcgcgcacttcctcctcttcgctgccgccgccgctgtcgatggacaaggtgttgtaggagctgccggcgaccagcccctcgaccacctcttcgcggtccatctccagctccgcggccagctcggtcgcggtcggcgcccggcccagccgctgcgacaggtcggcggtcgcggtgcccagccgcaggtgcagctccttgagccgccgcggcaccttcaccgaccagctgttgtcccggaagtgccggcgaacctcacccatgatggtgggcaccgcgaacgagacgaagtccgagccggcgtcgacgtcgaaccggaccaccgcgttgaccaggccgacccgggccacctgaaccaggtcgtcgcggggctcgccgcggccctcgaagcggcgcgcaatgtggtcggccagcggcaggcaccgctcgacgatcttgtcccgttgacgctgaaactccatcgagtcgggctcggcagtggccaactcacggaacatgtccgggacatcggcgtattcgttcgggcgagaaaccgaaccgccggcagctcgcgctgtcacctgctggaggccgcccgtcgcgccgtcagtgtgatgccgaagacactgccggcttcgttgggttcgcgaccgtcatggaaagtctgaacgtcgtcggccaaagacgtcagcacgtgccagctgaagctgccgggcgccaccacgtcgtgggtgtcgcatgccgcggaagcctcgaccactaattggtcgtcttgcgggtcgaccacgacgatcagcgtcgcgtcgggagtggccgagcgaatcaaccgggtgcacacttcgtcgaccgcgagccgcaggtccgccaccgcatcgaaatccaggtcctcgaaagtgccgatcgcgccgaccagggtgcgcagcatcgcgaggttttccagccgcgcggcgacatggagttcgacggcgcggtggccgcgcggacgcttgtcagcgtgcaatccagcatccttcatatggtctcccggcaatggtcgactgacactactactgctctgcagcccaccgtggaccgtgcgttcgagccggttagtcatgatcgccgccgggagttccgcccggggtggacgggcctgacaccaccgacatggtcgcgacgcgccgcctgcgacgcgtcgcggtgatcgccgggatcacgctggacgtattgattgtcgtcgcagcaggcatttatgtcggggtgttcgtgattgtgtccccgatgatggggtgacgttcgatttcgaggtgacgcgaccgtttcggcactcatcatggtgccaccttgatacccgctcgacgcggcccgtaaccgcggattcggctatcccgcaaaatttcagggcggcagccgtcgcggctggtccggcggccggcgacccgaccggcgaggcccggaaacaccgggggaagacggcgccgtcagctggccggccactgcctgtgcacctcgggatgttcggcgtaccagcggtcggcgatccggcggatccggcggtgctccacggccagccagaccagccccagcaccgcggcgatgaccgccgtgacgccggccgtcatgccctcgtgatgatgtccggtggcaaacgccgcaaggcttccgcaggctccgacgacgcccgcgacgactaacagataccccggccagtgcaggacgtcgatcagcgactcgccggcgagcggccgcgtggtcctcagatggtcgacggggtcgtgaaaggtgtctcccatggctgctcctcaccgcaccctcaacgttagatcgcggccgggcaaagctgaagggcaaagctacagggccagcaccggaccggcgatcggggcgactcccatggccaccatcagcgccatcacggtcagcaggaaccagcccgcgccgtgccagccccaccaggtgccgcgggccttccacacccgataggtgcgcacgaacgcccagatcccgccggccaacgcgatcagcgggccgccgaacgccagcagcgtacgctggggcggcccgcacgcgacggtgtccacaccgccggtcgggcaggtgctcacccacaccgcggcgatcagcaggaagccgacggcgccggccgcgcacagcacggcgaaccggatggcggcgtgcacctcacggtcttcctggcccaggcgatcaccgcccgaccgctcgtctgccttctgcatcgtcctcactcccccggctcggccccccgtcttgtttcatcgctgcccgcgccgcaatggttacggcggccggtgggcgcctcggcggcccgcggacgcgccgcccctggcggccgcgcggtggcagcgcaatgcgcacgggatcagatacccgccggcaaacccgggtaaaccggtccgggacgctagcccaaggtcggcagcgcgtcgcggaccgccccgatcgccgcgtcgatctcgccgcgcgagacggtcagcgccgggcggaaccgcaccccgtcgtcgcccgtgggcaacacgatcaccccgcctcgccacagccggccgatcagctcgtcgcggtccgccgtggtgggcaggctgaacgcgcacatcagcccgcggccgcggacgtcgagcaccaggccggggaactcgcgggccaggtcgtgcaggccgcgcagcaggtaggcgccctgccgggcagcgtgctcgaacagctcgtcggcctcgatcacctccaggatgcggcgggcccgcaccatgtcggccaggttgccgccccaggtggagttcagccgcgacgacaccgcgaacacgttgtcggccacctcgtcgacccggcggccggccatgattccgcacacctgggtcttcttgccgaacgccaccacgtcgggctgcacgccgaattggtggtaggcccaggcggttccggtcaacccgcagcccgtctgcacctcgtcgaagatcagcaaagcgtcgtgttcgtcgcacagccgccgcatggccgcgaagaactccggccggaagtggcggtcgccgccctcgccctggatgggttcggcgatgaagcaggcgatgtcgtgcgggtgcgccgcgaacgccgcgcgggcctgccgcagcgactcggcctccagggcgtcgatgtcggccccgcaccgcaggtggggcgcgtcgatccgcggccagtcgaacctcgggaagcgggccaccgtgaccggcttggtgttggtcagcgacagcgtgtggccgctgcggccgtggaaggcgccgcgcaggtgcagcacccgggtgcccagcgcggggtcgacaccgcgccgttcgttgtgccggctcttccagtcgaacgccaccttgagcgcgttctccacggccagcgcgccgccgtcgacgaagaacagatgcggcagcgccgggtcgcccagcacccggacgaaggtctcgacgaagcgggccatcggcaccgagtagacgtcggaattgctgggcttgttcagcgcggcggccgccagctcggcgcgaaactccgcgtcgcgcgccagcgcggggtggttcatgcccagcgccgacgacgcgaagaaggtgaacatgtccaggtagcgccgcccgtcccgggcgtcatagagcaccgatccgcgggagcggtccaggtccagcacgaagtcgaaaccgtcggtcaggatgctgcgcgacaacacctcgtgcacccggtcggggccggtgcaggagcgggcgcgggccaggcgttccagtgcggcggtcatgcggctatggtagccgatctttacgaaatcatgaggtataggcagtaatatttacggtacatataccctgttgtcgtaaaatgtgttcaatatgatggtgcttcgcgtcctgacgttcgcggcggtccggatccgctgcagcaggtcctcgagcgcccgggcggactcgacgcgcaccagcagcacgtagctttcctcgccggccaccgagtggcacgattcgatctcctcgatgtgctgcaggcgggccggcgcatcatcgggttgagagggatccagaggagtgatggccacgaacgccgacagccggtgcccgaccgcctccggttcgatgcgcgcggagtatcccgtgatcacgccgcgggcctccagcctgcgcacccgcgactgcaccgccgagaccgacaaccgggcgctggcggccagctcggccagcgtggcgcggccgtcggcgaccagctcgcgcaccagaatccggtcgacatcgtcgagcgtctcactcatggccggagactatcgcagcggcggtgcccggtgagccggccgaaatggttgcccacctggcggttgcgggcgatgttcgccgcgggcctctcggcgatgtacgccgccgaggtgcccggctacgccaccctggtgcaggtgtgcacgcgggtgaacgccgatcacgtggcgcggcaccccgacgcccaacggtggggctcgctgcgccgggtcaccgccgagcggcacggcgccatccgggtgggcagcccggccgaactgcgcgcggtcgccgatcttttcgccgcgttcggcatggcgccggtcggctactacgacctgcgccgcgctgcgtcgccgatcccggtggtgtgcaccgcttttcggccggtcgacggcaacgagttgtcgctcaacccgtttcgcatgttcacctcgatgctggccacccgcgaccggcgctacttcgaccgcgacctgcgcgcccgggtggacaacttcctggcgcaccggcagctgttcgatccggcgttgctggcccgggcccggagcatcgccgccgcgggcggctgcgccgacgatgccgcccggccgttcgtcgcggccgcggtggcgtcattcgcgttgtccggcaagccgatcgagcggtcctggtacgacgagctgtcgcgggtgtcggcggtggccgccgacatcgccggtgtctgctccacccacctcaaccacctgaccccgcgcgtgctggacatcgatgagctgtaccggcggatgaccgggcgcggcatcgcgatgatcgacgccatccaggggccgccggccaccggcgggccggcggtgttgttgcggcagacctcttttcgcgcgctggccgaaccccgccggttccgcggcgacgacggccgcatcaccgaggggacggtacgggtgcgcttcggcgaggtggaggcgcgcggtgtggcgctgaccccgcggggccgccgccgctacgacgccgcgatggccgccgacgacccggccgcggtgtgggccaactactttcccgccaccgacgcgcagatggcggccgagggcctgggctactactgcggcggcgacccgtcggcaccgatcgtctacgaggacttcctgcccgcctcggcggcgggcatcttccggtccaacctggacgcggaaacccccggtgccgcccaagccgcccctgccgtcgatgactccggctacgaccaggactggctggccggggcgctcggccgcgagatccacgacccctacccgctgtacgaggcgcttgcccaggaggccccccgatgactttgcccaccgccgccgaattgcgcgcccgcgccgccgatgccctgcgctccctcggcgcgcacgtcgagctcggcgcgccggacgcgcacgggctgcccgccagcaccccgatcaccggcgaggtgctgtttaccgtcgcacccaccacatccgatcaggccgagcacacgataacccaagcgacccaagcgttttcggaatggcgccgcaccccggccccggtgcgcggcgcgctggtggcgcggctgggcgagctgttgcgcgcgcaccgcgacgagctggccgccctggtcaccctcgaggtcggcaagatcacctcggaggcggccggcgaggtgcaggagatgatcgacatctgccagttcgccgtcggcctgtcccggcagctctacggccgcaccatcgcctcggaacgccccgggcaccggctgtccgagacctggcacccgctcggggtggtcggcgtgatcaccgcgttcaacttcccggtcgcggtgtgggcgtggaatgccgcgctggcgctggtgtgcggggacaccgtggtgtggaagccctcggagctgacgccgttgacggcgctggccacccaggcgctgatcgcccgggccgcggccgacgtgggtgccccgcccggggtgagcgcggtggtgctgggcgaccgcgagctgggcgagctgctggtggacgacgagcgcgtcgcgttggtgtcggcgaccgggtcggtgcggatgggccgggcggtcgggccgcgggtggcggcccggttcgggcgggtgctgctggaattgggcggcaacaacgccgccgtcgtgacgccgtcggccgacctggacctggccgtgcgggccgtggtgttcgccgccgccggcaccgccggtcagcgctgcaccacgttgcggcggctcatcgtgcaccgctcggtggccgacgaggtggtcgcccgggtggtgtcggcgctgcgccggctcccgatcggcgacccgttcgagccgggcacgctggtggggccgctgatccacgagaccgcttaccgcgacatggtgggggcgctggagtctgcgcgcgccgacggcggcgaggtgatcgacggcgaccgcaggcaccccttcgccgtcgagcacccgagctcttactatgtggcgccggcggtggtgcgcatgcccgcgcagacgcccatcgtggccaccgagacgttcgcgcccatcctctacgtgctgacctatgaccggctggacgacgcgattgcgctcaataatgccgtgccgcaaggtctttcgtcggccatcttcaccacggacctgcgcgaggcggaacgcttcctggacgaatccgactgcggaatcgccaatgtcaacatcggcacctccggcgcggagatcggcggcgcgttcggtggggagaagcagaccggcggcgggcgggagtcgggcagcgactcgtggaaggcctacatgcgccaaagtaccaataccgtcaattattccggtgcattaccgctggcccagggcgtcgagttcggatgaatccattgtggccggtgtctcatgtcgtatgagtactatctgacacatggcgacggcccgaaggcgattatcccccgaagatcggcgggctgagctgctcgctttaggggcggaggtcttcggcaagcggccctacgacgaggtccgcatcgacgagatcgcggagcgcgccggggtgtcgcgggccctgatgtaccactacttcccggacaagcgagcgtttttcgcggcggtggtcaaggacgaggccgaccggctgtacgagaacaccaacatggacgacgtcaccgggttgaccatgtatgaggagatccgggtcggggtgttggcctacatggcctaccacgagcagaacccggaggccgcatgggccgcctacgtcggcctgggccggtccgacccggttctgctgggcgtcgaggacgacgccaagaaccggcagatggaacacatcatgtcccggatcaaccagctgctcgccgaggtgcccgcgacgcgggagcccgacgtcgagcggcacctgcgggtcatcctgcacggctggctggcgttcaccttcgagatctgccggcagcgcatcatcgaccccaccaccgacgccgacaagctcgccgacgcctgcgcgcacgcgctgctggacgccatcggccgggtgcccgagatccccgaggagctgggcgaggcgatggccaactcgcggctctgagcgggccgcgaccatgtcggtgcccgttggcaccatggacgggtgagcactcccgccgagccccggccgtccaggccgtccgacccgctgggccggttcagcgcgatcacccgggagtggttcaccagcaccttcgccgccccgaccacggcgcaggcgcaggcctggagcgccatcgccgacggccacaacacgctggtgatcgccccgaccgggtcgggcaagacgctggccgcgttcctgtgggccctggacagcctggccggccagtccgagcgtgcgcccggcacccgggtgctctacgtgtcgccgctcaaggcgctggccgtcgacgtcgagcgcaacctgcgcaccccgctggccgggctcacccgcatcgccgagcgcgccggcctgccggcccccgacatcagcgtcggggtgcgctccggtgacaccccgccggcggtgcgtcgccagctgatcaaccggccgcccgacgtgctgatcaccacgccggagtcgctgtttctgatgctcacctcggcggcccgcgagacactggccggggtgcagacggtgatcgtcgacgagatccacgccatcgcgggcggcaagcgcggcgcgcacctggcgctgtcgctggagcgcctggacgcgctgcgcgagggccggcccgcccagcgcatcgggttgtcggcgacggtgcggccgcccgaggagctggcccgtttcctgtccgggacggcgccgggcgcccggaccaccgtggtggccccgccgtcggccaagaccgtcgagctgagcgtgcaggtgccggtgcccgacatggccaacctggcgaacaacaccatctggcccgacgtggagaaccgcctggtcgacctgatcgaggcgcacggttcgaccatcgtgttcgccaattcgcggcggctggccgagcgactcaccgcccgactcaacgagattcacgccgaacgcagcggcgtcgagctctccgcgaccgccaatccgaaggtggccggcggcgccccggcgcacatcatggcctcgggtcagacctacggcgtggagccgatactggctcgggcccaccatggttcggtcagcaaggaacagcgcgcgctggtcgaggaggacctcaaacgcggcctgctcaaggcggtggtggccacctccagcctggagttgggcatcgacatgggcgccgtcgatctggtcatccaggtggaggcgccgccgtcggtggccagcgggctgcagcgcatcgggcgggccggccaccaggtcggcgaggtgtcgcgcggggtgctgttccccaagcaccgcaccgacctgatcggctgcgcggtgaccgcgcagcgcatgctggccggccagatcgagaccatgcgggtgccggccaacccgctggacatcctggcccagcagaccgtggcggcggccgccctcgaaccgctggacgccgaccggtggttcgagacggtgcgccgggccgccccgttcgcgacgctgccgcgcagcatctacgaggccaccctggacctgctctccggcaagtatccgtccaccgaattcgccgagctgcgaccgcgattggtctacgaccgcgacacgggcacgctgaccgcgcgccccggcgcccagcggctggcagtcacctcgggcggcgccatcccggaccgcgggctgttcaccgtctacctcgcctcggaagccgaaaagccttctcgggtaggcgaactcgaagaggagatggtgtacgagtcgcggcccggcgacgtcatctcgctggccgccaccagctggcggatcaccgagatcacccatgaccgggtgctggtgatcccggcgcccgggcagccggcccggttgccgttctggcgcggtgacggcgtgggccgcccggccgagctgggtgccgcgctcggcgcattcaccggcgaactcgccggcctgagccgggaggaattcgattcccgttgtgccgcactgggtttcgacgcgtacgccgtcgacaatctgtacggcctgttcgacgagcagcgcaccgccgccggggtggtgcccaccgacaccacgttgctggtcgagcggttccgcgacgagctcggcgactggcgggtgatcctgcactcgccgtacgggctcggcgtgaacgggccgctggccctggcagtgggccgccggctgcgggagcgctacggcatcgacgagaagcccaccgcgtccgacgacggcgtggtggtgcggctgccggacacggtttccgatttcgcgtccgacggtggcgacaccccgcccggcgcagagcttttcgtcttcgacgccgacgagatcgacccgatcgtcaccgccgaggtgggcggttcggcgctgttcgcgtcgcggttccgcgagtgcgcggcgcgcgcgctgctgttgccgcgccggcaccccggccgccgctcgccgctgtggcagcagcgccagcgcgccgcccagctgctggaagtggcccgcaaataccccgacttcccggtggtgctggagaccgtccgggaatgcctgcaggacgtctacgacgtgcccgccctggtcgcgctgatggccggcatcgcgcagcggcgggtgcgggtgctggaggtggagacgcagcggccctcgccgttcgcggcctcgctgctgttcggctacgtcggcgcgttcatgtacgagggcgacagcccgctggccgagcggcgggccgccgcgctgtcgctggacagcacgctgctggccgagctgctgggccgggtggagctgcgcgaattgctcgaccccgaggtggtcgcggccaccgcccgggcgctgcagcacctggcgcccgagcgggccgcccgcgacgcggaggccgtcgccgacctgctgcggctgctgggcccgctcaccgaggacgaggtggtcgcccgggccggtggcgcggacgccgtcgaggtcaggggctggctggagggcctgcgcgcggcccggcgcgcggtgccggtgtcgttcgccggccgcagctggtgggtggccatcgaggacatcggccggctgcgcgacggcctgggcatcgcggttccgctgggcgtgccggccgcgttcaccgaggaggtcgccgacccgctgggcgagctgctgggccggtatgcgcgcacccacaccccgttcagcaccgccgaggccgccgcccggttcggtctggggctgcgggtgaccgccgacgtcctgggccggctcgccgacccctccacttcgcagggccggctggtgcgcggcgacttcgtcgcagcgcggccgtcggagccgggcggagtgctcggggccgagcagtggtgcgacgccgacgtgctgcgcatcctgcggcggcggtcgctggccgcgctgcgcgcccaggtcgagccggtcagcaccgccgcctacgggcggttcctgccggcctggcatcgggtcggagcggccgaatcctcgcgcgcgcccggccattccgggctggacgggctgatgtcggtgatcgagcagctggccggggtgcggctgccggcttcggcgctcgagccgctggtgctggccccgcgggtgcgcgactactcccccgccctgctggacgaactgctggccaccggtgaggtcacctggtcgggcgccgggtccatctcgggcagcgacggctggatcgccctgcaccccagcgagtccgcgccgctgacgctgcaggggcccgccgacatcgagctgggcgaggcgcaccgcgccatcctggatgtgctggccggtggcggcggctacttcttccgtcagctggcaaccgacggggtgtccgacgccgagctcaaagccgcagtgtgggaactggtttgggccggctggatcaccggcgacacgttcgccccggtgcgcgccctgctcggcggcggcggaacgcgccggcgttcggcgccggcgcaccgcgcgcagcggccgccgcggctgagccggtacagcgtcgcgcacccgcaggcccgtccggccgacccgaccgtggccggccggtggtccctgctgccgccgcccgagccggactccacggtgcgcgcccacttccaggccgaactgttgttgggccggcacggcgtgctgacccggggcgcggtggccgccgagggcgtcgcgggcgggttcgccacgctgtacaaggtgctgagcaccttcgaggacgccggccgctgccagcgcggctacttcatcgaatcgctgggcggggcgcagttcgccgtcgcctccaccgtcgaccggctgcgcgggttcgccgacggggtcgacccgcaacggcccgagtatcgggcgatcgtgctggccgcggccgacccggccaacccgtacggcgccgcgctgccctggccggcgtcgagcgcggacggggcccggcccggccgcaaggccggggcgctggtggtgctggtggacggcgagctggcctggttcctcgagcggggcggacggtcgctgctcaccttcaccgacgacccggccgcccagcacgccgcggcggcggcgctggccgggctggtctcggcccgtcgcgtcgcggcgatcctggtggagcgcatcgacggggtgccggcgttggcgccgcgcggcgacggtgccgccggcaacgacgcgctgacggcgctcgccgacgccgggttcgcccgcaccccgcgcggaatgcggctgcgctgaccatgccggagggtgacaccgtctggcacaccgccgccgtgctgcgcgagcatctgctcggcgagacgctgacccgctgcgacatccgggtgccgcggttcgccaccgtcgacctcaccgggcaggtggtcgacgagatcctcagccgcggaaagcatctgttcatccgggtgggcgccgccagcatccactcgcacctgaagatggagggcagctggcgggtcggcccgcgggtgcgggtcgaccaccgggcgcgcatcgtcctggaaaccggcgccgcgaccgcggtcggcgtcgatctgggcgtgctgcagatcctggaccgcgatcgcgacggcgaggccgtcgcgcatctgggacccgatctgctcggcgaggattgggaccccgcgcgggccgccgccaacctggcggcccgcccgcagcggccgatcgccgaggcgctgctggatcagcgggtgctggccgggatcggcaacgtctactgcaacgagttgtgctttgtcagcgggcatctgcccaccacgccggtgagcgccgtcgccgacccgcggcggctcgtctcgcgtgcccgggacatgttgtggctcaaccgcttccgttggaaccggtgcaccaccggcgacacccgcaacggccggcagctgtgggtctacgggcgggccggccaaccgtgccgccgctgcggcacccccatcgagttcgacgactccggggaccgggtgacctactggtgcccgtcctgccagcgttaatcgcgggcgtgggccaggaagaactccgcgatggcctccgacccgtccagcgtgtgcgtggtggggccgatgaccgcggcgggcaggtactgcttgccgccgggccaggtgtgcccgcccttgtcgatccggtagaagaccacctcggtggacgccgcgcacgacgtggagtcgaagcggtgcaccaccgtgccgtcgcgggcgtcgggcagcagctccatcgacggatcgccctggcatccgtcggccttgcgccacttgtccaccatggcttccgccgagacggcgtggctgaggccgccccggccgcgcaccgccccgcccttgaacggcaccagcggatcggcggtcccgtgcgccgcccacaccgacaccggccgggacgggttgcaggccacgcccacgccgagggtgccggccaccggcgcgacggcggcgaagacgtcggcgcggtcgcaggcgagccggttggacatgaagcccccgttggacattccggtgacgaagacgtggccgggcgcgacgcggtagtcgttttgcagcttggtcaccagcccgaccaggaaggcgacgtcgtcgacgtggtggcgatccgccggtgaggcgccgcgcccgtcggcccagctcttctcgtagccgtcggggtagacgaccaacaggttgtgcgcgtcagcaacggcgtcgaagccggtcagcccgcgctgcgcgatgccggttccgccgccgccgtgcaggctgagcaccaggccgacggggtcgcccgccggcacgtgcaacatgtaggttcggtccatgccgccggaacgaaaggtgccggaaatgtctcgcgcgctggccgccgacacatgccgcacaccgcagccgaccacgcataccgccagcacagcgagccacagccatcgggcgtacgccatctcgtcagatcaccggcgccgcgtcgagcagggcccgcaggtgacgcgcggtcgacgacggagcaaaccctggtgtggcacgcaccgcattatcggtgatacggcagccggtgccgccgcgacatgcgagcattcgacctagccccgcctccagcaagcaacggcacttctgttccacgggagtatcacaaatgacgagcacccagatacgcaagcgcgcccggccgcggtcgctggtggtcgccggcctgctgccgctggccggcctcctcggcgtgatcacgacgccggcgcacgccacctcggccgacgacgcgttcctggccgcgctgaaggccaagggcatcaactacgagtcccccgacgccgcggtcaactccggccacaccgtgtgccacgaactcgacatgggccagacccccgagcaggtcgccaacaacgtgctgtccagcagcaccctggacagctatcacgccggctatttcgtgggcgtcagcatcaaggcgtactgcccgaagtatgcggcggcggcagccggatcctgaaatttacagccggttgacaggctcgtgacgaaaccgcggataaaatctgaacatccgaattcaggtgacgaagcgcagagccacgatgattccgagactgctggccggtatggcctgtgtcgcaatcgctctcggcccgcccgtcggggccgcggcgccggccggcgccgaccccggcccgttcgcccatctgaattgcgcctgcgatcaaccggatccgcccggcggcgcgacgccgcgggatgcgatgaatcagggcatccggcaaggcctttccgctcccccggcggccgaatagccgtcctgcgccctgccgccgcgccacacgcggccccggctgtccggaatgctctgcgccccatcgtctttcccgctagcccgccgacggcggccgctgcatcacggtcccgggaagctccgcgccgtactcgatgtcgtcgtagtcgcgcccgttgcgccggcgggttccgttgccgcccgggcgcatcggcgtcatcggcagcatcggcggctgcccggccccggtcgcgagcggcgaggcggccgacgccagttgcacgggcgcctgcgaccccagcattcccaccgtcgccggcggcatggtcaggttgcccagcgagatgcccacgcccagcgccgcccgcggcgccagggacgatccggcggcgccgacggcgctgaccagtcgcacctcggccgccgacagggcggccgtgccttcggccaggccgccggcgacgtcggcgcccagcgactggaatccgctggcggtctgcagctgggccagcaccccgatcaggttgatcggaaatccgctggcggccaggaattggttgccccaggtgctccagtacttgaaccagccagtgttgggatcgaagaaggcggtggaggcggcctgcagggtgccggcgacaccggtctgggtgccggaatcagcggcgttcgtcgcgggcaccatcgcggcctgggtgctcaccccggacgggttggccacctgaggcggctcggtgaaccggggcaacctgaccgcggtcgccgaggtcgccgcgtagcggtacatcgccgcggagttgttcacccacatggcgtggtactcggcctcggtttcggcgatggccggatagttgatcccgaagaagttggtggccaacagcattgccaggcgggcgcggttggcggcgaccagcgagggatgcaccaccgtccagtgcgtcaattcgaatgcggcagtggcggtttgcaccgaggtggcgatctcctggcattgctgggcggtgatccgcaaccagtccacgtacggctcgagcgcccgggtcatcgcgagcgcggacggcccctgccaggtggtcgacagcgccgccagctccgcggtgtagctgctcgccgactgttcgagctccatgctcagctgctgccacaccccggcggcttcgatccatgaccaggcaccgggtccagcgtggatcagcgccgaggtgacctccggcggcagtatcccaaaatccatgaacctttaccttggctgcattcgggaagaacgtgggtgtgggccgcgctgcgggcgggcccgttcggcgattcggtgtccgcggtgagggcggggcaccatggtcaattcatccggccgacggattacgaggcatcactttgcctttgacttcccggccgtaggcgacgtcctcgtacttctgctgcttacgttttcgccagccggtgcccgccgaggtggtcggcggcggcaccatcatcggcatcagcgggaaacccgattcggccgcgggcagcggcgacgccgccgaggccagctgcacgccggtctgggttcccggcagcagcccgaccaccgccgggggcgcggtcagtttgcccagcgacaccccgacgcccatcgcgccgctcggcgccaccgcacccgcgccgatgcccttgatcgcgttggccaggctggcggtggtcgcgcccaggccctcggacaggccggagccgatgtcgccgccgacggacgcgaccccctgggcggtggccagctgcgcccacacgcccagcaggttgatcgggaagcccgacgagatgaactggttgccccaggtgctgaagtagttgaaccagccggcgttgggatcgaacccgccgggcatgttgaggtcgttgagcaccgagcccaccgacgaacccgaggagtcgaccgacgccttcatcaccgcggcctgctggttggcggtcccgccggggtcggtgacggccagcggcgaattgaactgtgtcagcggcgatgtcgcctgcgacgaggccgcctggtagcggctcagcgcggccgagttgttcgcccacatggtctggtattcgttctcggtctcggcgatcgccgccgtgttggtgccgaaccggttggtggccagcaactgggccagccgggtgcggttggcgctgacgaccgacgggtgcaccacggtggaccgcacggtgccgaacgccgtcgccgcggcctcggcggagttcgccagctgcgcggactgctgcgcggtctcgcgcagccacagcaggtagggctggacggattgcagcatcgccatcgccgaggggccgtcccaggactcgatcagcgacgacagcgtcgaggcgtagctggacaccgagttctccagctcgacggcgacgcgctgccaggcggcggcggcctcgatcagcgagcccgcgcccggcccggtgtggatgagtgtcgaggtgacctcggggggtgcaaacagatccatcacatctcacaatgcccacgctgagaacgcctcagcaaatttgcgttgaccaggccgcgaagagcgcggaaactctgcacgtcgaggcctgtcacctgcggtcatgtccctcccagaccgactgccgatgttaggccaccctatacccataacagaaatcgttttcacatttgctggcggtgtgccagcgggcgtgccggcggtcgccgcccgtcgcccggcagtctcggctcagtcgatgtggccgggcgggtcggcgaaggcgagatcggccgggtgctggtcgggtcccagctgttcgcagtgcccgtcgggcaccaggtaggagctggccccgttggggatcaggcgggtgaccgcgacgcagcgctgccaggtgccgtcgggctggacggggccgtcacacttgctcagcacgggcccgccgtactggcagccggcccgggccggcggggccgcggcgatcaccccggcggccagcagcagggcggccgccgctgcgacggtgccgtgcctcatggttgcctcccgtcacgtcggcgccggctatgacgctaccgcgtgccgtgcccgggtgggtcgccgttcagcgcagcgtccggtcggtcttggtgacgcagcggtagagctcctcgccgtaggggacgacgatcgcggcggccaccgcggcggcgaccgcggcgaggtagccgccgggcagcgggttctgcttccagcgcagccgctaggcgtcgcgggagcgggcaccgcggacgagctcgcgcacctcccgccagtgcaggcagcccagcgccgaggccgccatgatcggcagcgactccaggaagctgtgcacgtgctgctcccaggtggtgacccggcgcccgctgcgctcggcggcggtgacgtcccacagcgcggtggcctcgtgggcggcgatggacgccaggatcgtcgagagcaccagcgggttgatctcgcacagcaggaccagggtgatcggcacccccacctcggccatcatcagcagatggatcagcgactcccgggtgcccgaggtgatctcaatcctgctgcgccggtgctggttccaatccagcagggccgggatgaaccaggccggcagcagcccgtagagcaggtaccgcagcagcgcggtctcggcgtcgttggcccgttccggaatccgcaattgccgtcgcacacgccaccaggtacccgcgcagcggcgcgccaaactctgtcatggacctgggtcgtcgagggtccggcggttgacgaagacgcgacgggcgccggtgcgcggatcgtcgaactcgatgcgctgggcaagcagctgcagcggggtgctgaagtcatcggccggcacgtcaatgatgttgggatacaacggatcaccgatgatcggtatgcccagcgaggccatctgcaggcgcagctgatgggtgcgtccggtgcgtggccgcagccggtacagaccgtccggggacaacagctccacctccgtcagcgcgttgggcggcccgggttcgcagaccgcctgcatccggccccggtgcttgacgatgcggccggccagcacccgcgggaacaccagcgccgggtcgacggcggcccgggccagataggtcttgtccaccagcccgcgggagaacagcgtctgataggcgccgcgcacctcgcgccgcgcggtgaacagcagcaccccggcggtcagccggtccagccggtgcgcggggctcagctcgggcaagccgagctcccggcgcagccgcaccagcgcggtctgggcgacgtgccgtccgcgcggcatggtggccagaaagtgcggcttgtcgacgacgacgatgtcgtcgtcgcggtgcagcaccgggaggtcgaagggcaccaccacctcgtcgggcagctcgcgatagaggtacacactggccccggccggcaacacggtggcctcgtcgaccaccgccccgtcggcggtaaccacttcggcggcaaggactttggcgcgggccgcggcgccgaaccgggcggtgagctcggccagcaccggaccgccgcgcagccgcacccgggcgggtcccagcccgtcgcgaaccggcagcggcgccggtctcaattgagcggcaccggctcgaggatctcggcgcgcgcctcgggcgcgctggcgcgcagctcgtcggccgacacgtcgtcgggctgggcctgcgacaggatctcggcctgcacccgggcggtgtagttggccacctcgcgctcgacgtcgccggccgtccaccccagcaccggcgcgaccacgtcggccacctcgcgggcacagtcgacgccacgatgcgagtattcgatggagatgcgcatccggcgggccaggatgtcctccaaatgcaaagcgccctcggcggttacggcgtacagcgcctccacccgcagatagcccggcgcctccgtgatcgggttgagcaggtcgggccgatcggcggccagcgccagcacgtcaccgatcagcgagccgtagcggtccagcaggtggcgcacccggtagggatgcaacccgcgcagctgcgcgacgtgctcggcctgattgatcagcgcgcagtagccgtcggcccccagcaggctgaccttctccgtgatcgacggcgccacccgggccggaatgaattgcgccgcagcatcaatcgcgtcggcagccatcacccggtaggtggtgtacttgccgccggcgatggccaccaagccgggtgcgggcaccgccaccgcgtgctcgcgggagagcttggatgtttcctcgctctccccggccagcagcggccgcagccccgcatacaccccgtcgatgtcggcgtgggtgaggggtatggccagcacggtgttgacggtggacaggatgtagtcgatgtcggccttggtggccgcggggtgggccaggtccagatcccagtcggtgtcggtggttccgatgatccagtggctgccccacgggatgacgaacatcaccgacttctcggtgcgcaggatgatcgccacgtcgctgacgatgcggtcgcgcggcaccaccacgtgcacccccttggatgcccgcacctgaaatcgcccgcgctgcttggacaatgcctggatctcgtcggtccacacgccggtcgcgttgaccaccacatgcccgcggacctcggtgaccgagccgtcttcggagtcgcgcacccgcaccccggtcacccggtcgccctcccgcagcagggcgaccacctgggtggagttgcgcaccaccacgccgtagtgcgcggcggtgcgcgcgacggtcagtgtgtgccgggcgtcgtcgacgatggtgtcgtagtagcggattccgccgatcagcgcgctgcgtttgaggcccgggcacagccgcagcgcaccggcgcgggtcaaatgcttttgcgccggaacggatttcgccccgcccagccggtcgtagagaaagatgccggcggcgatgtagggccgttcccacaaccgattggtcagcgggaacagaaagggcatcggcttgaccaggtgcggtgccagcgtggtcagcgacagctcgcgctcgtagagggcctcgcgcaccagcccgaactccagctgctcgagatagcgcaggccgccgtggaacatcttcgaggaacggctcgaggtgcccgacgcgaagtcgcgggcctccaccagcgcaaccttgagcccgcgggtggcggcgtccagcgcgcagcccgatcccaccacgccgccgccgatcaccaccacgtcgaactgctcggcgcccagcctgtcccaggccgccgcgcgttgccgcggtcccagcgccgaagccggcgagccgggctcgccgagtgcgtggatcggatcgctcactgcagggctcctgtccggttactcgtcagtagggcgtgctgcaccaaggctaaccgttagtccaggtcgtcgtgggccatcagccgccgggccgcctcggtgatcgaaccggacagcgaggggtaaaccgccagcgtctgcgccaattcgttgacggtgatgcggttctgcaccgccaccgcgatcggcaggatcagctcggaggcgatcggcgccaccaccacgccgccgatcaccaccccggtggacttgcggcagaacaccttcacgaaaccctgccgcagccccgacatcttggcccgcgcattggtgcgcagcggcagcatgatggtgcgcgccgacaccgaaccgtcgtcgatcatggtctgcggcacgccgacggcggcgatctcgggccgggtgaacaccgtcgccgcgacggtgcgcagccggatcgggctgacgccctcgccgagcgcgtgatacatcgcgatgcggccctgcatggcggccaccgaggccagcggcagcaggccggtgcagtcgccggcggcgtagatgccgggcaccgaggtccgcgacacccggtccaccgtcaggtagccgccgcggcccagctcgatgccgacccgctccaggcccaggccggcggtgttgggcaccgagccgatagtcatcagggcgtggctgcccgccacggtgcgcccgtcggtcagggtgaccagcaccccgtcgggcgtgcgggtgaccgattgcgcgcgcgcgttcttcaccagctgcacgccgcgctcggagaacgcctcttccagcaccagggcggcgtcggcgtcctcgtagggcagcacccggtcgcggctggccaccacggtcaccggcacgcccaattcggtgtaggcgtgcacgaactcggcgccggtcacccccgagccgaccacgatgaggtggtcgggcagcgcgtcgaggttgtagagctggcgccaggtcaggatccgctcgccgtcgggctgggccgacggcaggatccgcgggctggcgccggtggcgatcagcacgacgtcggcctcgtactcgctgctgctgccgtcgggggcggtggccttgatgcggtggcgggccagccccggggtggggtcgatcagctcgccgcggccggcgaccacgtgcacgcccacgccgagcagctgttcggtgatgtcggcggactgctcggtggccagttgcttgacccgggcgtggatctggggcagcgagatcttggcgtcgtcgatgtcgatctcgaagcccagccgcggcgcgcggcgcagctcggtgcgcagccaggtcgaggcgatgaatgtcttggacggcacgcagtcgtccagcacggccgcgccgccgattccctcggagtcgatcaccgtgacgtgggtgctgtcggggtgggaggaggcggccaccagggcggcttcgtaaccggccgggcctccgccgaggatcacgatgcgggtcaccacgacccccaacctagcccggcgacgatgcccgccgcagcgcggcgggaggaggaggcgggccatcccacccagcccggcgacgatgcccgccgcagcgcggcggcgcccggctcgggggaagaccgaggcagcccggacgtctaagctttccccgtgccgctctacgccgcgtacgggtcgaacatggatcccgagcagatgctgaagcgcgcaccccactcgccgatggccggaaccggctggctgcacggctggcggctgacgttcggcggcgaggacatcggctgggagggcgcgctggccacggtcgtggaggacccgggttccaaggtgttcgtcgtgctctacgacatgacgccggccgacgagaagaacctcgaccgctgggagggctcggagttcggcgtgcacaagaagatccgctgccgggtggaccgcatctcgtccgataccaccaccgacccggtgctggcgtggctgtacgtcctggacgcctgggagggcggcctgccgtcggcccgctacctcggggtgatggccgacgccgccgaaatcgccggcgcgccagccgattacgtgcacgacctgcgcacccgcccggcccgcaacatcgggccctgactttccgtcgcggcctagcggcctagaacacctggaacagcgccgactgttcgacgatgttggccatcacccgcaccccgatcgccagggcccgctcgtcgaggttgaacgtcggctggtgcaggtccagctgtggccccaccccgggccacacccccagccgcgccatcgcgccgggaatctcctcgaggtaccaggagaagtcttcgccgccaccggactggcgggtgtcggccagggcgtcggggccgagcgcctcgatcgcgtgggtgaggatgcgcgtcgagacgtcctcgttgaccaccggcggcacgccgcgccggtactgcagcgtgtgctcgatgcccagcggcgcgagcagcccggacaccgtctcccggatcacctcctcgagacccacccaggtctgccggctggcggtgcgcacggtgccggccagcaccccggtctgcgggatggcgttggccgccaccccggcgttgaccgcgccccacaccagcacggtgccgttgcgcggttcgatgcgccgcgacagcaccccgggcagcccggtgatcagggtgcccagcccgtacaccaggtcggcggtcaggtgcggccgcgaggtgtgcccgcccggcgaatacagggtgatctcgatctggtcggccgccgaggtgatcgggccgtgccggaccgcgatctggccgacctccagccgggggtcgcagtgcagggcgaagatccgcgacaccccggtgatggcgccggcggcgatggcgtcgatcgccccgccgggcatcagttcctcggcggcctggaagatcaaccgcaccccgaccggcagttccggcaccgacgccagcaccagcgcggtgcccagcaggatggcggtgtgcgcgtcgtgcccgcaggcgtgcgccacgttgggcatggtggaggcgtagggcgcgccggtgcgctcggccatcggcagcgcgtccatgtcggcccgcagcgcgatccggggctcgtgctcggggccgaggtcgcaggtcagcccggtcccgccgggcagcaccttggggttgagtccggcctcggccaaccgctcggcgacgaactgggtggtggcgtattcctggcggcccaactcgggatagcggtggatgtgccgacgccactcgatcaggtcttggttgtgcgcggccagccaggaggtggcggcgtcggccaggctcatgggtgcgccccgccgcgtctgcgctcgtgcgcggccagcacccgatcgcgctcggccggcgtctgggccagcgcgacgacggtgcgggccagcatgattgcgccctcgatcaccgcgcggtcggcgctgggtccggcggcggcgtcggcgaaggcgcgctgatgcaccatggcgccaccggattcgaccccgaccaccgggtggatccccggcagcgcctgcgtcacgttgcccatgtcggtgctgcccatcggcagcgcggcttcgtactccggggccaccggctgccggcccagccggcacatctcctcgcgaaagatgttggccagccacgcgtccggcttgagttcgtcgtaggcgggcgcggggttgtcgatctcgtattcgcagccggcggccattgcgcccgcggcgaagcaggcatacatcctgccctccagctcgcgcagcgagtcggattcgacggcgcgcatcgcgtactgcagcgacgcgtgcccggggatgacgttgaccgcctgcccgccgtcggtgacgatgccgtgcaccagttggcccggcgccagttgctgacgcagcagcccgacggccacttgcgcgacggtgacggcgtcgagggcgttgacgcccaggtggggcgcgacggcggcgtgcgattccttgccgcggtagcgcacgatcgcctcggacagggccagcgagcgggccgcggcgatgtcggccggcccgggatgcagcatcaccgccgcggagatgtcgtcgaacaccccggccttgagcagcagcgccttgccgccgccggcctcctcggcgggagtccccacaagcgccacccgcagacccaggtcgtcggccacctcgaccagcgccagcgcggtgcccacggccgacgccgcgatgatgttgtggccgcaggcgtgcccaatctcgggcagggcgtcgtattcggcgcagaccccgatggtcagctggccgctgccgaagtcggcgcgaaaggcggtgtccaggccgccggcggccgcggtgatctcgaagccgcgctcggcgaccagcgcctgcgccttggcgcagctgcggtgctcggcgaatgccagctccggctcggcgtggatggcgtgcgacagctcgacgagatcggcaccgcgccgccgcacgacatcctcgacgctgtccagcgggctgtctgatccgacggggggcactctcgcagtatgtcgcagtatccgaccggggcccaacgcccctggctatacccgcccggcgatgaaccccgccgcctgggccgggtagggcgggtcctcgtagacgtggtgcgcgtcccggtcccgcccgccgacgacgcacaccgggtcgccgtcgctgcacaggtcgatggcgcgaccggcgaacgccccggtggtcgacaggggcgtgttgaagcggttgccggggttgccgaacaccgccaccgccgcgatcttgctcgccaggccgggatccagtgggggtgccgatccgaagttgccgatccgctgcccgaccggcggtaccccggcgagcatcgagaccgcggccgcgccctgcgagaacccgccgagcaccagccgggtggacgggcaccggtcgaccatctcggcgatgtggtcgcgggcgtcgttggcgccgtcggcggtggtcaggaagttgtagctggccggatagttcaccgcgtaggcgtcgacgttgcggttgcccagcgcgggttgcagcgcggcgaacagcgcatcgcccacggctcccaagcccgggggctcggcggtgccgcgggcgaaaatcagttgcacgtccggacatccgtcggccgccgcccgcggcgccgggccgcaggtgatggcgaccaccgacaaggcgaccgcgacgacagttccaatggccgggccaaccaccggccacccacgcagattcatacgccagatcctggcacacccccccgacacccgctcccgggccggcgttcgccgtcgccgggctaggctcgatcgctgtggccgaaaccccgtccaacccaggcgagctcgcgcgccaggcggccgcggtcatcggcgaacggaccggcgtcgccgaacacgacgtggccatcgtcctggggtcgggatggtcgccggcggtcgccgcgctgggcaccccgacggcggtgctgccgcaggccgaactgcccggcttccgcccgcccaccgcggtcgggcacaccggcgagctggtgtcgatgcgcatcggcgagcaccgggtgctggtgttggtcggccgcatccacgcctacgagggccacgacctgtgccacgtcgtgcacccggtccgggcggcctgcgcggccggggtgcgcgcggtggtgctcaccaacgcggccggcggcctgcgcccggaccttgccgtcggcgaaccggtgctgatcagcgaccacctcaacctgaccgggcggtccccgctggtcggcccgcagttcgtcgacctcaccgacgcctactcgccgcggctgcgcgagctggcccgccaagccgatcccacgctggccgagggcgtctacgccggccttcccggcccgcactacgagaccccggccgagatccggatgctgcgcacgctgggcgccgacctggtcggcatgtcgacggtgcacgaaaccatcgccgcccgggcggccggcgccgaggtgctgggggtgtcgctggtgaccaacctggccgccggcatcagcggcgagccgctgagccacaccgaggtgctggccgccggcgccgcctcggccacccggatgggcgcgctgctggccctgatcctttgccaactcccccggttctaggaccgtgacgcccgaggaatggatcgcgcacgatcccgacccccgcacggccgccgagctcgccgcatgcggcgccgcagaactcgccgcccgcttcgcccggcccttgcgattcggcacggcgggactgcgcggcccggtccgcgccggccccgacgcgatgaacgtcgcggtggtgtcgcgggccagctgggcgctggcgcaggtgctcaagcgccgcggcccggccggcgcgcgggtgatcgtgggacgcgacgcccggcacggctcggcggtattcgccacggtggccgctgaagtgcttgccgcccaagggttttcggtactgctgctgcccggtccggcacccaccccggtggtcgcgttcgcggtgcggcacaccggcgccgccgccggggtccagatcaccgcctcgcacaacccgccgaccgacaacggctacaaggtgtacgacggcggcggcatccagatcgtctcccccaccgaccaccagatcgaagccgcgatggccgacgcgccaccggccgacgagatccgccgaacacccgtcccaccggcgcacaccgacctcgtccagcgctacatcgagcgggcggccggggtgcggcgcggcaccggttcggtgcgggtggcgctcaccgctctgcacggcgtgggcgggacggtggccgtcgacgctctgcaccgcgccggtttcggccgaatacacaccgtggcaagccaattcgcgcccgacccggactttcccaccgtcgtgttccccaaccccgaggagcccggcgccaccgacgcgctgctgaccctggccgccgatgtggacgccgacgtggcgatcgcactggatcctgacgccgaccgctgcgccgtcggcatacccgacgcctccggctggcggatgctctccggcgacgaaaccggttggctgctcggcgattacctgctctcccagccgcagcgggccgaccgacccgtggtggccagcacggtggtgtcgtcgcggatgttgtcggccatcgccgcgcggcacggcgccgtgcacgtggaaaccctcaccggcttcaagtggttggcacgcgccgacgccgaggtgcccggcggcaccctggtgtacgcctatgaggaggcgatcggacactgcgtggaccccgccgcggtgcgcgacaaggacggcatcagcgccgccgtgctggtgtgcgacctggtggccggcctgatcgcgcggggcggttcggtgtccggccggctcgacgagctggcccgccgccacggcgtgcacgacgtcgccgcggtgtcgcgccgcgtcgggaccgacggggctgccgagctgatgcgacggctgcgcaccagcccgccggagacgctggccgggttcggggtggcgctcaccgacatcaccgacgcgctgatcttcaccggcggcgacgacgacacgtcggtcaggctggtggtgcggccttccgggaccgagccgaaggtgaagtgctacttggagattcgctgcgcgccgagcgacgacctggcgtcttcgcggcggcgcgcccgcgccctgcgggagcttctggtcgcgacggtgcggagctggtgaacaggttcggcccgaattggcgatccccggcatcgccgaggccgggcacgatgtaggccgccttgttgagtcccttgtctaccgcggcagtgaacactcgcgcgtcgggcgccgtttccccaaccgccgcaagaccttccggcgcggccaccacacacagcacggtaatgtcggtggcgccgcgacgctgcaacagccccagggtgtgcgccatcgagccgccggtggccagcatcgggtccagcaccatcaccggcctgccggccagcttgtcgggcagcgccgccaaatacgggaccggccggtgggtttgctcgtcgcgggcgacgccgacgaagcccacctcggcctcgggcagcgcggcctgcgccgggtcgaccatgcccagcccggcgcgcagcaccggaaccagcagcggcggattgaccagtcgggtcccggcggccgcggccaccggggtgcggatccggaccgacttgcgcggcgcgtcgcggctggcctcgtagaccagcatcagcgtcagatcgcgcagcgcggcccgaaatccggcggtgtcggtgcgttcgtcgcgcagcaccgtcagccgggccgcggccaacgggtggtcgatcacgcacacgtccatctggtcgagcgtatataacgatcgggcaaagccccgctgacacgcttgcccgccggccgcaaacgccttaccgccgttcgtatactccgggcgtgtcgcgcgaaaatcgaagtcgcagaaggctgatcggcggcgcataccgaagcctgcggctgctcggcgccgtggccgcggtggcgctggcggccagcccgttgacaccgcgcaccagccttgcggcagcggccattccgcaaccgtcgcacatcgtgatcgtggtggaggaaaaccgttccgagagcggcatcatcggcaacaagtcggcgcccttcatcaccgcgctggccgcgtccggcgccaacatgacccagtcgttcgccgaaacccaccccagcgagcccaattacctggcgctgttcgccggcaacacgttcggggtgaccaaggacctgtgcccggtcaacgccggcgccgcacccaacctggggtccgaattgctcgccgccggttacacattcgtcggctacgccgagggcctgccgtccccgggctcaccggtgtgtagtgcgggcaagtacgcgcgaaaacatgtgccgtgggccaacttcaccaacgtgccggcggctagctcgctgccgttctcggcgttcccgatgggcaactacgccagcctgccgacggtgtcgttcgtcatcccgaacaacgacaacaacatgcacgacggctcgatcgcgcaggccgactcctggctgaaccggcagctgtccggctacgccaattgggcgctggccaacaacagcctgctgatcgtcaccttcgacgaggacgacaactccaacgtcggagccagccgcaaccagatccccacggtgttctacggcgcccacgtccggcccggcaactacgccgagcagatcaaccactacaacgtgcttgccaccctcgagcagatgtacgggctgcccaagacgggctatgccgccggcgccgcccccatcaccgacatctggggctgagcaccaggtcgctattctgtgccgcatggctgctgacctcgtgcccatccgcttgagcctgtccgccggcgaccgctacacggtgtgggcgccgcgctggcgtgactccggcgacgagtgggaagccttcctgggcaaggacgaggatctgtacgtcttctcctcggtcgccgacctggtggccttcgtgcgctcggacgaggacaacgacctgaccgaccatccggcgtggacgcggctgcgcacggcgcacgcgcacaagttcgagcccgcgaaggacaagcagttcgatctggtcgcggtcgaggagctggtgtcggagaagccgaccgaggagtcggtgaccgcgctggccggcgtcctggccatcgtgtcgtccatcgggtcggtgtgcgagctggctgcggtgtcgaagttcttcaacggcaacccggccctgggcaccgtgtccggcgggatcgagcacttcaccggcaaggccggcgccaaacgctggcatgcgatcgccgagatcatcgcgcgcggctgggacgacgtgctcggcgcgatcgacgacatcgccaccacccccgaagtcgacgaggcgttgtcggccaaggccgaagacgagctggccgaggagcgcgacgacgaggagaccgacgaggcggacgaggccgccgaggcgccggccgacgcgaccgagccggacgaggaggccctcgaggccgacgaggccgacggcgaaccggacgacgacgccgacgaaaccgagacccgcgcggccggcgacaccgtggtgctcggcggcgacaaggacttctggctgcaggtcggcatcgacccgatccgcatcatcaccggctcgggtaccttctacacgctgcgctgctacctggacgaccaaccgatcttcctgggccgcaacggacgtatcagcgtcttcacctccgagcgcgcgctggcccgctacctggccgacgagcacgaccacgacctggccgacctgagcacctacgacgacatccgcaccgccgccaccgacggctcgctggaggtcgagatcaccgacgacaacatctatgtgctcagcgggctggccgacgacctggccgacgggccggacgcggtggatcgcgaccaactggagctggccgtcgaggtgctgcgcgacatcggcgactactccgaggattccaccgtcgacaaggccctcgagcccggccggccgctgggcaagctggtggccgccgtgctcgagcccggctcggtggccaagccgtcgccgccgtatgccgcagcggtgcgcgagtgggagaagctggagcaattcgtcgacggccggctgcgccgcggatagcccgctgcgtttgacgggctaggttgggtgtcgtgtcgcttcccggtatcggcccgttgcccctctacgggttccagcgtccgggcatgctgctgttcgggttggtgccgctggcgctgctggccctctacctggtggtgcaggcccgccgccggcgccgcctgcaccgctacaccgacgccccggtggcgcagtcgccgtggcggcatctgccgatcgcggtctcgctgctcagcctggtgttgctgaccatcgcgctggccacccccacccacgacatgcgcatcccgcgcaaccgcgcggtgatcatgctggtcatcgacatgtcgcaatccatgcgggccaccgacgtcgaacccaaccggctcaaggccgccgaacaggcggccagccagttcgccagccagctgacccccggcatcaacctcgggctggtcggcttcgccggcacgccctacctgctggtaccgccgaccccgcaacaccaggcgaccatcgacgcgctgaagaagctggacttcgccgacagcaccgccaccggcgaggcgatcttcaccgcgctgcacgcgatcagcgccaccgcggtcgccggcggcgacacaccgccgccggcccgcatcgtgctgctctccgacggcggcgagaacaagccgtccaaccccagcgacccgcacgacggcgtctacaccgcggcgcgcctggccaaggacgagggcgttcccatctcgacgatcacgttcggcaccaagggcggcgagatcgagatggacgggcagaaggtggccgtccccgtctcgaccgaccagatgaagatggtcgccaagctgtccggcgggcagtcctacaccgccaccaaccttggcgagctgcagaagagctacaacgcgatcgagaacgagatcggctaccgcacggtgccgggaccgggcagcgcgggctggctgcggctcggcgtgctgaccgccctgatcgcgacggcgctggcgttgctcatcaaccggcgcctgcccacctagcgcgccggcaccgcttggtcaggcgggcagccggcggttcagcagcaggccggccaacacggcgccggccagcacgacggcgccgagcagcatccacgccatgctggcgtcgcccttgacggtctcgtagccgatctggcgctgcagcgtcgagtacacgttcttcaacgagtccaggctgtcggcgtggaacgcctggccgtcggtgatctcgcagatcttctgcagggtctggtcgtccaccggcaccgggatggtggcgccctcgtagtcgacggtgccgtacggggtgccgaaggagatggtggagatctgcacgccctcggccttggcggcccgggccgcggtgaacgccccctgcggggcgttcgggtccagcggcacgttctcggcgccgtcggactccagcacgatccgcgccggtggcgggccctcgccgccgcccatcaccgacccgaccgtcgcgatggcctgcaacgcggtgaaaatgccttctcccgtagcggttttcggcgccggctgcagactgtcgatacccgccttgaccgcggcccggttggtcgtcggcggcaccagcagcgtggcgttggcggcgaactcgaccagccccagattgatggccggcgtcaactggtcggcgaactgcttgccggcctccttggccgcggccagccggttgggcggcacatcggtggaggccatcgactccgacacgtcgatcaccagcatcaccaccgcgcggttgagcggaatgcggacgtcggacgtcgggccggccatcgcggtggtcagcagtaccagcgaggtggccagcaggatggtgggcacgtgccgccaccggctcgggtggggcggcgcgacgcgctcgagcacctccatgttggcgaaccgcagcacccggcgccgccgggcgaactgctgcaccacgtacaggccgatcaccagcagcacggccagcagcgccaggaagaaccacgggttctggaatccggtcaccgacaccggcccgagcaggggcaacttcatgtccagccacactatgcgtcaaacgggccggttgcatcgaccgccgcccgtacccgcggtgccgatgacaccggcggtcgcagacgacgcgacctggtctaggcgggccaagacgtcgacctacaggcgcggcatgtcgacgtccgtcctaattttcgcgttcacgtcgcgggtgtgagtgcaggcggcggtcgaggcgtgggcccctcattgagcggggtggcgaagcggatcgtctagcgtccacgaaagtaagccactttgttacgccaggagtacgaggcggccaccgcatagccgactacctcgcaccgcacgagaagccattgcagccaagggattccgatgatgaaaaccacgcagcacgcgccagtgataccgagcgctacgagataggccgtggcggcatgcctcgagcgtgggtgctgcctcaggatcaacaggattcgaccggtagagacaatgatgtacgcaagagccgcgatcattacgaaccagtagacgcggagccagggcgtgtgttctgtggccacaacatcgggaacacaggtctcgccgatgtcgcctgcgacgaagaccgcgatcatgacggcgcagatcacgaccgacggcagttccaaccggttccgaacgaaccacctgagctgacccggcgtcatgtcgcagtggtcagcgaccagatacatgatcgagaacaagccgtacacgtagagcagatggccgatgaggtcttcgaggttccacacgcccgtcatgtcgtggagcaatgggctcagccacccgtccaccggcccgagcgccaggaccaactgggcacacataaacgccagtgccaacactgctgctcgctcgaacgggatgtgccaggccaaacggatgctccacaaggcagctagcgcaatgaccaacgtggctgtggcgatgatgctcacagaggtcgatcgggtcgaggtctcaagtcactcaggcggaagggccgctcatcgtcgtctccggcgagcagcttgtccagcggaacatcgaccgcctgggcgatcgtaagtagctcactgtaggtgaactcgaccttgccatcgagcttgctagaaaggctcgggcggctgatacctgtctcgtgagaaagacgggtacgggacagcttgcggtcgcccatgatcatccgcaatcggctggccagggcggcggccgacacaggcgaatgcgaagacatgcccggcagggtagcagtctgaaccgacaaagcgcgggcaaaaccgatcaattcgtcggttttcccgccaaaccggaggatttcgtgcaatagtctccgccgtggctgaattggacatgcatacaacaccgcgatccgggacaccgcagcagaagtcggtggccgcgggcggggcgcccactcgtcggccccggtgtgcaaacgtcgtcctggtctggcattcgccggctgggtcggcgttgacgacggcgcaaggacggtcgagcgatgatccatgacgcggtcacctaaggaggccgccctgttcacgtttctgttgacccccgcgttcgtcggggcaagcgccctgatcgcggtcgtgaccctggtcgtgttggtagccctgctgctgaacgagcacaacggcgacgacaaggacgttgacatggaagacacctggtggtgacagggagcataaccacgccgaagcgaatcgcgtttgcccgcacggcaattggagcgatgcttacggacccgagagtggcggattaggcggatgacggtgagcttcagcgacggcatggactcgctgcgccagtacgcccagttctacgactatcactagggacgaagccatcgacatcatcgagaaggcagagcttcagctagagcagctgcgcacgtacgacgcttcgccgctcaccgaaattgtgcgcgagctgatcgcagagctgcggcgggcccgcgccgaggtagcgcggctgcggcacgtcggcgtggagacagccctaaagctgggcatcgtcaaacgcgaactgacgctcaagcggtccgaatgcgagcgattgaggagacagcatgatcacggagacgtaccaccccacggtgacggttagcggagcagccgaagaccgcgcacggccgctcagccgatcagcaccgcgtaccggggtttgatcacctcgtcgataatggccagccgctcgtcgaacgggatgaaggcggacttcatcgcgttgatggtgaacctttccagatcgctccatccgtagccgaaagcctggaccagccggtgcatctcgcggctcatgtaggtgtcgctcatcagccggttgtcggtgttgacggtcacccggaaccgggtgcgggccagcaggtcgaacggatggtcggcgatgcttttgacggccccggtctgcacgttggagctggggcacagttccaacggaattcgcttgtcccgcaagatgttcgccagtctgcccaaccgtaccttgcccttgtcggggccgtcggccagcacgtcgatgtcgtcgacgatccgcaccccgtggccgagccggtcggcgccgcagaacgcgatggcctcgtggatggacggcaggccgaacgcctccccggcgtgaatggtgaagcgcgcgttgtgatctcgcatgtagtcgaacgcctccaggtgccgggtcggcgggttgccggcctcggcgccggcgatgtcgaaaccgaccactcccttgtcccgccaccggatcgccagctcggcgatctcccgggacaccgccgcgtgccgcatggcagtcaccaacagtcgcaccacgatcggccggcccgctgccgcacaagccttctcgccgtcggcgaacccggccagcacggcgtcgacgatctcgtcgaaggacatgccgcggttgatgtgcagctcgggagcgaaccggatctcggcgtagaccaccgagtcctcggccaggtcctccacgcattcgtacgccacccggtgcagcgcctcgggggtctgcatcaccgccacggtgtgcgagaacggctccaggtagcgctccagcgagccgctgtgcgagcgggtgcgaaaccaggtcgccagctcctcgacgtcggtggcgggcagcccgtcgtagccggtctgtccggcgatgtccagcacggtcgacgggcgcagcccgccgtcgaggtgatcgtgcagcagagccttgggcgccttgcggatctgctcgagctccaatggtgcggtcatgtgacgatccgatcgatgatcagcggtcgcggcgccggcgcgccgtcgccgacgctccagccgccgtccagctcggccagcgcggcgccgaagcgttccggcgtgtcggtgtagagggtgaacagcggctccccggcggcgaccggctcgccgggatggcggtgaatccggaggccggcgccggcttgcacccgttcgcccggacgggatcttcccgcgccgagccgccaagccgccagccccactgccatcgcgtcgatatcgcccattgtgccgccccggggagcggtcacggtctcggagtgcctaccgatcggcaacggtaccgacaaatcgccgccctgagcggcgacgagacggcggaaccggtccatcgcggtgccgtcgcgcagggtgtcggcggggtcccggtcgccgaccccggccagcgcgagcatctcggcggccagccgcagcgtcagctcgacgacatcggccggcccgcccccggccagcacctcgagcgcctcggccacctccaacgcgttgccgacggtcgcgcccagcgggcggttcatgtcggtgagcagcgcgcgggtgggcaccccgtgcgcggcgcccagcccgaccatggtgtgcgccaggtcgcggcactgctcctcggtcttcaccaacgcccccgagccgaccttcacgtcgagcaccagcgcgccggccccctcggccagcttcttgctcatcaccgagctggcgatcagcggcagcgattccacggtggcggtgatgtcgcgcagcgcgtacagcttggcgtcggccggggccaggtcaccggcggcgaagatggccgccccgacctcgcgcagctgctcacgcacccgccggctgggcagctgcgcgctgaacccggcgatcgcgtccagcttgtccagggtgccgccggtgtggccgagcccacggcccgaggcctgcggcaccgccgccccgcaggcggcgacgaccggcaccagcggcagggtgatcttgtcgcccaccccgccggtggagtgcttgtccaccgtcggcacacccaggtcggagaagtccagccggtcgccggaggccagcatcgccgacgtccaggcggcggtctcgccgccgtccatgccgcgcagcaggatggccatcaacagggccgccatctgttcctcggccaccaggccgccggtgtaggcgtcgatcacccagtcgatggcggcgtcggacagccggccgccgtcgcgcttggtcctaatcaccgtgggcgcgtcgaacccgggccgcatcagtcccgcccggcggccagctggtcggggccgaacgcgtccggcagcagctcgccgagccggcgcggcccgcccggatggtcgatcagcagctccgggccgccgtgttcggccagcacctggcggcaccgcccgcacggcgtcagcaccgatccgcgcccgtccacgcacgccagcgcgaccagccggccgccgccgctcgcatacagggcgcacaccaccgcgcactcggcgcagagaccaaggccatatgagatgttctccacattgcaaccggtcaccacccgcccgtcgtcgaccagcccggccgcgcccacccggaaccgcgagtacggcgcataggcgcccgcggacacgtcgattgccttgtcccgcagtgcattccagtcaatgtccggcataacgaaaccccgctcagccacggcctgtaccgacagtcaccctagccggaaagcggcatttcgcttgacggacatcggcgcggggcgcgccgcgtgcgagctaagctcaagtgcccggcgtgaccgtcgcaagcaagaaggtcggaagaaggcggtgaggggtgacacaggggtgacaacacaaccgacaaccgcggatccggcgacaccggtatcggctcccgcgcgcaaacgcaggccaccacgcaccctgtaccggggcgaccccggcatgtggtcgtgggtgctgcaccggatcagcggcgcgacgatcttctttttcctgttcgtgcacgtcctggacgccgcgatgctgcgggtcagcccgcagacctacaacgcggtgatccacgactaccagatgccgatcgtcggggtgatggagtacggcctgatcgccgcggtgctcttccacgggctgaacggcatccgggtgatcctgatcgacttctggtccgaaggcccgcgccaccagcggctgatgttctggatcgtcggcgtggtgttcctgctgctgatggtcccggccggcgtggtgaccgtcatccacatgctggggcacttccgatgagcacccccgacctgcagctcggcccgggccagatcgccccggtcaaacagcgcttctacgaccgcccggccagcctggacaatccccgctccccgcggcgccgcgccggcatccccaacttcgagaagttcgcctggctgttcatgcggttctccggcgtcgcgctgttcgtgctggcgatcggccacctgttcatcatgctgatgtgggacgacggcgtgtaccgcatcgacttcaattacgtggcgcagcgctgggcgtcgccgttctggcagctctgggacctggcgctgctgtggctggcccagctgcacggcggcaacgggctgcgcaccatcatcgacgactacagccgcaaggacagcacccggttctggctgaacagcctgctgctgctgtcgatgggcttcaccctggtgctgggcacctacgtgctgctgaccttcgacccgaacatctcgggataggcgagtcatgatccaacaacatcgatacgacgtggtgatcgtcggcgccggcggtgccgggatgcgcgcggccgtggaagccggcccgcgggtgcgcaccgcggtgctgaccaagctctaccccacccgcagccacaccggggcggcccagggcggcatgtgcgcggcgctggccaacgtcgaggaagacaactgggaatggcacaccttcgacaccgtcaagggcggcgactacctcgccgaccaggacgcggtagagatcatgtgcaaggaagccatcgacgcggtgctcgacctggagaagatggggatgccgttcaaccgcacccccgagggccgcatcgaccagcgccgcttcggcggccacacccgcgaccacggcaaggccccggtgcgccgggcctgttacgccgccgaccgcaccggccacatgatcctgcagacgctctaccagaactgtgtgcggcacgacgtgcagttcttcaacgagttctacgcgctggacctggttttgacgcagacacccagcggcccggtggccagcggcgtggtggcctacgagctggccaccggcgacatccacgtctttcacgccaaggccgtcgtgctcgccaccggcgggtcgggccggatgtacaagaccacctccaacgcgcacaccctgaccggcgacggcatcggcatcgtcttccgcaagggacttcccttggaggacatggagtttcaccagttccacccgaccggcctggccggattggggattctgatctccgaggcggtgcgcggcgagggcggccggctgctcaacggcgagggcgagcggttcatggagcgctacgcccccaccatcgtcgacctggcgccgcgcgacatcgtcgcgcgctcaatggttttggaggtgctggagggccgcggcgccggaccgcacaaggactacgtctacatcgacgtgcgccacctcggcgaggacgtgctggagtccaagctgcccgacatcaccgagttcgcccgcacctacctgggcgtggacccggtgcacgagctggtgccggtgtacccgacgtgccactacgtgatgggcggcatccccaccacggtcaccggacaagtgttgcgggacaacacctccaccgtgccgggcctgtacgcggccggcgagtgcgcgtgcgtgtcggtgcacggcgccaaccggctgggcaccaattcgctgctggacatcaacgtgttcggccgccgggccggcatcgccgcggccaactacgcccggggccacgacttcgtggacatgccgcctgacccggcggcgatggtggtgcgctgggtcgccgacatcctctccgagcacggcaacgagcgggtcgccgacatccgcggcacgctgcagcagtcgatggacaacaatgcggcggtgttccgcaccgaggagacgctcaagcaggcgctgacggacatccacgcgtgcaaggagcggtactcgcgaatccgcatccacgacaagggaaaacgattcaacagcgacctgctggaagccatcgagctgggcttcctgctggagctggccgaggtcaccgtggtgggggcgctcaaccgcaaggagtcccgcggcggccacgcccgcgaggactatcccaaccgggacgacgtcaactacatgcgccacaccatggcctacaagcagggcaccgatctgctgagcgacatcgcgctggacttcaagcccgtggtgcagacgcgctacgaacccaaggaacggaagtactgaatgtctgtcgagccggacgtcgaaaccttggaaccgccgctgccgccggttcccgacgaagcggtgatggtgaccgtcaagatcgcccggttcaaccccgaccagcccgacgcgtatgcggaaaccggtggctggcaaagctttcgggtgccgtgcctgcccagtgaccggatgctcaacctgctgatctacatcaagagctacctggacgggacgctgaccttccggcgttcctgcgcgcacggggtgtgcggctcggacgccatgcgcatcaacggtgtcaaccggctggcgtgcaaggtgctgatgcgcgatctgctgcccgagcccaagaagggcaagccgggcaagccgctgaccatcacggtcgagccgatccgcgggctgccggtggaaaaggacctggtggtcgacatggagccgttcttcgacgcctaccgcgcggtcaagccgtacctgatcaccaccggcaatccgcccacccgcgagcgcatccagagtccggccgaccgggcccgctacgacgacaccaccaagtgcatcctgtgcgcggcatgcaccaccagctgcccggtcttctggcacgagggcagctactacggcccggccgcgatcgtcaacgcgcaccggttcatcttcgacagccgcgacgagggcgccgccgagcggctggacatcctcaacgaggtcgacggcgtgtggcgctgccgcaccacgttcaactgcaccgatgcctgcccgcgcggcatcgaggtgaccaaggccatccaagaggtcaagcgcgccatcatgttctcccgctgatcgctcgagcttttgcccccttctgcccgcgagcgtccccttctgcccgcgagcgtcacgttttgcccgcgagcgtctccttctgcccgcgagcgtcacgccagcgtggcagtcgacgccgagcgtcacgccagcgtgacgcccgcgccgcggccagaaggttccaggcgccgtcacacatcgcgggcctgcctcgtctgatcggtatgacacagaaaactcgcatcgaacccctgccccctcagcgcgccgggctgctgacccgggccatgtaccggatcgccaagcggcgctacggccaggttcccgaaccgttcgccgtcgccgcgcatcaccgcaggctgatggtcgccagcgccgtgcatgaaaccctggtcgaccgggcgtccaagacgctgccggccagcgtgcgcgaactcgcggtgtactggaccgcccgccagatcggctgctcgtggtgcgtcgacttcgggtccatgctgcagcgcctcgacggcctggacatccagcggctcaccgagatcgacgactacgccacctcaccggcgttcaccgacgacgagcgcgccgccatcgcgtacgccgccgcgatcaccaccgacccgcacaccgtcaccgacgagcaggtcgacgatctgcgcgcccggttcggcgatgcgggcaccttcgagctgacctatcagatcgggctcgagaacatgcgggcgcgggtgaacgcggcgctcggcatcaccgagcagggcttcaattccggtgacgcgtgccgcatcccgtgggccacgggcgacacggaaactagcgacccagcggcgaaccggtgaacttgtccggattggcgatatcccagagcgcgcagacctttctctcgcgcaccgtcatcgccatgatccgcgggcacatctcccgatagccgtcaccgcccggcaggcccgccgtgtagatgcccagctcgccgttgaccagccccagctggtaggcggaatagaagccggggccgtagcggcgggccaggccgagcatgaaccgcaccaccttgtccgcgccgtggatgacctgaacggcggtgggcgccttgccattcgagtcgccggtgaacatcacgtcggggtgcagcagcgccaccacggcctccaggttgccggcggccatggcggccatcagctgtcccaccacctcgtcgtgcgacgggtcgggctcgggtggcggctgcgcgctgacgaccttgcgcgcccgcgacgccagctgccgggcggcggcctcgctggtgcccagcacctcggccacctccgagaacggcacggcgaacccgtcgtgcagcacgaacgccacccgctgatcgggcgacaaccgctccagcaccaccatcgccgcgaaccgggcgtcctcgccggccaccacggcggccagcggatcggcgccggaatgcgggcccaacccggtgaccaccggctcgggcagccagttgccggtgtaggtctcgcggcggtgcgtggccgagcgcaacctgtccaggcccagcctgctgaccaccgtggtcagccacgctcgtagatcggtgatggcgccgtcctgcccgtgccggcgcagccacgcgtcctggacgatgtcctcggcgtcggcgaccgtaccggtcagccggtaggcgaccgacatgagcacctctggctgcacttcgcccggcacggcccggacatcacgccgccgatcatcacccgcggccacggcgtcaccatctacgacgaccgcggcaacagctacctcgacggcctgtccgggctgttcaccgtgcaggtcggccacggccgcgccgaactcgccgaggccgccgcccggcaggcgggcacgctggcgttcttcccgctgtgggggtacgccacgccgcccgcgatcgagctcgccgagcggctggccggctacgccccgggcgatttgaaccgggtgttcttcaccaccggaggcaccgaggccgtcgagacggcgtggaagctggccaagcagtacttcaagctcaccggcaaacccggtaagcacaaagtgatttcgcgcgcggtcgcctaccacggcaccacccagggcgcgctggcgatcaccggcctgccgcgctacaaggcgccgttcgagccggtgacgcccggcgggttccgggtgcctaacaccaacttctaccgggcacccgaagcattcgccaacgaccccaagggttttgggctgtgggcggcggaccggatcgccgaggcgatcgagttcgagggccccgacaccgtggccgcggtgttcgtcgaaccggtgcagaacgcgggcggcagcatcccgccgcccccaggctatttcgagcgggtccgcgaaatctgcgaccgctacgacgtgctgctggtctccgacgaggtgatctgcgcgttcggccggatcggctcgatgttcgcctgtgccgacttcggctatgtgcccgacatgatcacctgcgccaagggcatgacgtcgggctactcgccgatcggcgcgatgatcgccagcgagaggttgttcgagccgttcgacgacggcgacaccatgttcccgcacggctatacctttggcggccacccggtttcggcggcggtcgggctggtcaacctcgacatcttcgagcgcgaggggctcaacgaccgggtcaggaccctggcgccgacattccgcgccactctggaaaagctgtacgacctgcccatcgtcggcgacgtccgcggcgagggcttcttctacggcgtggaactggtcaaggatcgggccaccaagcagaccttcaccgattccgaacgccgcgcgctgctgggacgggtcggtgccgcgctgttcgaggccggattgtattgccgtaccgacgatcgcggcgattccgtcatccagctggcgccgccgctgatcagcggtcaggccgagttcgacaccatcgaggcggcgctgcgcggcgtgctcagcgacgagtgccgccggctgtagccagcacccgcttgacctcgtaggcggccaacagcacctcgcgggaatgcgccgccgacgggctgttcgcgatccgcgattgcgcgttgcacagccaggtgagcgccgagcgcaggtcgccctcgggggcggcgtcgcggtgcaccttcagctcggtgagcatccggtcctggccggggccgcgcacctgggttcccttctccacctgcttgagcagctgttccaacgatcgcgggccgtcaccgccgcgccgccatcgggaccagaaccgctcgttggaaatggcacttcctcgggattcggggcggccgatcggcttcggactcgccgcgcgcccagcctaacccgcgcccgccgcggccgctgagtaacttccgcctcagcagtcacagcgcggctccccggattcgggcccccgatcgcttactgtgcacagacgatgtcaacttcagggaccctggtacgttccgcatcatgcctggcagcggcgcttttcctggcggccgcgccggcggtgtcgggcacggcgtcgccgctgggacgggccgagcccggcgccgaacccaatgccgcgccggcgaactgcccgtacaaggtgaacaccccgccggccgtggattcctcggaggtccccaccgccggtgacccgccgatgccgctggcggtgcccgccaagccggtcggcggcgacgccctgggcagctgcggcatcgtcgccgcgcccaacacgccgccgctgcccggcgacgtgtccgccgaggcctggctggtggccgacctggacagcggcgcggtcatcgccgccaaggacccgcacggccggcaccgcccggccagcatcatcaaggtgctggtcgcgatggccgccatcaacacgctcaacctgaacaaggcggtgcccggcaccgccgacgacgcggccgccgagggcaccaaggtgggcgtcgaggagggcggcgtgttcaccgtcaaccagcttctgcacgggctgctgatgcactccggcaacgacgccgcgcacgcgctggccatgcagctgggcggcatgcagcaggcgctggagaagatcaacgtgctggcagccaagctgggcgggcaggacacccgggtggccacaccgtcgggtctggacgcgccgggcatgagcacctcggcctacgacatcgggctgttctaccgctacgcctggcagaacccgaccttcgccgacatcgtcgcgacccgcaccttcgacttccccggccacggcgaccacccgggctacgagctggagaacgacaaccagctgctctacaagtatccgggcgcgctgggcggcaagaccggctacaccgacgacgcgggccagacgttcgtgggcgcggccaatcacgacgggcgacggctggtggcggtgctgctgcacgggacgcggcagccgatcgcgccctgggagcaggccgcgcacctgctggactacgggttcgccacgccgcagggcacccaggtcggctcgctgatcgcgcccgacccgtcgctggcgccggccaagcgcgacggcgccgccgaccggctggccggcaacgccgcggccgccgggatgatctcctcggccgacgcgctcccggtccgggtgggggtggcggtgatcggcaccatcgtggtgttcacactgatcatgatggcccgctcgatgaaccgccgaccccagcacagctgagcaccgtggcacgcggatcgcggcgcggcctgctggtcgggctgaccgccgccagcgtgggcgtcatctacggttacgacctgtccatcatcgccggcgcgcagttgttcgtcaccgaggacttcggcctgtccacccggcaacaggaactgctgacgacgatggcggtgatcggccagatcggtggggcgcttttcgccggggtgctcgccaacgcgatcgggcgccagcggtcggtgctgctgatcctgtccggctacgcggttttcgcgctgctggccgcgttctcggtgggtctgccgatgctgttgaccgcgcggctgctgctgggcctgaccatcggcgtgacggtggtggtggtgccggtttacgtggccgagtcggccccgacggcggtgcgcggcgcgctgctgacggcctatcagctggcgatcgtcagcggcctgatcgtcggctacctgagcgggtatctgctggccgacacgcacagctggcgctggatgctggggctggcctgtgttcccgcagtgttgttgctgccgttggtgtttcggatgcccgacacggcgcgctggtatctgctcaagggccgggtcgacgacgcgcggcgggcgctgctgcgggtggaacccgtcgcgcgggtggacgacgagctggccgagatcgaccgcgcggtgagcgaggaagccgcgagcctgccggccatgctggccgagatggtgcgcagtccctaccggcgcgccaccgtcttcgtggtggtgctggggtttctgattcagatcaccggcatcaacgcgatcatctactacagcccgcggatcttcgaggcgatgggcttcaccggcaatttcgcgctgctggcgttgccggcgctggtgcaggtcgccggcctggtcgcggtgggcaccgcgctgctgctggtcgaccgggtgggccggcggccaatcctgttgtgcggcaccgccatgatgatcgtggccgacgtggtgctggtggccgtgttcggccgcggcccgggcggcgtgatcgccgggttcgccggggtgctgttgttcatcttcggctacaccatgggtttcggctccctgggttgggtgtacgccagcgagagcttcccgtcgcggctgcggtccatcgggtcgagcaccatgctgacctccaacctggtggccaacgccatcgtggccgcggtgttccttacgctgctgcattccttgggcggcgcaggcactttcgcggtgttcgcggtgctcgcggtggtcgctttcgcattcgtccaccggtacgcgccggagaccaagggccgccagctcgaggacatccggcacttctgggagaacggcggccggtgggactgatcgccgcggggacgatggtggcatccgggcgggtccgccgcccgggctgggtcgagacgtccggcgggcatatcgcggcgtgcggcaccggcccgccgccgcgcccggccgaccgcgagttccccgatggcacgctggtgcccggcttcgtcgacatgcacgtgcacggcggcggcggcgcctcctacaccgagcccgacggcatcgcgaaggccgccgccttccatctgcgtcacggcaccaccaccacgatggccagcctggtgaccggctcgccggccgagctgctgggcggggtgcgcgcgctcgccgaggccacccgggatcgcacggtcgcgggcatccacctggagggcccgtggttgagccgcgcccgctgcggcgcccacgacgcccgccggatgcgcgaccccgacccgcacgagatcgacgcggtgctcgacgccggcggcggcgcgatcaggatggtcaccctggcgcccgagctgcccggggccgacgcggcgatccggcgtttcgcggacgcgggagtcgttgtggcagttgggcatacgaatgccgactaccggcagacccggcacgccatcgcgctgggcgccactgtcggcacgcatctgttcaacgcgatgccgccgctgcatcaccgcgagcccggccccgcgctggccctgctgcgcgacccgcgggtcaccgtcgagctgatcgccgacggcgtgcacgtgcatcccgacgtggtgcacgcggtgatcgacgcggccgggccggagcgggtcgcgctggtcaccgatgcgctcgcggccgccggccgccccgacggcgcgttccggctgggcccggtgcacatcgacgtcgtcgccggcggtcgcgcgggtgcacgggacgacgacgatcgcgggcagcaccgccaccatggaccggctctttcgcaccgtggccgggtcaggcgccgaccgcgacgccgcgctcgaggccgcggtgcagatgacgtccacgacgccggcgcgcgcgctggggctcgatcgggtgggcagcctgcaggccggccctgaggccaatcttgttgtgctggacgctgattggcgggttagggccgtcatagcccgcggcgactggctggccgacgcgtagcgatcttgtaacatcggtgccgtcagcaactgacaccggacgaggggccccgtacccggccagcgacaagacggcgccgtggaggtgcgcaatggcctggctgatcctgatcgcctcgggtgtgctggaagcggtgtgggcgaccgcgctgagccggtccgagggtttttcccggctcggcccgtcgctggttttctttgtggcgctggcattttcgatgaccgggctggcggtcgcgatgcgcagcctgccggtcggcaccagctacgcggtctgggtgggcgtcggcgccgcgctcacggtgacctatgcggcgctggtcggcgacgaaccggcgtcgccggtcaagctggtgctgatcgccgggatcgtggcctgcgtcgcgggactgaagctgctcggctagcggcgccggcgggtgagccggtcgaacgccagcgccgcaacggctcccaggcccatcgcggtcagcgtctggcgggtgttcagcccctcgtccaggtgcacccgcggcgcgatgatcgccggcgccggaggggcgacgggccgatcacgcggatcggtggacgcggtcgccgcccacgccgtgcagaacagcacgagataggctgtgatgtaagcgaataccatcaacccgagcaccgggccgaaggcggcgccggccgggctgcgcagcaccgtccgcagatagatcgacgcgacctgtttgaacacctcgaagccgatcgcggcgatcagcccggcccgcatcgaatccacgaaactgaccttctcccgcggcagccgggcgatcatccaggtgaacagcagccacgacaccagcgtcgcgatcagtatggagaaaatccagaacagccagtcgaagaccacgaactgcggtatgccaagccatttcagcagcgcggccatgggtgcggcgtggccgacggtggtcagcccgacggtggccacgatgaccgcgaacgtccccaccatggccagcaggtcggagagcttgttgcgcacgaagcccggcgactcgatctgggtgtcccaccacatctcggtcaacgcctggcgcagatgcgatatccagcccagccccgcccacaccgcggtggccaggccgatcaccccgaccgacgtccgggcatcgatcgccgagttcatcaactcctgcagctgatttcccagcgccccgttcacttgcgagcggatgtggtcgtcgatgctgctgagcagttgcggccgccgcgccagcacgaaaccgaacaccgcgaaaccgaccatcagcaacggaaacaacgcgaagatcgtgtaatacgtcaggcccgccgcgaagaagccgccgttgcggtcgtcgaatcgctggtaggcgcggatgaggtgatccagccagccgtgccgggcccgcagccgatcaagaaaccccgcctcggccggctcgctcatcgtggaacttcttacccccgtcgcggaaggaacccaagccgatcgtaaacccgttcgacggttttcccggcgacatcctgggcccgttgcgccccggccgccagaacggcctccaattcggccgggtcggccatcaattcgtcgacgcgggccttgatcggggtgacgaactcgaccaccgcgtccgcggtgtccttcttcagatcgccgtaaccccttccggcgtagccctgcacgagcttgtcgatgtcgacgccgctgaccgcggactggatgctcagcaggttggacactcccggcttggcgtcggtgtcgaaccggatctcccgctcgctgtcggtgaccgcggagcgaatcttcttggcggacaacgccggatcgtcgagcaggttgatcagcccggcatcggtggacgccgacttgctcatcttcgacgtcgggtcggccaagtcgtagatcttggcggtgaccttggggatgagcatctccggcaccacgaacgtgtccgggaagcgggcgttgaaccgctgcgccacgtcgcgcgccaactccaggtgctggcgctggtcctcgccgacgggcaccaggccggtgtcgtaggccagcacgtcggcggcctgcagcaccggataggtgaacaggcccaccgtggtggagtccgcgccctggcgcagcgacttgtccttgaactgcgtcatccgcgaggcctggccgaagccggtgaagcagcccagcacccaggccagctgggtgtgggcgggcacgtggctttgcacgaacacggtgctgcgggccgggtcgatgcccagcgccaggtactgggcggcggtgaccagggtccgccggcgcagcgccgcggggtcctgggcgatggtgatggcgtgcaggtcgaccacgcagaagaacgcgtcccagtcgtcgccccagtcgtcctgcagggtcacccactgcgagatggcgcccaacgcgttgcccaggtgcagcgaatcggacgtgggctggacgccggagaaaatccggcgggatccggtggcggtgctcatgatgcaccgatcttttcacgcctcgtctcccgcgccgtgccgcggcccgcacggaccgctgcccgcgccgcccaccaaacttgcggtaccggcggtaccgcatttaatgtcgcggtatgacgactcgtgcgcccatccacctcggccccaaggatggttccggggagccggtcgtgctgctgcacgggttcctgatgtcgcagacggtgtggcatccggtggcgccgcggctggccgacaccggccgttacgaggtcttcgccccgaccatggccggccacaacggcggaccgtacgcgggcacctggctgctcagctcgtcggtgctggccgaccacgtcgaacgtcagctcgaccggctcggctgggacagcgcccatctggtgggcaactcgctgggcggctgggtggccttcgaactcgagcggcgcggccgggcgcgcagcgtcaccggcatcggcgccgccggcggctggacccgctggagcccggtcaagttcgaggtgatcggcaagttcatcgggggcatgccgctgctgttgctggcccggctgctcggccaacgcatcctgcagttgccgctgagccggcggctggcgacgctgccgctgagcgccacgccgagcggggtcagcgaccgccagctgtccggcgtcatcgaggacgccgcgcactgcccggcctatttccagctgctggtcaagtcgctgctgcagcccgggctgctggagctggcgcagaccgcggtgccggtgcaactggtgctgtgcgagaaggaccgggtggtgccgcccagcaggttcagccggcacttcaccgaccacctgccgccggagacgaggatcaccaggctcgacggcgtcggacacgtgccgatgttcgaggcgcccgagcgggtcacaacggtgctcaccgacttcatcgacgactgcgtggcccgctcccagcgccagcagccccccgctagttagtcagctcccgccgcaggttctcggcgatcgagttgaggaattcctcgctctgctgccacttttggtcggggccgatcaggatggcgaggtccttggtcatcttgccgctctccacggtggagacgacgacgcgttccagggtctgcgcgaactcgaccacctcgggggtgtcgtccagcttgccgcggtgcgccagcccgcgcgtccaggcgaagatcgaggcgatcgggttggtcgaggtcggcttgccggcctggtactgacggaagtgccgggtgacggtgccgtgcgcggcctcggcctcgaccgtcttgccgtcggcggtcatcagcaccgaggtcatcagccccagcgagccgtaaccctgtgctatcgcgtcggattggacgtcgccgtcgtagttcttgcaggcccacacgtagccgccctcccatttgaggcaggccgccaccatgtcgtcgatcagccggtgttcgtaggtcagtccctcggcttcgaactgctccttgaattcctcgtcgtagatgcgctggaactcgtccttgaacatgccgtcgtaggccttgaggatggtgttcttggtcgacaggtacaccggccatttggcgttcaggccgtacttgaacgacgcgcgggcgaagtcgcggatcgactcccggaagttgtacatccccatcaccaccccgccgtcctcggggatggacaccatctcgtgcacgatcggctcgctgccgtcggcgggagtgaaggtgatcgcgacggtgcccggcttgtccaccttgaagttggtcgaccggtactggtcaccgaatgcgtggcggccgatgacgatcggcttggtccagcccggaaccagccggggcacattggatatcacgatcggctcgcggaagatggtgccgcccaagatgttccggatcgtcccgttcggggacagccacatcctcttgaggttgaactcccggaccctcgcctcgtcgggggtgatcgtcgcgcacttgacgcccacgccgtgcttcttgatggcatacgccgcgtcgatcgtcacctggtcgtcggtgcggtcgcggtgctcgatgcccaggtcgtagtagtccaggtcgatgtcgaggtagggaaggatcaagttctccttgatcatcttccagatgacccgggtcatctcgtcaccgtcgagctcgacgacgcggcccttgaccttgatcttggacgtgttggcggggttggacatgtcagcgctgcgacgcggccagcgcctcgttgaacgtcttgctcggccgcatcaccgcggtggtcttctcgctgtcgggctggtagtagccgccgatgtcgaccggccggccctgcacctcggcgagctcctcgacgatccgctgctcgttttcgcccaacgacgcggccagcgcggcgaaatgccggcgcagctcgtcgtcgtcgttttgcgcggcgagctcttgggcccagtacagcgccaggtagaactggctgccccggttgtcgagctcgccggtcttgcgcgacggactcttgttgttctccaacagctttccgatggcggcatccagcgtcttgcccagcagcttggcccgctggttaccggtcttgatgccgatgtcttcgaaacacgctcccagagccaggaattcaccgagggagtcccaccgcagatggttctcctcgacgagctggtgcacatgcttgggcgccgacccgccggctccggtctcatacatgccgccgccggacatcaacggcacgatggacagcatcttggcgctggtgcccagctccaggatggggaacaggtcggtcaggtagtcgcgcaggatgtttccggtgacggcgatggtgtcctggccgcgcatggcccgttccagcgtgtagcgcatggcccacacctgcggcatgatctggatgtgcaggccctcggtgtcgtgctccttgaggtattccttgaccttcttgcgcagctcgacctcgtgcgggcgttcggtgtccagccagaacaccgccgtcatccccgagttgcgggcccgggtgacggccagcttgacccagtcccggatcggttcgtcgcgcacgatcggcatccgccagatgtcgccggtctcgacgttctgggtcagcaggacctcccccgtgtccaggtcgacgatgttggcgacgccgtcctcggggatctcgaatgtcttgtcgtgcgaaccgtattcctcggcctgctgcgccatcagcccgacgttgggcaccgtgcccatggtcgccgggtcgaacgcgccgtgggttttgcagaagttgatgatctcctggtagatccgggaaaaggtggactcggggttgacggccttggtgtccttctgccgcccgtcggcgccgtacatcttgccgccggcgcggatcatcgccggcatggacgcgtccacgatcacgtcgctgggcgagtgaaagttggtgatgcccttggccgaatcgaccatggccagctcgggccggtgctcgtggcaggcgtgcaggtcgcggatgatctcgtcgtgcagcgacgccggcagcgactcgatcttgctgtagaggtcgaccagcccgttgttgacgtcgacgccgagctcgtcgaacagcgcctgatgcttggcgaaggcctccttgtagaagaccttcaccgcgtgcccgaagacgatcgggtggctgaccttcatcatggtcgccttgacgtgcagcgagaacatcacgccggtctcgtaggcgtcctgcatctgctgctcgtagaactcgaccagggccttcttgctcatgaacatcgagtcgatgatgtcgccggtgcgcagcgagaccatcggcttgagcacgatcgtcttgccgctcttggtctccagctccatcttgacgttgcgggcgcggtccagcgtcatcgacttctcgccgtggtagaagtcgccgtgcttcatggtcgcgacgtgggtgcgcgaggccggcgaccactccgccatgtggtgcgggtgcttgcgggcgtactccttgaccgccttgggtgcgcgacggtccgagttgccttgccgcagaacgggattgaccgcactgcccaggcacttggcgtagcgctcgcggatctcgcggtcctcgtcggtcttcgggctctgcgggaagtcggggatcttgtatcccttgccctgcagctccttgacggcggcgatcagctggggcaccgaggcgctgatgttgggcagcttgatgatgttggtgtcggccagcttggtcagccggcccagctcggccaggttgtccggcacccgctgctcttcggtcaggtgctcggggaactcggccaggatgcgagccgccaccgagatgtcgctggtcttgatctcgatgcccgccggttcggcgaaggcccgcacgatcggcaggaacgcgtaggtcgccagcagcggcgcctcgtcggtcagcgtgtagatgacggtcggcttctcggcgctcacggtccctctcccggcgtcaatgatgggttcgcattgtggggctcagcaatctatctgccacgttatcaagggtgtttggacaggtgtcggggcgcgtctgcccgcatcaccgccggctcaccgccgggtcgccaccggggagttggcaccgggtcggcacagtaagatagtctttgtatcggtcatgagcgccagcatcaagccccggcttgctggccggcaaccctccaaccgcggtggggtgccccgggtgatgaccaggttgagtagccaccacaaccggctatccggcaagcgcgggtccgccatgacgggcccctgagcagacagggaaacgtgatgcgcattcactcggttcatcggcaagctcgatcgcgcccgcgcgtgcgtcgctgctgacggctgcccgccggattcttcttccgacttcttccgaccgacttcttccgaccgagagaaagcacccccgtgagctccgagaacaccgatcacgacaccgaccccagcgcgcactggtcgttcgagaccaagcaggtgcacgccggccagcaccccgactcggccaccaacgcccgggccctgccgatctaccagaccacgtcgtacaccttcgacgacaccacccacgccgccgccctgttcgggctggaggtgccgggcaacatctacacccggatcggcaacccgaccaccgacgtcgtcgagcagcgcatcgccgccctggagggcggggtggcggcgctgtttctgagctccggtcaggccgctgagactttcgccatattgaacctggcaagtgccggagatcacatcgtctccagcccgcggctctacggcggcacctacaacctgttccactattcgctggccaagctcggtatcgaggtcagcttcgtggaggatcccgacgacctggattcctggcaggccgcggtccggccgaacaccaaggcgttcttcgccgagaccatctccaacccgcagatcgacatcctggacatccctggcgtctcgggcgtcgcccacgccaacggcgtgccgctgatcgtcgacaacaccatcgccacgccgtacctgatccagccgttcgcgcacggcgccgacatcgtggtgcactcggccaccaagtacctcggcggtcacggctcggcgatcgccggcgtgatcgtcgacggcggcaccttcgactggacgcagggccggttcccgggcttcaccacccccgacccgagctaccacggcgtggtgttcgcggagctggggccgccggcgtacgcgctcaaggcccgcgtgcagttgctgcgcgacctcggctcggccgcggcgccgttcaacgcgttcctggtcgcccagggcatcgagacgctgagcctgcgcatggagcggcacgtcgccaacgcgcagcgggtggccgagttcctggcctctcatgacggcgtgctgtcggtgaactacgcgggactgcccggctcgccgtggcacgagcgggcaaagaagctggcgcccaagggaaccggggcggtgctgtcgttcgagttggccggcggggtggaggccggcaaggcgttcgtgaacgcgctgaagctgcacagccacgtcgccaacatcggcgacgtccgctcgctggtcatccacccggcctcgaccacgcacgcccaactgtccccggccgagcagctgagcaccggggtcagcccgggcctggtgcggctggcggtcggcatcgagggaatcgacgacatcctggccgacctggagctcggtttcgccgcggccgccaaattcggtgcgaacgcggacacctccggcgccgacccgcacgccgtggcggcgttctgacggacccggccatgaccatccccgacgttcccacccagacgctgcccgacgaaggcgaaatcggcttcgtccacatcggctcgctgaccaccgaggccggtgcggtgatcgacgacgtgcacatcgccgtgcagcgctggggcgagttgtcgccgacgcgggacaacgtggtggtggtgctgcacgcgctgaccggtgactcacatgtcaccgggccggccgggcccgggcatcccaccggcggctggtgggacgagatggtcgggccgggcgcgccgatcgacaccgaccgctggtgcgcggtggccaccaacgtgctggggggttgccgcggttccaccggcccgagctcgcggacccgcgacggaaagccttggggctcaaggtttccccggatctcgattcgcgatcaggtggaggccgacatcgcggcgctggccgcgctgggcatcgacgaggtggccgccgtggtgggtggatccatgggcggcgcaagggctttggagtggatcgtcggtcacccgagcagggtgcgggccgggctgctgctggcagtgggcgcgcgcgcgaccgccgatcagatcggcacccagtgcacccagatcgcggcgatcaaatccgatccgaattggcagggcggcgactatcacgacaccgggcgcacgcccgacgccgggctggcgatcgcgcggcgcttcgcgcatctgacctaccgcggcgaggtcgagctcgacacccggttcggcaacgacgcgcagctcgacgaggatcccgccaacagcggccggtacgcggtgcagagttatctcgagtaccagggcgtcaagttggtggagcggttcgacgcgggcagctacgtggtgttgaccgaggcgctgaacagtcacgacgtcggccgggcccgcggcggggtgcgcaaggcgttgcgcagctgtccggtgccggtggtggtgggcggcattacgtcggaccggctgtacccgctgcgtctgcagcaggagctggctgagcagctgccgggctgcgccgagctgcaggtcgtcgactccatctgcgggcacgacgggttcctggtggagtccgaggcggtcggcgaaatgatccgcaagacactgctgttggccggttcgcagagcgccggcccgggcggcgccggcccggggagcaggaaaggcacgacccgccggtgacccgctcgcgccacgaccgctccctctcgttcggctcggcggccgcagcctacgagcgtgggcggccctcctatccgccggaggcgatcgactggctgctgccggtcggcgcgcgtcaggtgctcgacctcggcgcgggcaccggcaagctgaccacccggctggtggaacgcggcctggacgtggtggccgtcgacccgattccggacatgttggaggtgttgcggagctcgctgccggagacccgggcgctgctgggcaccgccgaagaaatcccgttggaagacaacagcgttgacgtggtgttggtggcgcaggcctggcattgggtggatccggagcgggcgattccggaggtggcccgggtgctgcggcccggcgggcggctcggcctggtgtggaacacccgcgacgagcggctgggctgggtgcgcgaactgggccgcatcatcggaagcgacggcgacggccgcacccacgtgacgctgcccgagccgttcaccgacctggcgcaccatgaggtcgagtggacgaattaccttacgccgcaagcattgatcgacctggtggcgtcgcgcagctactgcatcacctcgccgaccgaggtgcgcacccgaaccctggaccaggtccgccacctgctggccacgcatccggcgctggcgaattcgaccggcctggcgctgccctacgtcacccggtgcacccgggcgacgctggccggctgagcgccgggtcaatcgggttcgtccccgtcaacttcgccgtcgtcgtcctcaccctgtaggagtttttcggggtggtggaaggtgttggtgcggggttggtttcggtccaggtggggtggtggaatccattcggtttcccctttggcgtttttgtgggtggtccaggcgccgggttgtagcaggcggtggtggggtccgcaggcgaaggtcagatcgttgatgtcggtggtgtggcaggtggcgtagtcggtgcagtgatgcacttcgctgtagtagccggggatggtgcagccgggggcggtgcagccgcggtctttggcgtataacacgatgcgctgtgcgggtgaggccaggcgtttggtgtgatacagggccagggctttgccctggtcgaaaatcgcgaggtagtggtgggcgtgccgggatagccggatcacatcggacatgggtagcagggtgccgccgccggtcagacgccgtccggcggcggtttcgaggtcggccagggtggtggtgacgatgatggaggccgggagcccgttgtgttggccgaggtttcctgaggcgagcagggcgcgcaggccggccagcagcccatcgtggttgcgctgggccgccgagcgggcatcaccgtcgatggcgtgttgactcggagtgccttccacgcacggactctcatcgagtgggttgcacatgccgggggcggcgagtttggccagcaccgcttccagggtggcgcgcagctcgggggatagccagccgcggagttcggacatgccgtcggcgtgctggttgcccagggtgaggctgcggcggcgggcgcggtcttcgtcgcggtagaggccgtcggggttgaggcaatcggccagcgtgcccgccaacgcggcgagctgttcgggccgataccgggtgccttccctggccaggtcggcttcggcgcgttcccgggttgcctggtcgatccagcccggcaactggtggcagaacttacggatcaccgccacctgctcgagacccaacgacccctcccgttgccgcgcggcggtggcggccagcagcggaggcaacggttcgccggtcaacccgacgcgggggcccaaatcagcggcggtgtgcacccgccgggcggcctcggcgcggctgatcagcgtggcctcggcgatcgcatgcgaaagccggccacccaactccgccgggctggcgtcgcgggccagcgcgttgatcagcggatgctcggggaccggcaggcgtcggcgcaccgtctcgcagcgctgcaacaacgatagacactcgcggggcgtcaacgcgtcaaaactcaactcgcccaagcggtcgaccgcagcatccagcgcatcgaagaccttgacgatctcttcacgactgctgcagcccatgcctcgaagtgtatgaaggggcaccgacaagaatcgccgcaatgtgaccacagaaaccaaagtgacacaagggatttcaccggcccgcggcgccgagggagccgcggtcgtcgagcagtcggtgcgtccacaatggcgacgaatcacttgcccggcaaccgacttccgggccggccaataatccacctcgccgacgccgcggccttacgaaacgcttattgtgcgaacctttatcccaccgtgtcgtaaacgtgacagtgatggctcagagttcgtagggcgtgattcgagtgccgtcggtgcactccaggcggacggggaggctggcgtgaaggcacttgcacgaactcatcaatggatctgggttttgcgccaccagcccttcaccattcggctgctggccgcggccgccggcctgctcacggtggcgtcggcgttcgcggcgccggccggggcggagggaaacggcgacgacttcatcgacgcgctcaaccacgccggcatcgacttcggcgaaccgggaaacgcgatggccgtcggcgagtcggtctgcccgatgctgtcgcagccgggcggcaatttcgccgcggtggcgtccagcgtcgccggccggggcatgtcccccaccatggcccgcatgttcaccaccatcgcgatccagacgtactgcccccaggagatggcgaacatcgccagcggcaacctttccggcgccatgccgcaggttccgggaatgcccgggcagcttcccgcgatggccggccagatcccgggcatggcgggccagacgggccaactgccgacgatgcccggccagctgccgagcttctgaccgaggcgcgccgagcgtgtgggccatggacgaaaaatgacgaaaagtcgtacctaaagcccacgttcgacgcggaccaaacactcggaacgtcagccggtgcccagcgggtcgatggtccaggcgatgtaaaccatcgccgccccgaccatcgcggtggtgacgaagtcgattcccttgccgcgcaccaccagcagcccggcacgctcctcggacagcaccagccgcagcagcgccgccacccccaccccgatgccgagtagcagtgaaccgcggcgccagaagttggcgcccaccaaggccagtgccaccgcaaagatcaagcccaccaacagaatcggccactgggcccgcatcagggtgcgtgcggtcattcccgctcggccagctcgacgacgttggtcaacaggaacgcccgggtcaacgggcccacgccgccgggattcggcgacacgtgaccggccacctcccacacgtcggggtgcacgtcgccggcgagcttgccgtccacccggctgacccccacgtcgagcaccgcggcccccgggcgcaccatgtcggcggtcagcaggtgcggaaccccgacggcggccacgatgatgtcggcctgcctggtcaacgccggcagatcacgagttccggtgtggcacaacgtaaccgtcgcgttctccgaacgccgggtcagcagcagccccagcggacgaccgaccgtcacaccgcggccgatgaccaccacgtgcgccccggcgatctcggcgtcgtagcggcgcaacaggtgcacgattccgcgcggcgtgcacggcagcggcgccggattgttgagcaccaaccggcccaggttggtggggtgcaggccgtcggcgtccttgtccgggtccacccgctccagcgccgcgttctcgtccaactgcttgggcagcggcaactgcacgatgtaccccgtgcattcggggttggcgttcagctcgtcgatggtgtcgttgagcgcggcggtgctgatgtcggcgggcaggtcgcggcggatcgaggtgatgcccaccttggcgcagtcggcgtgcttgccgcgcacgtaggcctgcgagcccgggtcgtcgccgaccaggatggtgcccaaaccgggggtgcggccggccgcggtcaacgcggcgacccgctgcttgaggtcgacgaagatttcgtcgcgggtggccttgccgtccagtgtgattgctcccacgctgacagtctggcacgctccccgatatgcccacccctccggacgtgttcagccccgccaagctcggtccgatcacgctgcgcaatcgcatcatcaagtccgccaccttcgaggcgcgtacaccggacgcgctggtgaccgacgacctcatcgaataccaccggctgcccgccgtgggcggcgtcggcatgacgaccgtcgcctactgcgcggtctcccccggcggccgcaccgagggcaacggcatctggatgcggcccgaggccgtgcccgggttccgccggctcaccgacgcgatccacgccgagggcgcggcggtcagcgcgcagatcgggcacgccgggccggtggccaacgccaggtccaacaaggcgcaggcgctggcgccggtccggttcttcaacccgatcggaatgcggttcgccaagaaggcgacccgcgacgacatcgacgaggtgatcgccgcgcacgccaacgccgcgcggctggccatcgaggccgggttcgacgccgtcgaaatccacctgggccacaactatttggcgagttcgttcctgtccccgctgatcaaccggcgcaacgacgagttcggcgggtcgctgcagaaccgtgcgaaggtggcccgcggcatggtgatggccgtgcggcgggcggtggaaaaggagggcacgcccatcgcggtgacggccaagctgaacatggccgacggggtgcgcggcggcatcagcaccgaggaatcgctgaccaccgccaagtggctggagtccgacggcggcctggacgcgatcgagctcaccgcgggcagctcgctggtcaacccgatgtacctgttccggggcgacgcgccgctcaaggagttcgccggcgcgttcaagccgccgctgcgctggggcatgcgcatgacgggcaagaagttcctgcgcgaatacccctaccgcgacgcgtatctattgcgggacgccaagctgtttcgcgccgagctgaagatgccgctgatcctgctgggcggcatcaccaatcgggagacgatggacctggcgatggcggaggggttcgagttcgttgccatggcccgcgcgctgctggccgagccggatctgatcaaccggatcgccgccgacggtgccgcgcaccgggtgcattcggcgtgcacgcactgcaatcagtgcatgcccaccatctacagccgaacgcactgcgtggtcaccggtgcgcccgaccggcacaccagcgccgcaacttaatccacagcgctgcaagctacagttgtggcgatgtcagcaccagccccgccagcgctaaccgtccatcacgaaggctcggaacgtaccttcgccgcgggccacgacgtggtcgtcgggcgcgatctgcgagccgacatgcgcatcacgcaccctctgatctcgcgcgcccacctgctgctgcgctacgaccagggcaagtggctggccatcgacaacggttcgctcaacggaactttcgtcaatggccgccgggtgccggtggtcgagatccacgacgggtgcgccatcaacatcggaaacccggacggcccgctgctgaccttcgacgtcggccgccaccaaggcatggccggacgcccgccccgcaccgagtcgatgggcatcccggtggccgcccacccgcccgcacccgcggcctggtcggcccaactggcgccgccggtcgccgccccgcccccgccggccgggcgcacccccaactgggccgcgccaccgcgccgcccgcagcccgcgccgcgccccggcccgccgggccagaccatgtacggcggccgcccacccggcggctacccgcccgccgcgccgcccccgccgcccgtcgcgccggccccggcggccccgcacacccagatggcgcccgcggcttccaagccgcccgaggtggccaacctggcgaccaagatgttccaggcgctgatgccgtcgcggtccggcgcgatccagaagccggccgggtcgcagaccatcggccgggccaccgacaacgacatcgtcatccaggacgtgctggcctcccgccaccacgcgtttctgatccagacgccgctgggcaccgagatccgcgacgcgcacagcgtcaacggcaccttcgtcaacggcgtgcgggtcggctcggccgtgctcaccgagggcgacgtggtcaccatcggcaacgtcgacctggtgttcacccgggacggcctgatccggcgcaccgaggcggccacccgcagcggcgggctggaggtcaactccgtctgctacaccgtcgaccacggcaagcagctgctcgaccacatctcgctgaccgcccggcccggcacgctgaccgccatcatcggcggctccggcgccggcaagaccacgctgtcgcggctgatcgtcggctacaccacccccacgtcgggcacggtgaccttcgagggccacaacatccacaccgagtacgcatccatgcgcagccggatcggcatggtcccgcaggacgacgtggtgcaccgccagctcacggtcaaccaggcgctcggctacgccgccgagctgcggctgccgcccgacaccagcaaagaggaacgggcccgcgtcgtcgcccaggtgctcgaggaactcgacatgacccagcacgccgaaacgcgggtggacaagctctccggtgggcagcgcaaacgcgcctcggtcgccctcgagctgctcacccagccgtcgctgctgctgctcgacgagccgacgtccggcctggacccggcgctggaccgccaggtgatgctgatgctgcgccagctcgccgacgccgggcgggtggttttgatggtcacccactcggtgtcctacctggacgtgtgcgaccagatcctgctgatcgcccccggcggcaagaccgccttctgcgggccgcccgaccaggtcgagcccgcgctgggcacccgcaactgggccgacatcttcgccaaggtcggcgccgacccggacgaggccaaccggcgcttcaaggagcgcaaccagcagtcgtcgcagccgccgacgccgcagagcccggcggacctgggggaacccccgcagaccgacctgtggcggcagctgtcgacgatcgcgcgccgccaggtccggctggtggtctccgaccgcggctacaccatcttcctggcggtgctgccgttcctcatcggagcgttgtcgctgacggtgaagggcccgcatccggggctggggccagccgacccgcttggacccgcgcccacgcagccgcagtacatcatggtgctgctgaacatcggtgcggtattcatgggcaccgcgctgaccatccgagatctcatcggcgagcgggccatcttccgacgagagcaggcggtggggttgtccaccaccgcctatctgctggccaagatcgcggtgttctgcgtcttcgcgaccgcccaggcggctatcgcgaccatcatcgtgcggctgggcaagggcgcgccgaccgcgcacccgcagttcttcggcaactcgacgttctcgctgttcgtcaccgtggcgggcacctgtatcgcgtcggcgatgctgggcctgctgctgtcggcactggcgcagtccaacgagcagatcatgccgctgctggtggtgtcgatcatgtcgcagctggtgttctccagcggcatgatcccggtctaccagcgcatcggcctcgagcagctggcctggctgacaccggcgcggtggggctatgccgcgggcgcgtcctcgatcgacttcccgtcgctggtcaaggtcaagcagatccccaccaacgacccgatctggcagcactccaaacacatcttcgtgttcgacatggccatgctggcgctgctgtcgatcggttacaccggcttcgtgcgctggcatatccggctgaaacgctgaggccggccggccggccgcgaactctaatctgggtgtgatgactcgctccgcgcagcccgtgctgactgcccgatccgaccgctccgaaggcagcttcgccgcgggccgtgacgtggtcgtcggcagcgacctgcgcgccgacctgcgggtggcgcacccgttgatcgcccgggcgcacgtgctgctgcgcttcgagcagggccgctggcgggcggtggacaacaacacgctcaacggggtttatgtggacggccggcgggtgccggcggtcgacatccaggacgggcagaccatcaacatcggcaaacccgacggcccgcgcatcacgttcgaaatcggccagcacaccggcgccgtcggcctgctcccgccgccgccccggcagccgaaaccgcccgggcagccgccgacgcgctcgttccggcgtcgagacacccagcgcagcgccgtcccgccggacgccgcgacgcgcggggtgccgcagcccgggccgccgccgcgcacccagaccggcaggaccggcggcagcggggagttcccgaccacctgggtcagcgtcccgggtcccgacgccgatcgccggccggcgcccgggcgcgccgcctggatcgggcgcgccctcaacaacgacatcgtcatccacgatgtgctggcctcgcgccatcacgccttctttaccccgacgccgaccggcgccgagatccgcgacgccaacagcagcaacggcaccttcgtcaacggtgtgcgggtcggtgcggcggcgctgtccgacggcgacgtggtcaccatcggcaacgtcgacctggtgttcaccggcggcatgctggtccgccgccaggaggcggccacccgcgccggcggcctggaggtgcgcgaggtcaacttcggcgtcgacggcaagcagctgctggaacggatctccctggtcgctcgtcccggcaccctgaccgcgctgatcggcgggtccggcgcgggcaagaccacgctgtcgcggctgatcgccgggtatgccacccccacctccggctcggtgacgttcgagggccacgacatccacaccgagtacgcctcgctgcgcacccggatcggcatggtgccgcaggacgacgtggtgcaccgccagctcacggtcagccaggcgctcggctacgccgccgaactgcggctgccgcccgacaccagcaagtccgaccgggctcaggtggtcgcccaggtcctcgacgagctgggcctgaccgagcacgccgacacccgggtggaccgactgtccggcggtcagcgcaagcgtgcgtcggtggcgctggagctgctcaccgggccgtcgctgctgatcctcgacgagccgacgtcgggcctggacccggcgctggaccggcaggtgatgaccatgctgcgccagctcgccgacgccggccgggtggtgctggtggtcacccactcgctgacctacctggacgtctgcgaccaggtgctgctgatggcgccgggcggcaagacggcgttcctcggcccgcccggccagatcggcccggcgatgggcaccaccaactgggcgcacatcttcgccaaggtgggcgccgacccggacgaggccaaccgccgctttctggcccagaaccggccgccgccgcccgcgcggaccgaggcgccggccgagctgggcgccccggcgcagaccagcaaacgccgccagttcttcaccatcgcccgccgtcaggtccggctggtgatcgccgaccgcgcctacttcctgttcctggcggtgctgccgttcgtgatgggcgcgctgtcgctgaccgtgccgggcagcgccgggttcggctacgccgatccggccggcgagtcggccggcgaggccggcaccatcctgacgttgctcaccatggccgccgcgttcatgggcacggcgctgaccatccgcgacctgatcggcgagcggccgatcttccgccgcgagcaggcggtcgggctgtccagcaccgcctacctgctggccaagatcgtggtgttctgcgtgttcgccgtcgcgcaggcggccgtcgccaccgccatcgtggtgctgggcaaggggccgccgacgcggccggccgtgctgctgggtaacgccaccttcgagctgttcgtcgcggtggcggcgacgtgcgtggccgcggcgatgctgggcctgctgctctcggcgctggcgcggtcgcacgagcagatcatgccgctgctggtggtgtcgctgatgatgcagatggtgctgtgcggcggcatggtgccggtcacccaccgggtcttcctcgaccagctgtcctggctggtgccgtcccggtggggctatgcggcgcaggcggcgacggtggacctgtggacggtgtcgcccggcccgcagagcccgcgggacagccgcttccagcacatcgcgacggcctggctgttcgacatggcgatgctggcggtgctctcggtgggctacgccgcgctggtgcgctggcgcatccggttgcggcgctgacgcgctaggagcctgctgaattaggggattttttggggcggggcgtctcgaaccgtctagcggcgtgttgtagtcagaccctgtgggtcgacagaaaagagatcgccccgccgttgttgagcgtggcagcggtcggcggctgaggcaaggccttggtgtgagggcgtgttaggcgatggcccaggtggtgtcggtgcgggtcaggcccatggtgagcagccgacgtaggttcagtgctgcggcgcggtggtgcagccaatggttgtttttggcggttcctcggtagcggaccttgcggttgccgcgagtgagccaggccattgagcgttccaccatgggccggtgttggcggtattcggcttgccaatcggggtcgcgggccgcgacgcgagcagcgcgcaataattgctcgtggatatgaagggtgagtttgcgtccgcgcgtggcggtcgtgcaccgggacgccaacgggcatgagcgacagtatctttcgaaggtgactccgccactgggacggatcggcattccgtgtccagccgggcaggtcacgatgcgggcgtcgaaatcgatgaggaaatcgtcgctggtgaagccacccggaaccggcgagcgtagcggtagcggtttgatcaccgcgacatggccggcgtcggccagtgccgcccgggcggccccggtgccatacgccgaatcgcccaggacccgcaccgggggtgtgttcaccctcgagcaggctcagcccgacgacggcctcgtggttgtccgcgccgctggccttggtcaacgcgcaatcggtgatgattccggtgtcgggctcgacggcaaggtgggctttgaagccgtcctggcggcggtgcaccgtcttgtgagcgtgccgcgtgtcggcatcgacggtggagatcacgcgatccccactgacctgctgcgcgatgcgccagtgcccgtcggtgccatcagagccctcgaccggttcaacgtcttgaccggcgatcaacgccaacaacgccaccgcctcagcagcccgcggcgcgagttcctggtcaggcagatagcccagcacccggtgagcatcaccgaccaaaccatccaccagccgatcccgagcggccttatcctcccacgcaatcgcgggtttccccggatcgtcgtaatcatgggcgctgcagtgggcttcgatcaccgctgcagcgccagggacttcgcggcgcactcgtcggatcgcggcgatcaactgcgtcacggtgtcctgcgtggccaccgcatcgtcgagcaccgtggaatccaaggcccgccgtgtcttgcccgccaacaccccggtctcggccaccaccgtcttgaccgcctcaaagatccggttgggccgatccgaagccgccaaccgacgccgccaatacgtcaacgtcgtcgaatgaaacgcgcccgccgtgatcggcaacccgcacgctgctttccagcgcagatcgaaagtcaccgcatccacggtctcgttatccgaaaaaccgtgcagggcctgcaaggtgatcaccgaggccatcacctcagccggcacgctgggccggccccgctgcgacgggaacaagtccgcgaacatctcctcgggaaacaactggctgcggtgcgccgccaggaacgcaaacatgctgtcggccttcagaagatgcccggcaaccgactccgcatccaacaactcacgctgatcatcagagcgaccctgcacccaacaatcatccccaaaaccccaggacaactcgtcccgccacgcggaattaattcagcaggctcctagccgtccagccgcagcccgcgcgccagcgcgaaggcgacggcctggtcgacgtcgacgcgggccccggccagcgacgccgtcgtccacagcgccgggtccgcggcgccgccgcgcaggtcgttgccgccgagcaccgcgagcgtgaagtccacctcatcgaacgtcaccggccgcagccgacactgctcgaacaccgaccccagcatggtgcactgctcgaaagtgctgtgccacaacgatgttcgacgaaaggtacagttgcggaaggccgacgcgcggtgccgcgactcggccaggttggcgccgctgaaattgcattcggtgaacaccacccgctcggtcgacagcccgaccaggtcctcgtcggtgaaatcgtgccgctcgaattcgcggtcgacccacgcggtcaattggccgacaggctggccagcgcgtactcgctgaccgcgatcagggcgtcggtcgccgaccggcggtccctggcatcgacggtgatcaccgggatgtgcggcggcagcgtcagcgcctcgcgcacctcctcgaccgggtagcggggcgccccgtcgaactcgttgaccgcgaccaggaacggcaggttgcggtgctcgaagaagtccacggcggcgaagctgtcctgcagccgccggcagtcgaccagcaccaccgcgccgatcgcgccgcgcaccaggtcgtcccacatgaaccagaaccggcgctgccccggcgtgccgaacaggtacagcaccagatcgtcggccagggtgatccggccgaagtccatcgccaccgtggtggtccgcttgtcgggcgtggcctccagcgcgtccacgccggtcgaggcgtcggtgagcatggcctcggtgcgcagcggcatgatctccgacaccgccccgacgaacgtggtcttgccggcgccgaatccgccggcgatcacgatcttggtcgacgcgtggtcgccggagtcaagctgcacgtcagagtgcgcgtaagccacgcagggtccttcctatcagttcgtggcgctcatccctggtcgaacgctcggacaacgtcttgtgcacccgaaggtagccggacaacaccagatcgccgaccaggacgcgcgccacgcccagcggcaggtccagccgggccgagatctcggcgaccgacgggctgtccaggcacagccgcacgatcctgccgcgcgcgtcgccgggcggccaccggtgcgtcaggccggcctgcaacgtctggatcagcgcctccaccggcaggtcgacggtggtgtcggtgcgccccgacgtcagcgtgtacggccggaccagattcccgctgcgggaggtcggccaggtctcgggggtgtccatcgggcgctcacgagacgctggaccggcgggtggactgcaccaccccgcccacccgctcgacgaggacggccatctcgtagccgatctgaccgatgtcgcaggacgccgcggcgagcgcggccagatgcgagccgtccccgacctgcatcagcagcaggtagccgttggacatctcgaccacggactgcagcacctgcccgccctcgaacagctgggcggcgcccgttgcgaggctggccagcccggaggcgacggcggccagctggtcggcgcgttcgcgcggcaggtgttcgctggcggcgacgggcagcccgtcgacggacaccagcagcgcgtgcgcgacgccggggacctcgcgggcgaacttcgtcaccagccagtccagcgaccggtccggggctgcagaccaggaattgtcgggtgcggtcattgttggtcgggtccttcgctgctttcccgggcgtgcgaccgtccggtgcgcacgccaccgaaatggctgctgaacgaggcgcggaccgcctcggggtcgcgggtgacggccgcgtgctgcggccggcgcggcgcgggtgagcggccgttgagccccggctcgtcgtcgggttcggccgcggccccgtgggcgccacccggcaccagccgggcgccgggggtgcgcacgggcaggccgtggtcggtggtgtgcgactcgacgggcttgtcctcggcggcggccgccagcgtccagccccggtcccacaccgactgccagtccaggtcggggctgttgaccaggtcgtgcgggtcgcccagcatctccgagagcatgcgccggtagatgacgtcgtcgtcggccgggccggtgctggcggcgggcggaatcgaggcttccggcttcggcttcggcttcgggggcggtttcgggggcgcctcgggcggcgtctcggtacgcgggcgggcggcgaagaaggccgaggtgtccgacgccgcgcgggccggccggggcgccggctgctgcggttcgggggccggctcgggcgcccgttccggggccggcctgggcgccgggctggcctcccaccagggcgtcgccagctcacggcgctgccggcggggctgcggttcggccggcggggcgggaaccgcggcaacatccgcgatgccgctggacccaggattgcggcggggcagcagggtgaccggcggtgtggacgcgtcgccggcgttgcgggtgccgcgcgcggccggctgctgggtgccgtcgtgccggccgccctcctcggcgggtgcggcgatggcgctggcgagtttggcgctcggcgacgagaccgcccggatgtgccggggcccggacggctcggcgacgacccggccggcgagcaccgtcggcggcaggtacacctcggcggtggtgcccgagccggattcgttggccgccgggccgcgcaaccccacccgcatcccgtgccaggccgcgatccgacccaccacgaaaagaccgagatgccgggcgttttcgggatgcgggtcggggttcgcgtcgccgccggcctgcagccgcatgttggcgatgcgccggtcggcgtcgttcatccccaggccggagtcggcgatgcgcaccaccactcccccgtcgccgccgcgcgacgccgacacccgggccgaggtggtcggcggcgagtaccgcagcgcgttgtcgatcagctcggcgaacaggtggatggcgccgccggcggccgccccgagcagcgagcactcgggcagcccggcgatctcgacccggcggtagtcctccacctcggacaccgcggcgttgatcacggtggccagcggcaccggatcgcgctggtcgcgcgccagcttcgcgccggccagcaccagcaggttggcgctgttgcggcgcagccgggccgccagatggtccagccggaacaggttgtccagccgttcgggattgtcctcgttgcgctccagccggtcgatgagcgccagctgctggtcgaccagcgagcggctgcgccgcgacatggtctcgaacatgtcgttgaccagcagccgcagccgcgcctcgtcgccggccagcagcagggcctgggtgtgcagctcgtctacggcgtgcgcgacctggccgatctcctcggtggtgtacaccggcagcggagccggaatcggttcggccccaccggctttcacgtgtgcgatctcctcctcgagatcggtgtgggccaccttgagcgcgccgtcgcgcagcgtgcgcagcggccgcaccagggcccgcgccaccagcagcaccaccgccagcgcgatcacgatggcggccagcaccagggcggtgtccaggatggccgagttgcgccgttcggcggcctgcgcgtgcaccgacttggtcaccgacgcggtggtgttcttgatgacctggtcggcgatgtcgtcggtggtctggatcgagcgcagcaggtcggggttgtcgacgagcacgctggccgggtcggacatgatcgccatccggctgaccatctgctgttgcagcgtcttggcctcgggcgatccggcgccgagcacctcgctcatgccgaacagcgtcgacggttcggtgccggccagagtggccatcgaggtgcgcagctgcggctcgggcagctcggctccccgggtgaccaggatcttctgcatggtcatctgcccgcgggcgccgaccgcacggctcaggccctgggcctgcgcccggatccgctcgtcgtcgacccgcaccgacgcgttgatgacgttttcggcggtcaacaggatcggcgcgtagaaggtcacccgctcgcgcaggccgaggctgccctcggccaccttgttcaccagcatttggccggcgtccagcaggttgttcaccccggcgcggacgtcgtcggtgacgtcggtgtcgcccagccgggtctgcagttcgttcttgcgggcctcgtagttcttcttcgcgccctcggcgtcgcgcccggcggagcccgccagcagcgcgacgtccagcgccgacatgtacttggtgatcgccgggacgacgtcggcgcgggcggcggccagccgcaggcccgccgcgttggccatcgcgccgtggatgcgcagcaccccgaaaaccgtcgccagcatcagcgggaccaggacgatggccagcactttccaccgcaccggccagttgctcagcgaccaggccggcgggcgtttggccggcacggcatcgccgcccagcggtgcgggcccgggggcttccgccgcggccggttcggccgggcggctgaacatggtcacgtcgtcgcggccgcgcgaccggccgctgcgctcagtgctgaaacaaacccgaggctcatgaaacttcctgctttatttcgccatttcgcccgccgcgcgccagatcggcgtgtgcgtaagtgtggcaacccgacgagtatgacagcccgcggcccagcccaccagaatcgtcactgagcagacaggtccctccaagctggcgccgcccggccgtcgtcggccctggcaaacaccgcggcgggcggaaggtcaggccgggcgcagcaccgcgaccaggaactcggagtcctcggtgaacggccgcaggtcccagctggacagcagcagatcgggggcgaacccggcgtcggccgcgtcgttgaggaagtcggtgaactcgtactcgcggtaggcgccgaagccgatcgcggcgcggccgtcggcggccaggtgtgcgcgcagccggctcagcaccagcacgcgggtgctgggcgccaggaacgtcatcacgttgccggccgagacgatcacgtcgaacgggtcggtgatgccgcgggcgggcaggtcgagctcggcgaggtctccgaccagccagcgcggcccgggatggtcgtgctcggcggcttcgatcagcgccgggtcgacgtcgacgccgaccacctggtggccggccgcagcgaggtagctgcccagccggccgggtccgcagccggcgtcgaggatgcgggcaccccggggcgccttggcgtccacgaaccgggcctcgccggccaggtcgtcgccggcgcgggccatggcgcggaagcgctcgatgtaccagtgcgaatgaccgggatcggcagcgaccttctgcatccagatgctctgctcgaccatgcgaccattatcgcgttgtgttcaagctgatgttcgtctccccgcgcatcgcccccaacacgggcaacgccattcggacggcggcggcgaccggctgcgaattgcatctggtcgagccgataggcttcgacctgtccgaacccaagctgcgccgggccgggctggactatcacgacctcgcctcggtcaccgtgcacgcctcgctggccgccgcgtgggacgcactgacgccggcccgggtggtcgcgttcacctcgcacgcccccgcgtcgttcgccgagctgcgctaccggccgggcgacgtgctgatgttcggccccgaacccaccgggctggacgcggccacgctggccgacccgcacgtcaccacccaggtgcgcatcccgatgctggccgggcggcgctcactgaacctgtccaacgccgcggcgatcgccgtctacgaggcgtggcggcagcacggctacgccggggcgacctgatttcggcgacctgatttcatcgcggcgacccgcttcgcccggctgcgccgcgcttgcgatcgccgcgcattcaccagctgtcccagtgcgtgacctgctgggcgggcagccgcttggccgggcggaagtcggtgcccttggtgtaggcgatcgggaacagcccgccctggctgtagcggtcgtgcgggatgccgagcagctcggcggcctgcttctcgccgtcgttgatcaggtgcagcgtggtccagcacgtgcccagcccgcgcgagcgcagcgccaggcagaagctccacgccgccgggaacagcgacgcccagaacgacgcgctcagccccagcggagcgttctccacccgcccctccaggcatgggatcagcagcaccggcgcctcgtgcatgtgctcggcgaggtagaccgccgagtccttgaccttgggcatccgctcgccgcgggtgtcgccctcggggtactcggcggcgggcaggctcaggtaggcgcgggcgttggccaggtagatgtcggcgatcgtcttcttcttgtcggcgtcctcgacgaaaacccattgccagccttgggcattggacccggtgggcgcctgcagcgccagttccaggcattccatcaggacctcgcggggcaccggcttgtcgaagtcgagccgcttgcggaccgagcgggtggtggtcaggacttcgtcgacggacaggttcagggtcatgcttggagactaccgtcggccggccggccggcccgtcgccaccgaacgtgcactcacggtgacgttcacgcgaaattttcgccgccagtgcacgttcggcgggccggtcagcggaagtcgcgggagcgtgagccgacggccagggtgatgcggcccaaccgttcggcgacgacggtgatggcgccgctggcgttttgcacctgcccgcgcaccagcaacgccggcgcggtgttggccagcttgcgatgccgcgcccacacccccggggtgcagagcacgttgaccatcccggtctcgtcctcgaggttgaggaaggtcaccccctgcgcggtgccgggccgctgccgatgcgtcaccgcgcccgcgatcagcacccggtcgccgtcgggcaccgaccccagcctcgccgcgggcaccacccccatcgcgtccaggtcgtcgcgcaggaactgggtcggatagctgtccggggagatgccggtggcccacacgtcggcggcggccagctccagctcgctcatccccggcagcgccgggatgtgcgaggacgaacccaccccgggcagccggtccggccgctgggtggccgccgccccggccgcccacagcgcctcgcgccgcgacatcccgaagcagccgaacgccccggcggtggccagcgcctcggtctgctgcaccgaaagctgcagccgggcggtcaggtccagcagggaagtgaacgggccgttggcctttcgctcctgcaccagcttttcggccaggtcgtcgccgatgtggcggacggcgcccaggccgaggcgcacctcggtgccggcgttctccagcgtggcgtgcgccaggctggcgttgacgtccgggccgtgcaccgtcacgccgtgccggcgggcgtcggccaccagcgactgcggcgagtagaaccccatcggctgggcgcgcagcagcgccgcgcagaacgccgcggggtggtgcagcttgaaccacgacgagtagaacaccagcgacgcgaagctcagcgcatggctttccgggaagccgaaattggcgaacgcctccagcttttcgtaggtccggtcgatcacctcgtcgggggcgccgtgcagcgcccgcatgccgtcgtagaaccggctgcgcagccgtcgcatccgctcggtggagcgcttggaccccatggcgcggcgcagctgatcggcctcggcggcggagaacccggcgcagtccaccgcgagctgcatcagctgctcctgaaacagcggcacccccaacgtctttcgcagcgccggctccatcgacgggtggtcgtagagtaccgggtccaccccattgcgccgccggatgtagggatgcaccgacccgccctggatgggcccgggacggatcaacgccacctccaccaccaggtcgtagaacacccggggcttcagccgcggcagggtggccatctgcgcgcgcgactccacctggaacacgccgacggaatcggcgcgggccagcatctcgtacaccgccggctcggacaggtcgagccgcgccaggtccacctcgatccccttgtgctcggccaccaggtcgatggcgtagtgcagcgccgagagcatgcccagcccgagcaggtcgaacttcaccaaaccgattgccgcgcagtcgtctttgtcccactgcagcacgctgcgattctccatccgggcccactccaccgggcacacgtcggcgatcgggcggtcgcagatcaccatgccgccggagtgaatgcccaggtgtcgcggcaggttgcggacctggttggccaggtcgatcacctgcggcgggatgccttccacgtccggggaatccgccggcccgctccagctgctgatctgcttgctccacgcgtcttgctgaccctgcgaatagcccagcgcgcgggccatgtcgcgcaccgcgatctttccccggtaggtgatgacgttggcgacctgggcggcgtagtcgcggccgtagcggtcgtagacgtactggatcaccttttcgcgctggtcggattcgatgtccatgtcgatgtcgggcgggccgtcgcgggccggcgacaggaagcgctcgaacagcagctcgttggccaccgggtccaccgcggtgacgcccagggcgtagcagaccgcggagttggccgccgatccccgaccctggcacaggatgttgttctcccggcagaaccgggcgatgtcgtgcaccaccaggaaatatcccggaaactgcagttgcgcaatgactttcagctcgtgctcgatctgggcgtaggcccgcggcgcgtgctcgggtgacccgtagcggtcgcgcgccccggtcatggtcaactgccgcagccagctgtcctcggtgtggccgtcgggcacgtcgaacggcggcagccgcggcgcgatcagcgccagcccgaacgcgcactgctcgcccagctcggcggcggcggtcaccgcctgggggcgccaagcgaacagccgggccatctccgcgccggagcgcaggtgcgaaccgcccaggggggccagccatccggcggccgaatccagcgactcccgggcccggatggcgcccatcgccatggccagccggcgccgcgacggcccggcgaaatgcgcgccggtggtggcgacgacgccgaccccgaagcgcggggccagcgcggccagcgccgcgttgcgttcgtcgtcgagcggttggccgtgccgggtcagctcgatgctgacccgcgccgcgccgaaccggtccaccagatcggccagcgcccgcgccgccgcgtccggcccgccgtcggaaagcgcttggcgcacatggcctttgcggcaaccggtcaggatgtgccagtgcccgccggcggcctcggtcagcgcgtcgagatcgtagcggggcttgcccttctcgccgccggccagatgcgccgcggccagctgccgcgacagccgccggtacccctcggggccgcgggccagcaccagcaggtgcgggccgggcgggtcgggcgcctcggtgcgcgcgctggggcccaaagacagttcggcgccaaacacggtgcgcacgtcgagttcggccgccgcctcggcgaaccgcaccgccccgtacaacccgtcgtggtcggtgagcgccagggcgcgcaggtccagccgggcggcctcctcgaccatctcctcgggcgtgctcgccccgtccaggaagctgaacgcggaatgcgcgtgcaattcggcatagggaaccgacgaacgggccgcccggccctcgtcgggcggccggtacgtcgcgcgcccgcgcgacagcgggccgtctggttccggggcggcagactcgccggcgcggcgcggcttgctgtcgagcacccgctccatctccgcccaactcggcggcccgttgaaccagcccacggacccgagtatatcgaactggtgttcgatttaatcgctgcccggtacaaccgttgttaaaccgatcttcaactcctaaacaaggtcttaacgctgcgggggttaccgcgggcggggcactggacgaatactggtacgggttcaaaaaagcggacacgggcgggaccgagcatggcgcagacactcgatacggcgttcctcaaggcccacgatccggatcagcacgccagcctggcgatcggggcggtcgccatcgtcgacggcaccgtgcccgaccctgcgcaactggaacaccttgtggcagaacgcatcctgccaatcgcgcggtgcacgcagctgctgcgggcgcacccgctgaaccgggagtgggtggactgcccggacttcgatctggcccggcacctgcgccgggtggcgatcgcgggcaccggcgacgaggccgagctgtcgcaggtgatcggccaggcgctgcgccggccgctgcacccgggtcgcccgccgtgggaatgctgggtgatcgagggcctgcgcggcaaccggtgggcgatgttgatgaagacccatcacggcctgctggacggcaacccggccgcccgcctgatcacccggctctgcgacgacgccgacgccgacatgttcgccaataacgctgcggcacaacctgtttcaccctcgaccggctggctcgacgcgctgagccgggtgtcgtcgctgaccggtgggctgctcggggcgctccggctcgccgggcgggccgaggcggtggcgccggtgcgccgctacgccacggtgcgggtgccgatcgccgacgtcgaccgggtctgccgcaaattcggtgtcagcgccaacgacgtcgcgctggccgccgtcaccgagggattccgcacggtgctgctcgaccgcggcgagcaaccgcgggccgactcgctgcgcaccctggtcccgctgccggtccgctcggcggtgctctcgcacctgcccgtcgaacacgacgacccggtgcgccggctgcagaccgtgcacgcccggtgcaaccccgccgccgggacgcagccggccggcatcgtcgaatcggcgatcggactgctcccgaacatggtgcgcggcaatctgatccagctgctgtcccggctgccgcagcgtggcggtgctcagctacggcgacgaactggttttcggcatcaccgccgggccgggcgacgggttcgacgtcacgcggctggccgccgccgtcgagctgggcatggcgcggctggcggccctcggcgacgattccgtgctgctgttcgccgaccggcggcgccgccgcgcggcccgcccgccgctgggccgggtgccgcccgcgcacccgtcggcgcccgggcacgcgcgtcactgaccggctcggggcgcgaccgtgccgccgtgagaaggttttcctcatgggcgaatcggggccggtggtgatcgacccgcgccgccacgacgcggtgctgttcggggtcggcgacgcgctgggctcggcactggcgagccaactgggacagatcggggtgggcaccgcggcgttcgcggcggacggcccggcggcggcggccgaccggctgcgggtccgcccgggccgctgcgtggtggtggccggcgaccccgcggccgtcgaggcggcccgcaccgccgggttcgcgttggtgatcgggctggcgcccgtcgggcgcgacggcgacgggctgcgcggggccggggccgacgcggtggtcgccgagctggaacagatcaccgtgcgcaccggcgaccgccggatgtcgcagctgccggatgcctcccaggccctgaccggcggcgccgacgggctggccggtcggcacccggcggtgttcttcgacttcgacggcacgctgtcggacatcgtcgacgatcccgacgcggcccgcccggtggccggggccaccgcggcgctgacccggctggccgcgcgttgcccggtcgcggtgctgtccgggcgcgatcttgctgacgtgacgaaacgcgttggggtgctggggatctggtatgcgggaagccacggtttcgagctgaccgcacccgacggcagccaccaccagaacgatgacgccgccgcggccatcccggtgctggcgcaagcggccgggcggctgcgcgatgagctcggcgcgataccgggtgttgtggtggagcacaagcgattcggcgtcgcggtgcactaccgcaacgcggcacgcgaccgcgtcggcgaggtggcggcggcggtgcgcgccgcgggccggcacgacgcgctgcgggtgaccaccggccgcgaggtcatcgagctgcgcccggacctggactgggacaagggcaagacgctgcactgggtgatcgagcacctgcgccggtccgggtcgggtgcgctgacgccggtctacctcggcgacgacatcaccgacgaggacgcgttcgacgcggtgcgcggcgggcccgtccagggcgtgccaatcctggtgcggcacaacgacgacggcgaccgcgccaccgcggccctgttcgcgctggacagtcccgcgcgggccgccgagttcaccgagcggctggccgatcagctcgaacgcggcgagggttaggcgtactccaccgcgccgtcgtcgagcaccacccgggtgttggagccgtccgggttcgacgcctcggtgcggaacaccgccttgcccggctcggtgcgccagatcagcgtggtcagcgtctcgccggggaacaccggcgaggtgaaccgcgacgcgatcgaggtgatgttggccgcgacgccgccgccgagctcggccaccagcgcccgcccggacaccccgtaggtgcacagcccgtgcaggatcggcttggggaagccggccagttcccgggcgaaccacgggtcgctgtgcagcgggttgcggtccccggagagccggtagatcagcgcctggtcctcccgggtgggcagcgcgatccgcgcgtcgggctcgcggtcggggaattccggcgcgatcggccgctgcccgggcatcccgccgaacccgccctcgccccggatgaccagggtggtcagcgtctcggcgatcagctgcccggagtccggctcggtgccgcggccgcgcaacaccaggatcgcgttcttgccctcgcccttgtcctggatgtcggcgacctccgagaccaccgagagcttgcccgccggcggcagcggcgcgtgcagccggatgctctgcgagccgtgtaacagcatggcccagttgaactttccgaccaacccggccgcgccgaaggccgggcagcagatcaccgcgtaggtgggaagcacctgctggtcgatgccgtggctgttctcggtggtgaaggccaggtcgtcgaccccggcgccgacaccgagcgcataaagcagggtgtcccggtcggtccattcgaacagcaggggttcggtcaccgcgccgacggcactcgggtcaatcgccatgggagtccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctcctttccgcggaattcgagagcttttctcccgctaaccatcgcaaacccttcccagcggagccgtcggcagggcaggctatctctcatgcccaagcgcagcatgattcggaaggtctcggtggcgctggccgtgctcaccgcgacggtgaccgtcgccgcctgcggcggctcaccgcaggcccggtccatcacggtgaccttcgtccggcacgcccagtccgaggccaacgccagcggcaccatcgacaccgaggtgcccgggccgggtctgtccccggagggcaaggggcaggccgaacaggtcgcccaccaactcggccgcaaggactacgacagcgtctacgcctccaccatgacccgggcccagcaaaccgcggccccgctggccgccgagctcggcaagcaggtcgaggtgctgcccggcatccaggagatcaacgccggctggtacaacggcaaatccgagtcgatggcgaagtcgacctacctggtggcgccggcgaactggctcaagggcgacgtctccgacagcatccccggctcgatcagcggcaaggagttcaacgaccagttcaccgcggccgtcaacaagatctacaacagcggccaccgcaacccggtggtgttctcgcacgcgaactcgatcatggtgtggacgctgatgaacacccgcaacgccaaggacagcctgatgaacacccatccgctgcccaacaccggccgggtggtgatcaacggcaacccgatcaccggctggacgctggtggattgggacgggatccgcgacttccgcagctagcccccggccgccccaagctcggcccccaagctcgccgcccaatctcggcggttgacgtgcgcggccggcaccgccacgatgtcttcatgcggtatgtcgttaccggcggtaccgggtttattggtcgccgcgtcgtcactcgtcttctgcaaacccggcccgaagcgcaggtgtgggtgctggtccgccggcagtcgctgggccgcttcgaacggctctcggcgcggggcgacaccccctggggcgaccgggtgaaaccgctggtcggagagctgccggcgctggagctgagcgacgagaccctggccgagctgggacacgtcgaccacctggtgcactgcgcggcgatctacgacatcaccgccggggaggccgagcagcgggccgccaatgtggacggcacccgcgccgtgatcgagctggcgcaacggctcggcgccaccctgcaccacgtgtcgtccatcgcggtggccggtgacttccccggcgagtacaccgaggacgacttcgacgtgggccagcaactgcccacgccgtatcaccagaccaagttcgaggccgagctgctggtgcgctcggcgcccggcctgcgtcatcgcatctaccgtccggcggtggtggtgggcgactcgcgcaccggcgagatggacaaggtggacaggccgtactacttcttcggcgtgctggccaagctggcggtgctgcccaggttcaccccgatgctgctgcccgacaccgggcgcaccaacctcgtgccggtcgactacgtcgccgacgcgctggtcgcgctgatgcacgccgacggcctggacgggcagaccttccacctcaccgcgccgaaaaccgttgggctgcgcggcatctaccgcggcgtcgccaaggcggccgggctgcccccgctgcgcgggtcgctgcccggcgcggtggccgccccggtgctcaaggtgcgcggccgcgcccgggtggtgcgcgacatggcggccacccagctcggcatccccgcgcaggtgttcgacctggtcgacctggcccccaccttcgtcagcgagaagactcgaaatgcgttggcgggcaccggaatcgaagttcccgagttcgccggctacgcgcccaggctgtggcggtactgggccgagcacctcgaccccgaccgggcgcgccgcgacgatccgcggggaccgctgtacggccggcacgtcatcgtcaccggcgcctccagcggcatcggccgggcgtcggccatcgcgatcgcgcagcggggcgccaccgtgttcgcgctggcccgcaacggcgccgcactggacgcgctggtcgacgagatccgcgccaatggcggtgcggcccatgcctttacctgcgacgtcaccgattccgcgtcggtggaacacaccgtcaaggacatcctgggccggttcgaccacgtcgattacctggtgaacaacgccggccggtcgatccgccgctcggtggtcaactcgaccgatcggctgcacgactacgaacgggtgatggcggtcaactacttcggcgcggtgcggatggtgctggcgctgctgccgcattggcgggagcggcgattcggtcacgtcgtcaacgtgtccagcgccggtgtgcaggcacgcaaccccaagtacagctcctatctgccgaccaaggcggccctggacgcgttcgccgacgtggtcggctcggaggtgctgtccgaccacatcaccttcaccaacatccacatgccgctggtgcgcaccccgatgatcgtgccgtcgcaccggctcaacccggtgcgggcgatcagcccggagcgcgcggcggcgatggtggtgcgcgggctggtggaaaagccggcccgcatcgacaccccgctgggcaccctggccgaggccggaaactacttcgcgcccaggacttctcgtcgggtcctgcaccagctctacctcggctacccggactcggccgcggcgcgcggggtggccaccgagccccggccggcggaacgcaccgaacgcactgcaccccgcaagccgcgccggcccgtccgcgccgtcacgcgcggcctgcgcacaccgcgcccggtcaggcggctggtgcgcctggtccccggcgtgcactggtgatccgcgcacacgtttacccgggcgcgatcgcggtactccggcgcgatggtaggcagtgccggccggactgacatcgatcccgtgggagcggccgccgaactggtggccgcgacgggcgcggcggtgctgcccgcgctgagtgtgacgcgcagcctgggtgtgggccgcgaggagtggacgcggttcgcccgggacccgttgctgcacaaggtgatacggctgctgtcccggatcgccgccgccctcgacgaggtcggcgagtggaacgtccaggtgcacccgttccgcatccggtcggcgccgcaggagtgcggcgccggcggtcaaccgacgcccgacggccggcggctgctgacggcgacgctggccgagccgggcaccctgctggtcagcgacgaccgccgcaccctgcaccaggtgtcgccgatccggccgctcgagggcgacggcccggcccgccgggacgtcctggtgatcaccttcgcgtccggccgtccctgatcgtcgcggtatcgtggccgcggtgactccagttttcgtcgatgtcgacaccggcgtggatgatgcgctggcgctgatgtacctgttcgccagcccggacgccgacgtggtcggcatcgcatcgaccggcggaaacgttgcggtggagcaggtttgcgaaaacaacctgggcctgctgcagctgtgcgggctgaccggcatcccggtgtccaagggttccgggcagaccctgaccggcccgatgcggctgccatcaaaagtccacggccccaggggattgggctatgccgagctgccgcccagcgaccaccgggtcaccgaccacgactcggcaaccgcctgggtgtgcgccgcgcacgcccaccccggggagctgatcggggtggcgaccgggccgctgaccaacctggcgctggcgctgcgggccgagcccgcgctgccgaccctgctgcgccggctggtgatcatgggcggctcctacgaccatcggggcaacaccaccgcggtggcggaatggaacatcagcgtggaccccgaggccgcggccgaggtgctggccggctggggtggcgccgacgtcgggcgggagcggctgccgatcctgtgcgggctggacctgacccgcaaggtggcgatgacgccgggtcacctgacgcggctggccaccgccgcggactccagcacccgcccgctgagcgccgacgacgaacccggaacccggtcggcggccgccaacccgctgatccgggtgatcgaggacgcgatgcggttctacctggaggcctatcacgacctcggccacggctatcaggcgcacatgcacgacccgttggccgccgccgtcgcgctggaccccacgctggtggccacgcgtccggcgacggtggagatcgagctgaccggcaccctgacccgcgccatgacggtcaccgactggtcgggtcgtcgagaacccaacgcgctcatcgggattgatgtggactcggcggcattcttcgaccggttcatcgaacgggtggggccgttcgcccgccgggtgggcggcggccggtgacgacggtatccgcaaaacgaaggcgggccgtcatacgaaaatcggcggttgccggtcacctgcgccggtgacgtcggcggattgtgttttcatgaagatggacgagtgggggcgcgacgtcacgcgtggacggctcccgtcaagtgaaaggtatcgagtgtcatgacggagctggttaccggggaaacgctgccgaacgtggtcgtcactggcatcgccatgacgaccgcgctggcgactgacgccgagaccacctggaagctgttgctggacagtcaaagtggtatccgcaagctcgaggattccttcgtcgaggagttcgacctgccggtgcgcatcggcggtcacctgctggaggatttcgacgacgggctgacccgggccgagcggcaccggatgggctacctgcagatgatgtcgacggtgctgggccggcgggtctgggagaacgccggctcgcccgaagttgacagtaaccggctcatggtgtccatcggtaccggcctggggtcatccgaggaaatggtcttcagctacgacgacatgcgcgcgcggggcatgaagggggtctcgccgctggcggtgtcgaagtacatgcccgacggcgcggccgtcgcggtgggcctggaacggcacgccaaggccggcgtgatcacgccggtgtcggcgtgcgcgtcgggctccgagggcatcgcccaggcgtggcgcaacatcgtcttcggcgaggccgacatcgcgatctgcggcggtgtcgagacgaagatcgaggcggtggcgatcgcggcgttcgcccagatgcgcatcgtgatgtcgaccaagaacgacgaccctgtcggcgcctgtcgcccgttcgaccgggaccgcaccggcttcgtgttcggcgaggccggcgcgctgatggtgatcgaaaccgaggaacacgccaaggcccgcggcgccaacatcctggcccgcatcatgggcgccagcatcacctccgacggctaccacatggtcgccccggaccccaacggcgaacgcgccggacacgccatgagccgcgccatccagctggccggcctgacgcccggcgacatcgatcacgtcaacgcgcacgccaccggcacctcggtgggcgacgtggccgagagcaaggccatcaacaacgcgctgggcccgcacggcggcaacgccgccgtctacgccccaaaggccgcgctcggccactcggtgggcgcggtcggcgcggtcgagtccatcctgaccgtgctggccctgcgcgaccaggtcgtcccgcccaccctgaacctggaaaacctcgaccccgaaatcgatttggacgtggtggcgggcaaaccgcgaccgggcaactaccagtacgcgatcaacaactcgttcggcttcggcggccacaacgtcgccatcgccttcggacggtactgaacccaccgtcgcgccggccctcgtttggtgatccgagcagagggtaaagcagcgactatggccttcgccgagtatcagaacgagctctacgaccagtcgttgcacggcaaccagccgcagtatccgatcagattcgaggagctggaggccaaggcgtcggcggcgatgaccccgaaggtgctggggtacgtcgccggcggcgccggcgacgagcacacccagcgggccaactgcgaggcgttcaagcggtggggcttgtacccgcggatggggatcgcccccgaacagcgcgacatgtccgtcgagctgttcggcacccggttcccgtcgccgatattcatggcgcccatcggcgtgatcggggtgtgcgaccccgacggccacggcgacctggcctgcgttcgggcctcgatccgcaccggcgtcccgttcttcgtcggcacgctgtcggccgatccgatggaggacctggccgacgaattgggcgacaccccagcgtttttccagctctacaccccaccggaccgcaagatggccgccagcctggtgcaccgggccgaggcggccagcttcagcggcatcgccgtcaccctggacacctgggtgaccggctggcggccccgcgacctgagcggcgggaactacccccaggtgcccagcggatgcctggccaactacaccagcgatccggtttttcgcgccgggttgagccgcggcgaagaccccaccgaggcggcggtgcgcaagctgccgatcttcggcgggccgttccggtgggaggacctggaatggctgcggtcgcggaccagcctgccgctgatggccaagggcatctgccaccccgacgacgtgcgccgcgccaaagacattggggtggacgccgtttactgctccaaccacggcggccggcaagccaacggcgggttgccctgcctggactgcctgcccggggtggtcgaggcggctgacgggttgccggtgctgttcgactcgggtgtgcgcagcggggccgacatcgtcaaggcgctggcgctgggggcgaccgcggtcggcatcggccgcccctacgcctacgggctggcgctcgggggcgtcgacggcatcgtgcacgtgctgcgctcgctgctggccgaggccgacctgatcatggccgtcgacggctacccctcgctgaaggacctgacgccggacgcgcttcgccgcgtcgaacatgttgcaccacaacgttattcgtagcttccctccaaataccacctcctttgccggtagcacagcagcagcgcgcgttcgctttccagcagaacctgcgcgcgggcggtacggcccccaccctgaccccggtcgtcccaccaccgctcgtcgaccggccagggcccgccccaccagcacagccgctcgccccggccgtgaacgaccaggcgcgcagggtcggcggagaacagcccccgactgctgacacgtatcggattaccttgggcgtcaagcaattccaccggatcgtcgagcaacaccgccggtgacggctcgggcagccggccgggccacggcaggtcgggatcggcctgcggcaccggctcgtcgccgagcgggatcaaggtgatgcgctcggccgggccgcggccaccagagcgcaccggcacctgcaccgcctccgggccgagcaagccctgcacccgcaccagcgcccggcgggcccgcagccggtcctcctcccccaggccgccccagagcggcaactgcagcgcctcggcggagaccacctccaccgcccgcagccgcaacagcgtcaccggggcggtgggacgatcgcgcgcggtgcggttgctcaaccagccgtccagttgccagcgcacccggtcggcggtggcgtcctcggtcaacggctcggcgcaccgccacacccggtggcgttcttcgccgctcccggtggcggcgtgaatggccagccgggtgcagcccacaccggcggccatcagcgcctgatgcagcgtgccggccagcgagcgcccggcgaacgccgcggcgtccacccggtcgatcggcgggtcgcagtccagcacggcctcgagctcggccgggggttcccgcccggagggcggccgttcgggttcgccgcgggccagccggtgcgcggccaccccgtcggcgccgaaccgggacgccacgtcgccgcgggccagtgcggcgaactgcccgatggtgcgaattcccatccgccacaacaggtccgtcagctcttcgcggccggggccggacaggctcggctcggtggcgagttggcggacggacagcaccgacaggaacttcgcgtcgcctcccggctccacgatccggcccgcccgcgccgccaggaccgcggtggacaaccggtcggcgatcccgacctggcactcggcgccggccacggagctcacggccaccgcgtcgaccagccgctcggccgcggcctcctcggacccgaagtagcgggccgccccgcgcaccggcagcaccagcagcccgggccgcagcacctcggcgcgaggcaccaggtcgtccaccgccgcgatcaccgcttcgaagaagcgggcgtcgcggtccgcgtcggcggtgctgacatgcagttgcgggcaccgggccgccgcctcccggcggcgcaggccccgccgcaccccggccgcgcgggcggccgacgagcaggcgatcacccggttggccaacgtgaccgcgaccggggcggtggctggcagctccgcggcggccgccgccgccaccgcgggccagtccatgcaccagatcgccaaaacccttgaaccagaaggggttaccaccggaattcaccccgcccgcgcctgggccgccacccgccgtcccgcgcacatcccgctgacctgcagccgcaccccgctgatgcgcccgaaccccggggcgggttttccccactgggccggtgtgacctcatagccacagacccgggccgcgagccgcgtcggcgcgccctgccaatcgccgccggtgaccagcagggtgcagcccttgctgcgggcccgcgccaccaccgcccgggcccgggtcggcggcacccggcgcccgcccagcccgaggaccaccagatccatgccgtcgaccagcaccgcggccacctccaccggatcggtcccggggtccgggatcaccgcgagccggctcaggtccgcccccatctcggcggcggccagcagcccgatgtccggctggccgacgatcgcggcgttgcccccggccgccgtcaccgcggccaccatgctcaacagcagcgaccgggcacccgagagcaccgccaccgacccccggggcacccacaccgattcggccagccaccgcggcatggccagcaaagattccgcgcccagcaggtcggcgggggcggcggcaccggatgccgccccggacatcctcccggacatctccgccatccgccggcgcagcgattccagccgctcggcgcgggtttcttcgtggcgactggaggcgaaagccgcggtcatgaccagcctcctgtcgccactcgtcgcccgaaggtttcgaatgcatgttcgattcactggggagtaaacacccaccctccgacaaccgtcaagaaacgtaaggggcagccttatgcactcggtgccggtgggacggatggtgctttttttgccccgagtggcaatgccgggccgggccggtaggaagccggttgaagccgcgccgtcgtgcacggcgacgagcacgtcatcaaattcaccgaggcctgctaccgggaaaacgccctccagcccgacccgcggttcgccgcggccgtacagaccgcacagcggcggatcgcgccgcgcgccctcggcggcggcgcggcgaccatcccgtccggctgacggcagcccgagcccatttccggcggggcggctactcccactcgatggtgccgggcggcttgctggtgatgtccagcaccacgcggttgacctcggggacctcgttggtgatccgggtcgagatccgctccagcacctcgtaggggacccgggtccagtccgcggtcatggcgtcctcactggtcaccggccgcagcacgatcggatgcccgtaggtgcggttgtcgccctgcacccccaccgagcggacctcaccgagcagcaccaccgggcactgccagatcagcgagtccaagccggcggcggtgagttcctcgcgcgcgatcgagtccgcccgccgcagcgtgtccagccgcgtcgcggtgacctcgccgacgatccggatgcccaggccgggacccggaaagggttggcgcgcaacgatttcctccggcagccccagttcccggccgaccgcgcgcacctcgtccttgaacagcagccgcagcggctcgacgagggtgaacttcaggtcgccgggcagccccccgacgttgtggtggctcttgatgttcgcggtgccgctgcccccgccggactccaccacgtcgggatacagcgtgccctgcaccaggaactcgaccggcttgtcccccaacacatctcgcaccgcgccctcgaacgcccggatgaactgccggccgatgatcttgcgcttgccctccgggttggtcaccccggccagcgcctgcaggaaggtgtccgccgcgtcgacggtgaccaggttggcgccggtggcggccacgaaatcgcgctgcacctgcgcgcgttcaccggcacgcaacaacccgtggtcgacgaacacacacgtcaagcgatcgccgatggcgcgctgcaccagggcggcggccaccgcggaatccaccccgccggacaatccgcagatcgcatggccgtcgccgatctgcgcgcggacctgctccaccagcacaccggcgatgttggcggccgtccagtccgcgcccagcccggcgaagtcgtgcaggaaccggctcagcacctgctggccatgcggggtgtgcatcacctccgggtggtactgcaccccggccaggcggcgggcccggttctcgaacgcggccaccacggcgccggggctgctggccaccacctcgaaaccgtccggcgcggcggtgaccgcatcaccgtggctcatccagaccggctgcacgcccggcagccccgaatgcagttcgccgccaagcactttcagctcggtgcgaccgtattcgctggtgccggtgtgcgcgacggtgccgcccaaagcctgcgccatggcctgaaatccgtagcagatgccgaacaccggcacccccaggtcgaacaccgccggatccagctgcggggcgcccggctcgtagacgctggacgggccgccggagagcaccagcgcccgcggctggcgggccttgatctcctcgatcgtcgcggtgtgtggaatgacctcggagaagacccgcgcctcacgcacccgccgggcgatcagctgcgcgtactgggcaccgaagtcgaccaccaacacgggtcgagcgggcggttcgggcacctcggtggggggggattcggccacgccagaagtctagtggccgcctccgccggccccggcccccgaggcccgcagcgaaagcgcggcaccgagcgaattctatgccttcgatatgagcctcccggtcgctgctgataacgataatcattttcacttatcttttcggtgattccgcaagcccgcccagcccaggagttgccgtgacgacagtgcccgcgatgaccgcaccgatctggatggcgtccccgccggaggtgcactcggcgttgttgagcagcggccccgggccggcgtcgatgttcgccgccgcggcggcgtggagcgcgttgggcgccgaatacgcctcggcggcagaggaactcagcgggttactggcgtcggcgcaggccggcgcgtggcaggggccgagcgccgcgtcctatgtcgccgcgcacggcccgtatctggcatggttgacgcgggccagcgcgcacagcgcggcggcggccgcccagcacgagaccgcgggcaccgcgtataccgccgcgttggcggcgatgccgacgctgccggagctggccgccaaccacgccgtccacggcgcgctggtggcgacgaatttctttgggatcaacaccattccgatcgccgtcaacgaggccgactatgcgcggatgtgggtccaggccgccggcaccatggcgacgtatcaagcggtctccaccgcggcggtggcagccgtcccgcagccggacccggcgccgtccatcctgaaatccaccgcggcgcacgaccacgacgaccacgagcacggggatgaccacgatcacgaccacgggttcgacagcccgctcaaccagttcgtcgcccagatcctgcggctgttcggcatcgactgggacccggtcgagggcaccctcaacgggttgccgtacgaggcctacaccagccccgccgacccgctgtggtgggtggtgcgggccctggagctgttttccgatttccaacagttcggggccctgctgcaggaaaaccccgcggcggctttccaattcatcaccgaactggtgctgctcgactggccgacccacctggcccagctcgccagttggcttccgacgcaaccccagctgctgttggtgcccgcgctcgtcgccgcggcgccgttcggggcgctggccggcttcgcgggcgtggccgggcagccgcccctccccgcgccggtcgcggagccggcgaccccatccgccgcggcgccgaccggcctgccggcgacggccggcgcgaccccgatcgccgcttcggccgcggcttcggggccggcgcccgcgcccacgcctgcgcctacggcggccaccgtgtccagcccggcaccgccggcgccaccggccccgggcgcggccccgtttgcgcctccctacgccgtcccaccgcccggtgctgggttcggttcgaaagcgagagcgagcgtcgacacccgcgcgaaaagcaagtcaccccaaccggattcgaatgcagtcggcgccggggcggccgtccgggaggcggcacatgcccggcgccgccagcggtcgcggcgccgcggcgacgaattcatggacatgaatgtcggcgtcgatccggactgggacgagccggcgacgacggcgtccccgcgcggtgccggaaacctgggcttcgccggcacggcgccccgggaaaccgttgcggccgcgggcctgacccagctggccggggatgagttcggcggcggggccggcatgcccctgctcccgggcagctgggccccgccggacccgcgcgacagcggggtctgacgtccggcgcgccggcgatcggtggcgacatgtcccttccgcatggtggagtggataccgcccgaccccaaccaccggaagcgagtgcccgtgctgggtctgcccgagaaagtgcacgcctgcctgttcgacctcgacggcgtgctcaccgacaccgccagcgtgcacaccaaggcctggaaggcgatgttcgacgcctacctggccgaccgggccaagcgcaccggcgagacgttcgtcccgttcgacccggccgccgactaccgcaaatacgtcgacggcaagaagcgcgaggacggggtgcggtcgttcctgcagagccggggcattcacctgcccgacggcagcccagacgacgcggaagacgccgagacgatctacggcctgggcaaccgcaagaacgacatgttccagaaggtcctcaaacaggacggcgtcaaggtgttcgacgggtcgcggcgctacctcgaggcggcctcggccgccggcctgggcatcgcggtggtgtcgtccagcgccaacacccgcaacgtgctcgaggtcaccggcctggaccggtacgtgcagcagcgggtggacggcatcacgctgcgcgaggaacacctggccggcaagccggcgccggactccttcctgcgcggggcgcagctgctcgacgtccccgccggcgcggcggcggtgttcgaggacgccttgtccggggtggccgcgggccgggccggtaatttcggtttcgtggtaggtgtcgaccgggtgggccaggccgaggatttgcgccgcaacggcgccgacgtggtggtcagcgatctcgccgagctgctggcgtcatgatcgccgacgaatcgtttcccgtcgacccctggcacgtgcgcgagacccagctcaacctcaacctgctggcccagtcggaatccctgttcaccctgtccaacgggcacatcgggctgcgcggcaacctggacgagggcgagccctacgggctgccgggcacctacctgaactccttctacgagatccggccgctgccctacgccgaggccggctacggctacccggaggccggccagacgctggtcgacgtcaccaacggcaagatcatccggctcctggtcgaggacgagcccttcgacgtccgctacggcgaattgctttcccacgagcgcactctcgacctgcgcgccggaacgctgacgcgaagcgcgtactggcgctcgcccgcgggcaaagaggtcaaggtggtctccacccggctggtgtcgctggcccaacgcggcgtcgccgccatcgagtacgtcgtgcaagccgtcggcgacttcgtccgggtgacggtgcaatccgaattggtcaccaacgaggaccagccgcagacctcgggcgacccgcgggtgtcggccatcctggagaacccgctcgaagaggtcgaccacgaaaacaccgacaccggtgcgcttctcatgcaccgcacccgcagcagcgcgctgatgatggccgccggcatggaccacgaggtcgaggttcccggacgcgtggaggtcagcacggattcgcgggccgacctggcgcggaccacggtgatctgcgggctgcgcgccggacagaaactgcgcatcgtcaaatacctcgcctacgggtggtcgagcatgcgctcgcggccggcgctgcgcgaccaggtggccgccgcgctgcacagcgcccgctacaccggatggccggggctgctggaatcgcaacgcaagtacctggacaacttctgggactgcgccgacgtcgaggtggagggcgaccccgaatcccagcaggccgtccgcttcgggctgttccacctgttgcaggccagcgcccgcgccgaacgccgcgcgatcgccgccaaagggctcaccggaaccgggtatgacggccacgccttctgggacaccgagggatacgtgctgccggtgctgacctacaccgcgccgcacaccgtcgccgacgcgctgcggtggcgcgcctccaccctggacctggccaaggagcgcgcggccgagctgggcctggagggcgccgcgtttccgtggcgcaccatccgcggacaggaatgctcggcctactggccggccggcacggcggcctggcacatcaacgccgacatcgcgatggccttcgagcgctaccgcatcgtcaccggcgacgacgacctggaggccgagtgcgggctgccggtgctggtcgaaaccgcccggctgtggctctcgctgggccaccacgaccggcacggcgtctggcacctcgacggcgtcaccggccccgacgagtacaccgcggtggtccgcgacaacgtcttcaccaacctgatggccgcgcacaacctgcgcgtcgcggccgaggcctgcaaccgccaccccgatggggccaaggcgctgggcgtcaccaccgaggagaccgcggcctggcgcgacgccgccgacgccgtcaagatcccctacgactccggcctgggcgtgcaccagcagtgcgagggcttcaccaccttcgcggaatgggacttcgagcacaacaccacctacccgctgctgctgcacgaggcctacgtgcgcctctacccggcgcaggtgatcaagcaggccgacctggtgctggcgatgcactggcagagccacgcgttcacgcccgagcagaaggcccgcaacgtcgactactacgagccgcggatggtgcgcgactcgtcgctgtcggcgtgcacgcaagcggtgatgtgcgccgaggtcgggcatctggaactggcccacgactacgcctacgaggccgccctgatcgacctgcgcgacctgcaccacaacacccgcgacggcctgcacatggcctcgctggccggcgcgtggacggcgctggtgtccgggttcggcgggctgcgcgacgacgagggcgtcctgtcgctggatccccaactgccggacgggatttcgcggttgcggttccggctgcggtggcgcgatttccgggtcaccgtcgacgtcaaccacgccgacgtcacctacacgctgcgcgacgggcccggcggcgagctgaccatccagcacgccggcgccgagctggagctcagcacccagtccccgaccaccgtcgcggtacgtccccgcaagccgctgctgccgccgccgcagcagccgccgggccgcgagcccacccaccggcgggcggtgtcgcggtcgtcgccgggtcagtgagggccgggggacctcaggatccgctccacctcggcgccggccgcccggcgtagctcggcgtcggtcagctcctcgatccccgtcgccgcccgcagaatgggcgcgaacagccgccaaccgaactgcagcgtgcacaccaatgaaaatccttgtgaaataagataatacagcgcctgcgccggcggcggggatccttggcggacggcccgccgatgggacaggatcgacggcatgaccgggatcgacttctcgttgttggacgtgccgcgagccgcaccggtcgacgaccccgaggcctacctgcgcgccgtgatcgcctggcacttcggggcggacaccggttcgccgttctggctgcggaccgcccggacgctgagcttcgacccgttgaccgacgtgcacacgttcgacgacttgcgcaggtttccgaacctggtcaacgaactgcgccacgtcgcggtgggcgatctcatcccgcgcggctatccggcccaggaccgcccgctgatcttcgaatccggcggcaccaccggcgcaccgaaacgcaccgtgcagatgccggattgggtcgcccaggtcgtcgactggcagaccgaggacttcgcggccggcgggtttcgccgcggcgaaggcttcctgtgcatgatgccgagcggcccgcacggtgtcggctacttctcccggctggtgtcccagcggctcagcgcggtgttccacgccgtcgacatcgacccgcgctgggtgaagaagctggccgcccgcgacgccgccgcggacgtggccggctatgtcgagcacgtcgtcgagcaggccgtgttcgtgctgcagacccaggacgtggcgaacctgcacaccaccggtccgctgctggcggcgatggcccgcgacgaccgggtggtcgagctggtcgacgccaagatcggctacctgttgctcagcggcgcgcacgtcgacgccgacaccctcgacctgctgcgcggcatcttcccgcggaccacgatcaccatggccttcggcagcaccatggtgctctcgcaggcggtcacccgcaccgacggcgatacattcgtcttcgacccccgcaccccctacgtcgtcttctgggtggtcgaccccgacaccggcgaacgggtgcgctacgggcagcccggccaggtggtgatgcaccacctcagcaggaccatgttcatcccgaacaacctggagcgcgacctggccgtccgcaggcccggcccggcgggtgagctcagcgactcgctcagcgaggtgcggccggtgcaaagcttcgagggtgaggccgtcatcgagggcgtgtactgagacgtgacggatgaaaacccttgcagcgccggcgatctgctgtatcttgatgcgctcggacccgacggcgactaccggacccgcaacaccgaaaccgtcaccagcaccgccggggtggccgtcgcgcgactgagtctcgttccgccgctgtatgtttcgcgcacgctcggtgcgcaacgcaaggccgcgccgctgccgcccgccgaccggcgggcggcgctgtcgcgggccgccgaggtgttcaccgacggggtgatcgccggactcgatttcgaggcgtacgccggtttggccgcccggatttcggggttgcccgtggcgatcacccgcgccgcggcgcgcggtgtggccgacggcctggccggcgcgttcgacgcggtggcctcggcacggccggcgggggcggtgccggactggcgcgagccgcgcgtccgtgggggcggcgcgttgtgggtgcggcgcggcgaggtgttcgccgtgcatgccgccggaaacgggcccggggtgcacgggctgtggccgcaggcgctggcgctgggctaccgggtggcggtgcgcccctcgcggcgcgagccgctgaccgggcaccggctggtgacggcgttgcggcaggcgggatttcgcccgcacgacgccgtctacctgcccaccgatcacgccggggccgacgagatcatcgcctcggccgacctggccatggtgtacggcgggcaacgcgtggtggacaagtacgccgccgatccggcggtgatcgtgaacggccccggccgcagcaagatcgtcatcaccgccgagcaggactggcgggagtgcctcgacgtcgtcgtcgactcggtcgcccgccacggcgggatggcgtgcgtcaacgccaccgcggtgctctacgagggtgatccggcgccgctggccgcggccgtcgcggagcggctcgccgcgatcgagccgctgcccgccgacgacgagcgggcgatgctgccgaccctgccgctgccgcgggcgcgcaccctggcgaactacctggcggccaaggccgccggggcgacgacgctgctgggggccgaccaggtggtcgccgacctcggcggcgggcaggccgcgctgcgcccggccgtacacgtgctgaccgagccggacccggaactgctcaacctcgagctgcccttcccgtgcgtgtgggtgacgggctggtcgcgcgagggcgggcgggccgcggcgctcgcgccgctgcggcgctcactggtggtcaccgcgatcaccggcgacgacacgctgatcgacgccctggtcgccgagccgaccatcggcagcgtctaccgcgggtgcccgacgtggtcgaccgccccgggcgtcccgcacgacggatatctggccgacgcgctgatgcgcaccaaggggttcatcggggactagcggcccgcggtgcgctcactccccgaaattgccgtgcccggaggcgaccgacgccgcgccgggaccgccgaggccgaggtggctggaggcgaaggagacgcccttgtcgatcatggcgccgtcgtcggcgtaggtgtcgtgggcggcgaagttcatgccgtccgagcacaccggatcctcggtggcgcacaccttgagggtcttgtcctggaagagcggaccgatgaccacaggcggttcgccgaggaagttcatcgcgcgcacgttgggcatgccgaacagcacgaccgaggagacgtggttggcgacgtccggggtgaggggtttgggcacggtggccgggtcgatgccgtcgggcacggccggcgaggtgacgaagcccatcacggccgcgccctgcgagtagccgccgagcaccatcttggtgttggggcagtcgtgggccatcgagacgacgtgtgcgccggcgtcccggatgccgtcgatgccggtgtcccactgatcggtggccgggtagttgaccgggtagacgtcgaaggagcggccccccacgcgttggtgcagggcgtcgacgaaggcctgtccggtggggccgacgccgggggcttcaccggtgccccgcgcgaagaccacttgcacgtccggacattgggccgcagcggtggggatgaccgaaccggacaccgccgacgcggccacacccgaggctgccataactagtgctgaaccgagagaacgaatgacatggcgtgccaacatgtcgccattgtgcccagccgacacgccgcttaaacccaggaaacgctgaaattaccgtgttctcataaatgcgccgccgcccgggcggacggctgagatcggttgcgcgcggcgcgcatccggcgggtgtgcccatccccgggcgcgggtgcgccgcaccggcattcggcgaacatccgggccggggcacgacggccggccgggatgtggtctgctacttgtggttcaggcggctcgaacgaatgcggcggcgaaggtgaacgcaatagcgcaggccctcgacaaggtcctcaacacggtggccgaccgggtggccaacccggcgcgggtgtcggacccggaccggttgcgcggcgccgtcggcggcaggacggtcctggtgaccggcgcctcctacggcatcggcgaggcgaccgcgcgccgcctggccgccgccggcgcgacggtgctggtggtcgcccgctccgaggagcggctcggcgagctgacggcggcgatcaacgccggcggcgggcgggcggtcgcctacccgaccgacctcaccgacgaatccgcggtcagcgccctgaccaaacagatcaccgaggaacacggcccgctcgacgtcgtggtgagcaacgccggcaagtcgctgcgccgctcgctgcatcaccagtacgaccggccgcacgacttccagcgcaccatcgacgtcaactacctggggccggtccggttgctgctcgggctgttaccggccatgcgcgacaacggccgcgggcacgtcgtgaacgtgtccagcgtcggggtgcgggtggtgccgggtccgcagtggggcgcctaccaggcgtccaagggagccttcgaccggtggctgcgcagcgtggcccccgaattgcacgccgacggcgtgcacgtcagcacggtctacttcgcgttggtccggacccggatgatcgcgcccacaccggttttaggccggctgcccggcctgtcgccggaccaggcggccgacgtcatcgccaaggccgtcatcgagcggccgcgcaccctcgagccgccctgggtgctgccggccgagctggcctcggtgctgctggccggcccggccgaccgcgccgcacggctgtggcatcgccggttcttcagcgacgccgaggaggccggccgtgagcgctgaacgggtggcgcccaccgccgcccgggcgctggtgcgctccggtctgctcaacccgccctcgccgcgggcggttctgcggctgcttcgcgaggcgagccgcggcggcaccaacccctacacgctgttggcggtcaccgcggcccgctggccgggccgcaccgcgatcatcgacgacgacggcgcgctgtcctaccgcgagctgcagcgcgccaccgaatcgctggcgcggcggttgatccgcgacggcgtcgcgcccggccgggcggtcggggtcatgtgccgcaacggacgcggttttgtcacagcggttttcgcggttgccctgctcggcgccgacgtcgtcccgatcagcaccgagttccgcagtgacgcgctggcggtcgcgctgcgcgcccaccacatctcgacggtggtggccgacaacgaattcgccgagcggatcgcgggcgccgacgacgcggtcgccgtcatcgacccggccaccgccggcgccgaggagagcggcgggcgaccggccgtcgccgcgcccggccgcatcgtgctgctgacctcggggaccaccgggaaacccaagggggtgccgcgcgccccgcagctgcgctccgcggtgggggtgtgggtgaccatcctggaccgcacccggctgcgcaccggatcgcgaatctcggtggcaatgccgatgtttcacgggttgggcctgggcatgctgatgctcaccatcgccctgggcggcacggtgctgacccatcgccatttcgacgctgaagccgcgctggcccaggcctcgctgcaccgggccgacgccttcaccgcggttccggtggtgctggcccgcatcctcgagctgccgccgcgggtgcgggcgcgaaatccgttgccgcagttgcgggtcgtgatgtccagcggcgaccggctcgatcccacgctgggacagcggttcatggacacctacggcaacatcctctacaacggctacggttccaccgaggtgggcatcggggcgctggcgacaccggcggacctgcgcgacgccccggaaaccgtcgggaaacccgtcgccggctgcccggtgcggatcctggaccgcaacaaccggccggtcggcccacgggtgaccgggcgcatcttcgtcggcggcgagctggccggcactcgctacaccgacggcggcgggaagaccgtcgtcgacggcatgaccagcaccggcgacatgggctacctggacaacgccggccgactgttcatcgtcggccgggaggacgacatgatcatctccggcggggagaacgtctacccgcgcgcggtggagaacgcgctcgccgcgcaccccgccgtcgccgacaacgcggtgatcggcgttcccgacgagcggttcggccaccgcctggcagcgttcgtggtgctgcaccccggcagcggcgtcgacgcggcgcagctgcgcgactacctcaaggaccgggtctcgcggttcgagcagccgcgcgacatcaacatcgtgtcgagcattccgcgcaacccgaccggcaaggtgctgcgcaaggaactgcccggttaggaaccgttaggcatcctgctggccgggctcgagggcggcgacctgtttggccagccagttgggggccagcgccgagatcgcggtggcgcccgcggtggaacccagcaccccggtccaggcgaccggccccaacggcgtgcagccgaagaactggctgagcaccggggtctgcacgatgccgaccaacacccccgcgctgcccagcgcggtcgccaccaccagcgggctgtgccggcgggtcagcagcgtctgcgccagctgggtggtcaccagcgcggtcaaacccattgtcgccgtgcggcgttcggtgcccggggtccaccggccgatggcccaggccgcggtcgccccggccgcggtgaccgcgccgcgggtgacgatctggcgcatcagcggggcgtccagcgagggggtgggtccggtcagcaccgcgcggcggtgctcgcgccgggcggcctcggcgtccgcggcggaggggtactcggcttcgtcgggttcgacgtactgcgaggtgaccgcgaccgccagcgcggggaacatgtcggtgagcaggttgaccagcagcagctgccgggtgcccaccggcgcccggccggcgccgaaggcggtcccgatgatggtgaacagcacctcgcccacgttgccgccgaccaggatcgtgacggcgtcgcgcaccccggcccacatgctgcggccctcgaccagggcgtccagcagcacgctcaggtcctggtcggtcagcacgatgtcggccgcgccgcgggcggccgacgaaccgcgcccgctcaccccgatgccgacgtcggccatccggatcgccgcggcgtcgttggcgccgtcgccgaccatcgcggtcacccgtccgcagcgctgcagggcggccacgatctgcaccttctgctccgggctgacccgggcgaacacctgcacgtcggcgaccagtttggcgcacgcgtcctcgtccaggccggccagctcggcgccggtgaccacccgggcgtcggccggcaggcccagctggcgggcgatcgcccgcgcggtgatcgggtggtcgccggtgatcagcacgacgtcgcgctcggcgtccagcagcgcctcgatcagcgggcgcgccgacgcgcgggcggtgtcggccagaccgacgtagccgagcagttccaggttgtgcgcggcggcgtccaccgcgtcggcgtcggtgtcgtcgtcgtcggtgtcgtgcttccagccccgctgcgccaccgcgagcacccgcaagccctgttcggcgaggccccgcaccaccgcctcggcccgctgctggtcggcctccgggtcggcgaaccggcagcgcggcaggatcacctcgggcgcccccttgaggatgagcaccggtgtgtccgaggggttcccgttggcgttgccgacggtgccgatcgcggcggcgaagccgcggctggactcgaacggcacctcggcgatcatcgaccagtccgaatcccgttgcccgttcagcgaactcgcggcggtcaggatcgcctcgtcggtggcgtgcgcatgcccctgcccctcctgcggccgggcggacgcccgcgcggcggcccgcaccagctccgccgactgcggggcggtcagctccgggaacgggtcgtgcgggttgacgtcgtcgggcaccgcgcacaccacccgcagccggttctcggtgagcgtgccggtcttgtcgaaacagacggtgtcgacgcggcccagcgcctcgatggtgcggggcgcgcggaccagggcgccgcgggcggtcagccgctgcgcggccgacagctgggacagggtggccaccagcggcagcccctcggggacggcggccaccgcgatcgccacgccgtcggccaccgcctggcgcagcgacgcgcggcgcagcagcgccagcgtcgacaccgcggcaccgccggccagcgtcagcggcagcaccttgctggtgagctcgcgcagccgggcctgcaccccggccgcggtttccacgtcggcgacggccgagatggcgcggtgcgcggccgtccccacgccggtggccaccacgatcgcccgggcgtgcccggccacgatggtgctgccctcgaacagcatgctggcgcggtcggggtcgttgacggcgacgggctccacctgcttgtccaccggcagcgactccccggtcagcagcgactcgtcgacctcgaggtcttcggcctccagcagccgggcgtcggcgggcaccacttccggtgcggccaggtcgatgacgtcgccgggccgcagcgacttggcggacaccgtcgcggtgcgggtggcgtgccgggcggcctccagtcggcggcgggtggtcgccaccgccggcaccaccacccggcgcaccatctggtcctgctcggcgaacagctcggcggccgccgactcggcccgaagtcgttgcgccccaccggttatcgcgttgacggtcatgaccccggcgaccagcagggcgtcgatgttgctgccgacgatcgccgaggccgccgcgccgacggccaggatgggggtcagcggatcggccagctcggtgcgggtggccgacgccagccgcagcacgttctgcagcggcgcccgcagcggcgccagggccgggctgtaggacaggtcgtcgaggcggcgccgccacgacggctcggtctccacggccagcggccgcgcgccgccggccagccgggagtagacgatctcgggatccagcgcgtgccaggcggtcagcggttgcggagtgggatcgggcagccgcagcacccgggtggccgagaaggttcccgccaccagcgcggtggccgccgcggcgttgaccgggttgagccagcgccggaagctcaccgggctggcgcccttctcctgctcaccggtgaccagcagcagcccggccagcgtggtgccgccctgcgccaggtgcaccgccgactcgctggccgagcgggccaccgggatcgccgacaggatccgcaccgcgtcggccaggtcggtgccggtgatgatgtcggcggtccaggccgtcgcggcgcgcggatcatcaagggccacaccgacatccgcgatggccagggcggccagggtgtcggtcgacgcgaagtcgcggtgcagcgcggtgatcagcagcaccggcccccggtcggcgcgcagctcgcggaccacgttcagcagcggggtgccgggcggatgcgtggcgccgacgctggcggtgaggtcctcggtgccggcgacgtggcgcagcaccacccgggcgccggtgcggtgcgcggtctggaatagcggaatcgcgtacgggtcgacctcccagcccacgtcgacgcggccgacgcggtcgccgtcgacgatcaggtcggcgctttccaggccctgcgcgggcatggccgaaggtccttgggacggcacccatctcagccgggcgccggtcgcgggcaactcgtcggggtcgggctcgggggcctcctcgccgtgcagcagcgcgtcggcgacctcgtagacccggtcgtcgtcccagccgggcgcctcgccgcggacccgcagcacggcgcggtggtcgccgcgcagcgcggcgccgtcgatgaccaccaccttgacccggtccaggcggcgcagcgcgccggggtcgagcaccagctgcccggagttggccagcccgcgacccagcaccgcggcgaacgcctggcgacccatgtgcgcggcccgcggcaccccggcctcgatggccgccgccacgtcctcggtgccgccgccggccaccagcgcgctgaccgcggcgatcaacgagccgttggccgcggagtcgacgtagctttccaccggccccgccatcgagcccttcgccttgtccatcgcggcgtcgatggtcccgccgaccacgacgtgcgacgcctcaccggcggccgcggccgcccagctgtgccggggcacctcggacttggccgacgagatgaccggcaccaccggggcctgcggccggtccggcgaggccagctgtggctcgcggtcccgccacacccggcggtgtgccgccgcctcggaaatctgcagggtgcgctgggtcaggtcgagcagcggggtgccgaacgactgggtgaggccgtgagcggcggccgtcgtcgcggcgagcgcgatgtcggtgcccacccggcccagccgcgcctccaggatggacaccatgcgcggttggtggttgatcagcgcggccgcggcccgggtggtttgcggcgcggcgggcagccgggtcacccagccggtgaccgccgcacccatggccaccagatccagcgccgccgcggtgagcggcaccaggatcgccagcgggttgcccgggtcggcgaacggcgccgacggcggggccgcctccgccttggaccagctgatgtccgcggcgacggaggccacggtcgagcgcacctcgtccagcacggcggcgtcgtcggcgtcgtcggcgagttcgaccaccagccggcccagcgagccctcgacgtgtgccttggccacccccgggatcctgcgcaccggctcctcgacggccggcgcgtactcgtgccagcgggggaagggcagcagcgggtccaggtccaggtgcacgcgccgcccgctgtgcaccaggtccaggtgcacgcgccgcccgctgtgccagcgcaccggcgggacgatcgcgggcgcgccgtcggccgagccgtccaacccgatggcccggccggtggtctgcgccatcgactggatcaccgggccggcgagctcggccaccgggctggccaacgtctgcagggcaccggcggctcccgccgcggtggatacgccggcccgcaccacctgtgcggccccaccagccaccccagcgacgacgctggaaacgccgggaatcttcactcgtcacccttcaattacgtctccgcggtcaatgatcctgacctgtgcaggagctgtccacacgtgggtcgggaaggtgaaccgtgcgacgacgcccctggcgacgcaggtcgggctttcccggcaagcagcttcttggagaaagcgaggaaaaccattgaggtgcaatcacgtccttggacagaggttaccgggttgacgacaactcaaacgcgccgaacgaagcggcctcccaatagcgccgggccgacgggccgggcgcttcggacgccatccggcggccgggcagcggccaaggggcgcaagctttttcgccggttggtgcaccggggagaattgcgcgtcgaagtccggggaaacgtgaatgcgcggtagccgtcgaccggctatcggtgcgctattcgggtcgaaggaccggcaaagaattggcggctacaaaacccggtggttcgcccttcccacgtgatatccggtggggaaggatttctcaatgacctgcagctgatggtccacccgggactcgagttcgagcaccacgcagtcgttgagtgtcttggattccagaactatgtagcgttggccgcaatccgtaatcggatcaccagagtgcaaattttcgacggggaccaattccgggtttccgtgtgcctccacccaccacacgttaggtcaattcggtgggggagggaatagcgtgtcagcgcccctgtttgaagaacacgctgatatgagagatcagcccgtcgccgcccctctcgaacaggatgcactccggccaccgccgggtggcgccgtcgatgtcgaacgcctcggtcaattcgacgtagcagcgcccggcgtccacgtgtgacacccgctgcacctcgagccggtggccgggcagctcggtgaggaccctgcgcaggtagtccaggtattcggccttgccctcgatgacgtcgcggaacgggccctcccgggtcagcccgtcgtcggcgatggtgccggccaggccgtcccagtcgtgcgcggccaggcactgcaggtagcgctcgaccacgccggtcccggccggatcgggggactccacggacctcacagtaggccagccggataggaaaaaatactgcggcaaagccgcgcgcggggccggccgcggcgggaaacaatggagcgatgagccaaccggacgcactgccgatgagctggtgggtggtgggctccgagcacacgctgagccagcaggtgccggccccgccggccgcggtccgcgacttctacgtcgatttggacaacctcaggctggtccacccgctgatcgtcgcggtccagacgctctttcgtgggcagaccccggacggctacctgcaccgctaccgggtgacggaccggatcccgttggggcccttggccttacgcatcaactatcgggcccagctgctggtgcgcgcggacggggtggtgctgaccgaggccgaccagtcgccgggggtgcgcctgcgcggcacggtcagcttcgcgccggcggccgccggcacccgcatcaccgaacggatccggatcgcggcgccgcgaccgctggccccgatgaccgtccggcaggccgtcaaggcgcacacggcgatgctcgccgggatccggagccacttcgcgaatccggttgagcggtagcgcaagatggattcgtgccacgccccggcgtggcccgggggacgccaccagagagcaaggagccgcaatgaagtgtcgtgccgccgtgatccgcggggtcggccgggactgggagatcgccgagatcgagctcgacccgccgcgcagcggtgaggtgctggtgcggatggccgtcgccgggatctgccactccgacgaccatctgttcaccggtgacgtggtgccgacgcccgaggtggtcgccgcgagcggtcagcccgcgccggactggttcccgctgctcggcggtcacgagggcgccggtgtcgtcgcggaagtcgggccgaacgtgacgtcggtgcgcccgggcgaccacgtggcgctgtcgttcatcccggcgtgcggcagctgccggttctgcgtgaacggccagagctacatctgcgacatcggcgccagcctgtttcagcgcgagatgcccaccgacgggacctgccgccgccatctcggtgcggaaaacctgttggcctacgggcaactcggcaccttcgccgagtacgcggtgctctccgaacggtccgtcatcaagatcgacgaggcgattccgttccatgccgcctccctggtgtcgtgcggagtcagcaccggatggggctcggcgacggtgtcggcgggcaccgaaccgggcgacaccgtggtggtgatcggcgccggcggtgtcgggatgaacgcgttgcagggcgcccgcgcggtgggcgcgaagtacgtcgtcgcggtcgatcccgttgcggccaaacgggattcggccaagatcttcggcgccacgcacaccgccgcgtccgcgcgggacgccataccgctggtcagggagatcaccgccggcctgatggccgaccgggtggtggtctgtcccggcgtggtgcacgtggacttgatcccgttggcgctggcgctgctgcgcaagggcggggtctgcgtgctgaccggcatcaccccgttcaccgagcccccggttccgctggtgctgcaggagatgacgctgtcggccaaacaactgcggggcgccctctacggcgggatgaatccgcgcaccagcgtgccgatgctgttgtccctgtatcaggcgggcgatttgaaactcgacgagttggtcacccgccactaccggctcgacgagatcaacgaggcattcgccgacctgcgcgagggccgcaacatccgcggcgtcatcgacttcgccagccggtagccgctaactcacggcgcgatccactccgaggtcagcgcgtactccgacagatacttcgtcgaactccatccgccgtcgaccacgatcgtctggccgttgatgaaacttccgcccggcgagcacaggaacgcgacggtggcggcgatgtcgtcgacgctgcccaaccgttggtgcggtgtcatctccgtgttgatcttgcgaaagcgcgggtcctgcaaccgcttttccaccatcggggtgaccgtcacccccggcgcgacggcattgcagcggatgccggaggcgccgtattggcaggcgatgtgggtggtcagcgcggtcagcccgcccttggccgcggagtaggcgccgccgcgcaggccgccgacgacggcgaacgtcgatgtcacgttgatgatcgccgatccgggcggcaggtggggcagcacctcgcgcgcgagccgaaacggtgcccgcagcatcaaattcaggaagtagtccagggtgtcgtcgtcggtttcgtgcagcggtttggggctgcccacgccggcgttgttgatcaggaagtcgatgtggccccaccgctgcagggcgcggtccacgatgcgccgcggcgcgtcgtcgtcggtcaggtcgaccgcgacggtggcgacccggtcggggtcgccgatcgcggtttccaactcggccaaccgctttgggtcgcggccggtgccgagcaccgccatgcccgtcccggccagcctggtcgcgcagcccaacccgatgccgctgcttgcgcccgtgacgatcgcgacctgcatgtcagccatccttactcagcgccgcgcggatccgatgcttgagcaccttgccggcgtcgttcttcggcagggcatcccagagcaccacttgttcgggcgccttgaacttggccacccccttgctcaccagcagcgccagcaggccggccacgtccgggctcgccccgggggtgggaacgatgaccgcgcacgcccgctcgccggtgcgctcgtcgggcagcccgacgaccgcgatctcggcgatgccgggatggtcggccagcaggtcctccacctccttggcggagatgttctcgccgctgcggatgatgacgtccttggcgcggccggtcacgaccaggtaccggccggcggaatcggctaacgcccagcggcccaggtcgccggtgcggaaaaaccctgcggcgtcgaaggactcggcgtcgtcctccgggtggcggtagccgcgcagcatctgcgggccgcgcacgcagatctcgccgtcaccggtgggcgccgccgggtgcgcggcgagcttgatctcggcgatgccgggccggccgtcggtatcggcggcgtagtcggcctcctgcggtcggggagccccgacggtggccaccggcacctcggtgcagccgtacacccgggtgacgaccgcgcggtcgaaataggccgcggcccggcggatcagtgacggcgacaccgaggcgccgccgcagatgaacaccttcaggtcgggcaggcgggtgcgggcgttcgcggcggccgagagcagctgctgcaaaaacggtgtggccccggccatgtgggtgcagcgatgcgcggtcatcaacgccaccgcccgcgccgggtcccaccggtccatcagcaccgccgtggtgcccagcagcagcgggcattcaaacgcgtagatcgagccgccgatatgggcgagcggcgacggcaccaggaatgtgtcgccgggatcgatcgcccagtggtcacggatctggcagatcagcgcatgtatcgaattatgggtgtgcagaacacctttcgggcggctggtggtgccggaggtatagaggatcatccgcaccgcatcgggatccagggccggaagacccccgggcggtccgcccagcatgcagcggtacggggtgtgccgaccggttcgtcccgttgcggggccgcgcagcaccaccacctgcggcgccgcactcatcgcggccgtcacgcggtccagcatcgccgggtagtcgtggccgccgtaccggtgcgggacgaaaaccattgcagcgcaggcatcctcgaggatgaaacgcaggtcgtggtcgcgcagcgacggcaggatcgggttcaccaccatgccggccagtgtcgcggccaggtagatgaccgcggcctcgtgccagttcggcagcatgaacgacaccacgctgccggccgggatacgggccagcagggcggcggccagctcgccggcctgggcgtacagggtggcgcagttcagccgaacctcgttgtccaccaacgctatccgctcgggcgtacgttgcgcagcggcgcgcgccgcgtcggccagtgtgctacgcacccaccagccgcgccggtaggccagcgatgtttgcgcggcgtccggggcggtgcgggcggtcatctcaaccggcctgaccggtgacgcggcgcatcgtcatcgcgtaccggaagttcggggacaggtgggtgttgatcgtcacctgggccacctcgccgtcggaggtggtgtaggtgcgccgcatctgcagcgcggccgtccccgcctcggcgcccagaccatcggcgagttccggcgacagcagcaccgcggcgatctcctggtgcaactgggcgacgctcacaccgaacaggtcctcgatcaacggaaagatcggcccggcatgccgttgcagcagccggccgaccgcggcgaagctgcggttgatgtagtactcggtgcggcagatcggcaccgaggcgccgtcggcctgccggtagccgcgcaccgacagccactgggtgccgggctcgagtccggtccgggcggccagctcgtcgtcgatcgtcaccatcgcgttggattcgatggtcagctgcgcgccggccgcgaacgcgagcaggtcgtcgatcgacatcgcgtcctgggcataggaactcgacgccgggcggggaaccacccgggtgcccgcccgcggccgggacgcgaccaggttgtcctcgcgcagccggcgcagggcttcgcggatggtgtagcggctcaccgcgaagcgttcgcacagttggtgttcggtcggcaactgcgaccccaccggatagaccccgtcgacgatctccttgcgcagcgctcgcgcgatctgcagatagcggtggtcgccggagatggtctgcggcatcagtggccgtcccgggtcggccgcagcgccagcacgctgccctcgccgtcggccgagacgtacagtgtcccgtcggccgcggcggtgatcccggcgaacgggccctgcggcccggagaacggcggcatgcccttgagcggcttggggttcacccccggcgggggaccgaccggcaggccggacgcgatggttcgccgcgtcttgtcggccggatcgaacgcgatcagctccttggcgccggcgtcgaccacgtagagcacacctccgtgcagcagaatgccttgcgggcgttgcagatcggccatcacggtgtcgaccttcgagccgtccacccggaccacccgcccggctccggcctcggccaccagagccgccccgtcgtggccgatcgcgacaccgaccggctcacgcagcccggccgccagcacctcgacggcacccgagcgctgcagcgacagcacccggccggtgcccagctcggcgaccaccacgccggccggccccggggcgatgccgtagagctggtcgaaaccgtctgccagcacctcgctttcgctggcctcgggccggtagcggctgatctgcccgccggacgtggtgacgacgaactcgtccggtccactcgccgcgacgccgcgcaggaacccgggatagccggggctgaacagcatccccacggtgtgcagggcgccgtcgggcagtgcggcgtagaagtaggtgccgtcggcgacgtagagccgcccgtcgtggccgaccgcgaggtccagcggccagttgagtccaccgggcagtacggatcgcgtggtgccgtccggtgatatctcggtgatctcgccggtgaagttggagacgaacagccggtcgccgacgaaggtgcagttgtccaggccggggttcagctgggcgagcacccgctgctcgccgctgcgcggatcgatgcgcagcacctgcccgctggccacctgcgtcgagacgatgtggccgcgtgcgtcgaacttcaccgagtcgggcacaccgagacccgttgcgacgcattgcggttcgccgccgtcggggtcgacgcgccagatctcgttggcgcccatcaccgggaagtacagcagcccgtccgggccgacctccatcgcgttgggtgagggcacgttgtccagcagcacccggggcggcccgccggccaggtcgaattccagcagccggccgccctcccggcactcgccgatgaacaaccggccccgatggaaggtgatgccgttggccgacggcacgtcgtcgcgcagcacccgcgtccggccgccggtgtcgcgcacgctgacccgcccgtccatcacctcggtcgcatacaggttgccggcggcgtcgaacgccacgtcgtcgggcgccacgatgtcgccgcccttggggctggcagtctccagttccccggtgtggtgatccagcgcgctgatctggctcccggtcacctgggcgatgtagatccggccgtcgggaccggtgcgcagaccgttggcgccgaacagccggctgggcgcggtgacccggtcgagccgccaacccggcgcgacgtcgatggcgggcaccggcgaaccgggcgtcgcgtaccgcgagggctgcgtggagatggcccgtgaaatggacatgcgtgccgggatccttccgtccgccgttgggctggacgctatcaactcggtgtagtccagacaatagcggccactgcactgtaggcgggccctgacagccgccttcgccgatcggaatagtgttctccacgggacagaatgcgatattttgtccggacaaaaatcgggtgaacctcgccgccgccggcccgccggtgtccgggcagcagaaagcaggtcatggacgacgatctcctcaggctcgagggccgcgtggtggtggtgtccggcgccggtggcggcggcatcggcaccaccgtcacggccatggccgcccgggccggggccaccgtgatcgcggtgagccggtcgaaggagaacctcgacgagcacatcgccccgctggccgcccgggggctggccgtcctgcccgtcgccgccgatgcctccaccgacgagggcatcgccgcggtgatcgaccaggcgcgccgggcggacgggcggctgtacggactggtcaacgtcgccggcggtgcggaaccgtcgacctggatgccgtcgacccgggtgtcgcgcaccgactggcgcaagatcttcgccgataacctcgaaacggcgttcttcatgagccaggccgtcgcagccgagctcctcgcacggcgactgcccgggtcgatcgtgtcgatctcctcgatcagcggcatgaacaccgcgccgttccacatcgcctacgggacggccaaatccgccatcgcggcgatgacccgcaccatggcgctggagctggcgcagtccgcgatccgggtgaacgccgtggcgcccggcgtcaccgagacggccgcttcccgcacctacgtcgccgacgacccggatcgggatcgacgggcgatcgcgacgggcgatcgcgatgggccgccgcggccggcccgaggagcaggccggcgccatcctgtttctgctctccgagctgtcgagctacgtcaccggccagacgctgctcgtcgacggcgggctggacctgcgatggagtcacctcggcgccgacaacacgtcgctgttcctgcatgacgaatccttccgcgcaacgatcaggaggatgtgatgaccgacgttgccaaggacgcgaattccgcggtggcagaagaactctccacgccgatgacgatcggggtggaggcgtacatcagcgaggactatgcccgcgccgagcgcgacaagctgtggcgcaaggtctggcagcaggtcggccgcgtcgaggaactgcccgaggtgggcagctatctgacctacgacattctggacgactcgatcatcgtggtgcgcaccggcgcgaacgagtttcgcgcccaccacaacgtgtgcatgcaccgcggccggcggctgatcgacacccccgagggcgccaagaacgcgctcggacgcacccgcaagtcgttcgtctgcggctttcacggctggacctacggcctggacggcgcctgcacacacattcgcgagcaacaggattggcggcaggccctcacgcccgacaacacccatctgcggcccgtcagggtcgacacctggggcggctggctgtggatcaacatggaccccgactgcgagccgctggccgactacctgttccccgccgcgaagattctcgagccgttcgggctggagaacatgcgctacaagtggcgcaagtggctctacttcgactgcaactggaaggtcgcgctggaggcgttcaacgagacctaccacgtctacaccacccatcccgagttcaacaagttcggcgagttcaaggggtgggcgaaagcccaaggcaggcatagcaacatcggctacgacgcgcccgaggacatggaggccaccaagtccaagatccggctgggcatcggcgccgacccgcgggtgtcgaccgccgagatgcaggtgtacaccatggaggagaccaacgccaccaccacccagaccctggtgaacgccgccaagcggctggtcgacgagttgcccgagggcaccccggccgacaaggtcctcgagcactggctggcgtcggcccgccgcgacgacgaggcgcgcggcgtgatctggccgaccatcccgcccgacatcctcgggcaggccggcaccgcgtggcagatcttccccaatttccagatcgggcagggcctgaccagcgcgctgtgctacggagcgcggccgcaccccagctacaaccccgacaagtgcatcttcgaggtctcggtgttcgagctgtaccccaaaggcgaagagccacaaacggaatgggaatacaccccggtcggtgacccgcgatggcgttctgtgctgccgcaggacttctccaacatggccgccgtgcagcagggcatgaagtcactcggcttcccgggcaccaagcccaacccctaccgggagcgcagcacggtcaacctgcactaccaattgtcgcggtacatgggtaccggtgcgccccgggaactctcagacaaggagcacccactggcatgacccccgacgtggacacgcagcaggacggttgcgggccgaccgagacgcccgacgacatcgacatcgacgcgctgcggcagaaatacgcccacgagcgcgaaaaacggctgcgcaaagagggttccaagcagtacatcgaattggaggacgacttcagcggctactacgaggtcgacccgtacacgccggtgacgccgcgcgagcccatccgcgaggacatcgacgtcgccgtcctcggcggcgggttcgcgggcctgctgtcggcggcccacctgaagaaggcgggcgtcgacgacgtgcgcatcatcgaactcggcggcgacttcggcggcgtctggtactggaaccggtacccgggaatccagtgcgacaacgaatcctactgttacataccgcttctggaagagctcgacttcatgccgtcgaagaagttcgccgacggcgccgagatctaccagcactgccgcaacatcggcaagcacttcggcctgtacgactcggcgatcttctccacccaggtgcacgacctgcgctgggacgagcagatcaagcgctggcgggtcagcaccaaccgcggcgacgacatccgcgcccggttcgtggtgctggcgtcgggcccgttccaccggccgaagctgcccggcatccccggcatcaaaaccttcggcgggcacagcttccactcgtcgcggtgggactacgactacaccgggggcgactcgggcggcaatctgcacaaactggccgacaagcgcgtcggcgtcgtcggcaccggcgccacgggtatccagatcgtgccgttcctggcgcgctacgcccagcacctctacgtgtttcagcgcaccccctccaccgtcgacgcgcgcaacaacacccccaccgacccggaatgggtcaagacgctgcgacccggctggcaacgggagcggcaacgcaacttccacgcctggacgttcgagggcatggcgccgggacagccggacctggtgtgcgacttctggaccgagctggggcgcaacaccgcggcccgggtgctcgccctggacgaccccgcgtccctgacgcccgagcagttcatggcgatccgggaggaggaggactacaagatcatggagcggctgcgccgccgcatcgacacgctgatcgacgacccggcgaccgccgaagcgctcaagccctactaccgattcctgtgtaagcggccctgctccaacgacgactacctgcccagcttcaaccgcccgaacgtgaccttggtcgacgtgtcggcgagcaagggcgtcgagcgggccaccgaaaagggtttggtggcaaacggtgtcgagtacgagctggactgcatcatctacgccagcggcttcgagatcaccaccgagatcagccggcgctactcgatcgagacgatcgcgggacgcgacgggctgtcgctgttcgactactggcgcgacggctacaagacgctgcacgggatgaccagccgcgggtttccgaaccagttctacaccggcttcacccaggtcggtatctcggccaacatcgccgccaactacgaactccagggcgagcacatcgcctacatcatcgccgaggcgctgaaacgcggggcggccacggtggagcccagtgacgaggcgcagcaacagtggtgcaccacgatccgcgaaaccgcggtcgacaactcggctttcgacgctcagtgcacgcccggctattacaacaacgaaggcggcggcgggggcgagggcatccggtctcacctgggtgaaccgtacggtcccggcttctacgccttcgaggacctgctgcgggcctggcgcgacaagggtgatctcgaagggctggtgctcggcagttgagcgaaaccctcgcgcccccactgcgattcgacgaccgcgtggccgtggtgaccggagccggccgcgggctgggccgcgcctacgctcacctgctcgccgcgcgcggcgccaaggtggtggtcaacgacgtcggcggagccctggacggcgcgggggtcgacaccggtcccgccgcgcaggtggtcgacgagatcaccgcggccggcggagacgcggtggcgtgcaccgaatcggtcgcgacgccggaaggcggacgggcgatcatcgagacggcgctggcacgctacggccgcctcgacgtgttggtgcacaacgccggcaacgtccgtcgcgcctcgctcaaacagatgagctacgaggacttcgacgccgtgctcgacgtgcatctgcgcggcgcgttccacgtgctgcgtcccgcgttcccggtgatgtgccgggcgggctacggccgcatcgtgctgacctcgtcgatcggcgggttgtacggcaaccagggggtggccaactacgcggccgccaaggccggcgtgatcggcctgtccaacgtcgccgcgctggagggcgccgccgagggggtgcggtgcaatgtgatcgtgccggccgcgctgacccggatggccgacggtatcgacacctccgcctacccgccgatgggcgcggagctcgtcgcgcccgtggtgggctggctggcgcacgaatcctgttcggtcagtggcgaactgttcatcgcgctggcgggccgggtggcccgggcggtcatcgcggaaagccccggcgtgtgccggcccgggtggacggtcgaggacgtcggcgagcacctggacgcgatccgctacgtcgaggcgccgctgatctttccggtggtccccgacgggcacgccgagcacatccgctacagcttcgagctggcgcagcgcgccaacgagcagggggcgctgcatggctaacggtcgggcgcgccgagcgtgggccctgtgcacgccatcgcaaggcttttcgtgcataacccccacgctcggcgagagcgcacggcagcgggcgcggcatggctagccccagcggcccgatggccggggtgcgggtgatcgacctgaccgcgatggtgatggggccgtactgcacgcagatcatggccgatatgggcgccgacgtgatcaaagtcgaaccgccgcagggggataacacccgctacatctcggtggggccggcgcccggcatgagcggggtgttcgtcaacgtcaaccggggcaagcgcagcgtggtgctggacctgcagaccgacgccggggcacgcgcgctgcgtggcctcgtcgagaccgccgacgtgttcatccactcgatgcgcgccaaggcgatcgccaagctcggcttcggctacgacgacgtcgccgcgatcaaccccgccgtcgtctacaccaactgctacgggtacggccggcgcggacccgaccgcgaccgccccgcctacgacgacaccatccaggccgactacgtgggcaccatcatggccgacaagatcgccggcctcacagcgctttacgcgacgacgatggcgttgttccaccgcgagcgcaccgggcagggccaggaggtggaggtcgccatgttcgagaccatggcctcgttcatgctcgtcgagcacgccaacggcgccctgttcgacccgccgctggggcccgcggtgtatccgcgcacggtggcgccgaaccgccgcccgtaccgcaccagcgacggctacatcgccgcgctgatctacaacgacaagcactggaacgccttcatgaacgccgtgcggccgccgtgggccagcgagctgtatgcgacgctggaacagcgcgccgcgcagatcgacaccgtctacgggctggtggccgagaccatgaaagagcggtccaccgccgagtggctgaagctattcggcgagctggaaatacctgccgcgccgctgaattcgcccggcgcgctgttcgacgacccgcacctcaacgccgtcgggatgttccagaccgtcgacaccccgcacggcccggtgcgcttccccggcgtgccgacctggttctcgcagaccccgggccgggtggccgggccggcgcccgagctgggcgcccacaccgacgaagtgctcgccgaaatcggcgcgagcagacgcaaaagctcccgaaacgccgtgccggaggcggattttgcgtctgctcgcgagggaaaggaactgtaaatgggtgtgccggtttatcagcggatcctcgatctcttccaggccgagggggtgaataccctgttcggcatcccggaccccaacttcgtgcgcatgttcttagaggccgaatcccggggctggtcggtggtctcgccgcaccacgagctgagcgcgggattcatggccgaggcggcgtcgcggatgaccggcaagcccggcctgtgcatcgggacgctcggcccgggcatggccaacatcgccggtgccatccagtgcgcgctggtggagaactcgccggtgatctttctcggcggccagcgggcccgcgtcaccgaacgccgggtgcgccgcggacgcatccaattcgtgcgccaggagccacttttcgcgccgtcggtcaaatacagcgcgtccatcgaatacgccgaccagaccgacgagatcatccacgaggcgctgcgccgggccatgtccggcacgcccggcccggcctacatcgaatacccctcccacgtgatcctctccgagctcgacgtgcccgacccgctgccgccgcaccggtaccggctggtcaaccagaccgccggggagcgcgaggtggccgaggcggtgcggctgatccgcgccgccgagagcccgatcctgctggtcgggcacggggtgcacacctcgcgcaccggcgccgcggtccgggagctggccgagctgatggcctgcccggtaatccagacctccggcggcacctctttcatcgacggtctgcaggaccgcaccttcgcctacgggttctcccccgccgccgtggaggcggtggtgacctccgacctgtgcctggcgttgggcaccgagctcggcgaaccgagccactacggccgcacccggcactgggcgcagaacgacgccacgcgcaaatggattctggtggaacaggatccggccgccatcggcgtcaaccgtcccatcgacgtgccgctggtcggtgacctgcgcggggtggtgccgcagctggtggcggcgctgcgggacaccccgcgcaagccctcgccggatctggaccgctggatcgagcaggacgcggcggagctggcgcagctcgccgagaacgcgccgacgggccgcaccccgatccacccggcccggttcgtcgtcgaggccacccgggcctttcccgacgacggcatcatggtgcgcgacggcggcgccaccgtcatcttcggctggacctactcgcaggccaagccgcgcgacgtgatctggaaccagaacttcggccacctgggcaccggcctgccgtatgcggtcggggcgtccatcgccgagggcggcaagcggccggtgatgctgttgaccagcgactcggccttcctcttccacatcgccgagctggaaaccgctgcgcggcaaggacttccactggtctgcgtggtgggcgtcgaccaccagtggggcctcgaggtgggcgtctacaagcgcaccttctctcagccgtcgccgcagcccggcgtgcactggagcaaggacgtgcggctggacaaggtcgccgagggcttcggctgccacggcgagtacgtggagaaggaggacgagatcggcccggcgatccagcggtcctacgccagcggcaagcccgccgtcgtgcacgtctgcatcgatccgaaggccaattccgaggagatgcccaagtacgacgaattccgcacctggtatgccgagggcacccagtaagagaaggatgatctgatgcgcgaatacctgaagttctacatcgacggacaatgggtcgacccggtgcggcccaacacgttcgacgtggaaaacccggcgaccgaacaggtgtgcggcaagatctcgctggggtcggcggccgacgtcgacgtcgcggtcggcgccgcgcgccgagccttcggccgctggtcgcagagcagccgcgaagaccggctggacctgttgcaggccatcctcgccgaataccagaagcgcgccgacgatctcgccgcggcggtcaccgaggagatcggcgcgccgccctcgctggcggccggcccgcaggtctttctcggcatcggccacctgaccacggccatcgaggtgttgaagaacttcccgttcaccgagcaacgcggggcgacgctgatcgccagggaacccatcggcgtctgcggcctgatcaccccgtggaactggccgatcaaccaggtcgcggtgaaggtctacccggcgctggccaccggctgcaccgtggtgctgaaaccgtccgaggtggcgccgttctcgtcgtacatcttcgccgagatcctggccgccgcgggggtgccggccggggtgttcaacctggtcaacggcgacgggccgggcgtgggcgcggccctggcgagccatcccgacatcgacctggtgtcgttcaccgggtccacccgcgccggggtcgaggtggcccgcaacgccgccccgacggtcaagcgcgtcacccaggaactcggcggaaaaagccccaacatcgtcctggacgacggcggcttcgccgacgcggtccgggccggggtggccaacatgatgcccaattcggggcagagctgtaacgccccgtcgcgcatgctggtgcccgcgtcccggatggccgaggccatctccatcgcccgcgaggtcgccgaacaggtgcaggtgggcgaccccgacgacgcgacggcgatcgggccggtggcgtcgcgcgcgcagttcgagaaggtgcagcggctgatccagcagggcatcgacgagggcgcaacggtggtggccggcggcccgggccggccggcggggctcgaccagggctactacgtcaagccgaccgtcttcgccgacgtcaccaacgacatgacgatcgcccgcgaggagatcttcggtccggtgctgtgcattctcggctacgacgacctcgaccacgccgtccggctcgccaacgacaccgattacggcctggccggctacgtttcgggcgccgacctggacacggcgcgcgaggtggccggcaagatccgggccggatgggtgaccatcaaccacgccttcgacctgaacgcgccgttcggcggctacaaacgtagcggcaacggccgcgaatggagcgacttcggcttccacgagtacctggaagtcaaaagcatcctcggctacgcgccggcccagggagaccagtagctcctgtcacgcccaaatcaggccccgcacagcgcaaatccggtgcgtgtccttccacgcgatcgcgcatacccacccttaagctggctgcgatcaacaggaggggcagcgacgtatcggcatcaaccatggcgccgggcgagatggtagtcacggcgcgctgacagcagacaccgagccgggcgggtctcaccccgcgccggctcgtggtactcggccccggtgggtcgccccggtgcgccgggtggggcggctggcgatctgggaccgaccggaacggcgcagcggaatcccggcgctggacgggctgcgcgccatcgcggtggcactggtgctcatcggccacggcggcatccccggcgtcagcggcggattcatcggcgtcgacgtctttttcgtgctcagcgggttcctgatcacctcgctgctgctcgacgagctgggccgcaccgggcgcatcgagctgaccggattctggatccggcgcgcccgacggctgcttccggcgctggtgctgatggtgctcaccgtggccgccgcccgccagctgctgcccgaacgctcgctcaccgggctgcgcgacgacgcgatcgcggcgttcctgtggatggcgaactggcggttcgtcgcccagaaaacggactacttcacccagggcgcgccgccgtcgccgctgcagcacacctggtcgctcggggtggaggagcagtactacttcgtctggccgctgctgctcatcgcggtcgcgctggcgctggccgcgcgcgcccggcgccgctgcacccgggcgaccgtcggcggggtgcggttcagcgcgttcgtcatcgccaccgtgggcgcgctggcgtccgcgtcggtggccatcgcgatggccaccgacggcacccgcgaccgcatctacttcggcaccgacacccgggcgcaggcattgctggtcggcgcggccgcggcggcgctgctggtgtccgactggccatcgatgaaccgcggctggtgcctgttgcgcacccggtgggcgcgccgcgtcgcccggatcctgccggtgctgggattggccgggctggcggcggcgacccactgcgccagcggcgccagcggcgaattccggcacggcttgctgatcggcgtcgcgatcgcggccgtggcggtgatcgcccccgtcgcggtggagcagcgcggcgtggtggcgcgggtgctggcgctgccgccgctggtctggttgggcaccatctcctacggcgtctacctgtggcactggccaatcttcttggcgctcaacggggaacgcaccgggtgggccggtatgctgctgttcgccgcgcggtgcgcggcgacggtggcggtggccgccgcgtcgtggtggctactcgagcagcccatccggcgctggcgcccggcgcgggtgccgctgttgccgctggccgcggcgacggtggccagcgccgccgcggtcacgctgctggtggtgccggtgggcaccgggccgggcctgcgtgaggcggggctgccgcccggcgtctcggcggtcgcggcggtgtcgccgtcgccgcccggaaatagccggccgcgagatcccaatcgcccgttcaccgtttcggtgttcggcgattcgatcgggtggacgtggatgcattacctgccgccgacgccggggttcgccttcctcgaccacaccgtcatcggatgcagcctggtgcgcggcacgccgtaccggtacatcggcgaaacgctggagcagcggccggaatgcgacggctggccgatccgctggtcgaggcaggtcagccaggaccagcccgacgtcgcgctgctgatcatcggccgctgggaaacggtggaccgggtcaacgagggccaatggacccacatcggcgaccccaccttcgacgcctacctcaacggtgagctggagcgggcgctgaacatcgtcggctccaccggcgtccgggtggtggtggccaccgtgccgtacagccgcggcggcgaaaagccggacggccgtttgtatcccgaggaccagccggatcgggtcaacctgtggaacaccatgctgcgcaagaccgttgcgcaccatcccaacgtggcgatcctcgacctgaacaagaagctgtgcccggacggggtttacaccgccaaggtggacggcatcaaggtgcgcagcgacggtgtgcacctcaccccggaaggggtgaagtggttgacaccgtggctggaggagtcgctgaggtgaggccctaaccgcttgtgcggcagctgatttccatgctgtcgctgtcgcggacctggaagttgaagctgacgtagccgttgtcggggttgcgcacccggtcgaggtagggctgggtgtcggccgcgctggtgttgtcggcgaccaccaaaacccctggggacagccgcggttcgagcagctcgagcaccggcagatacaggtccttccagccgtcgagcagcacgaagtccaccgggcccggcagatccgccagcgtggtcagcgcgtcaccctgaaggatcgtgatcacgtcgtccagtccggtctcggcgaacgtcttcttggccgcggcgatcttggtctcgctcagctcggtggtcaccacccggccgctgccgttgtcgcggaccgcggcggccaggtgcacggcggagatgccgaacgacatcccgaactcgacaacggtggccgggcgggtggcgcgcaccagcgaatacagcagccggcccgcttccggcgtcaccgggatgtagaactcgctcatcgcgtcggcccgctgctgcgccgtcatcggctgatcgaatgtgccgcgccgctcgcgcaacaacgacatctggttcttcgactcggaatacatgcggtcgagcgccgatgcgacccggggatcctgcaacgttgtggtcatggtgcacgagcctaggcgcggagtctgagtgcgggctgggcgccgccggtggccgtcagggatccgttaagcggtttgacgagctcgcggccgcggtgtcactatggtttccgcaagcacctcggtaggtgaggcgtctgcatggatacaggccactgaccccgaacgtcgagagacgccccgggtcaggacagctcttcccggacccaagggttgagcccaagtggcttccggagccccggatacgccgtgcagtgccgaagctccgacgagaggggtgcgaccggcggcgttctccgggccggtcatcgaatcctctttcgttcaggtggatgtggtggcacccgcgtgtgtcttggccgtgaggaggtgagggcgagatgagtcccggcgatagtccctatccgaaatccgtttcgtcccgatccggctccggcatcatgtccaccgcctgaccttcactgctggtcgcgcggctgacgcgtcgctgtcggtcgggcctccggcaggagaagatcatggcttttgttgtcacgcaccgttttccgactgtttcccgtcggcgtggatggtcgatgctgcgcgcgggccggttgctggccaacaagtttcaccagcggaccgccatgacgccgcaggagcgggccaacctgtatgtctcgcggatgccgatcgcggtgatcaccgcgtcgctgggcgggcacccgtcgggttccgccgaccagcaccggtgaccggttgccgatgcccgcggcggcgggggcgctagcgccggtccgtcgccgcgggcgcgcggcatgccgtacccgcgtccgcctcaccccgagtgaggacacgtccgagagagcgaggcttccgatgacttcgatgcacacccgcggccggcgcaccccgggcgctgccgtgcagagttcggcggtgtccgacgccgcccacgtcggcgacatcgtcggcgcattcggccgcatccggcgcgacggcggcggcgccgacggggccgcgggcgggcgctggcgccggctgcggacgttggcggtcatcaccggtcccggactgatcgtgatggtcggcgacaacgacgccggcggggtcgcgacctacgcgcaggccggccagaactacggcatgggcctgctgtggacgctggtcttgctgatcccggtgctctacgtgaaccaggaaatggtgctgcggctgggcgcggtcgcccgggtggggcacgcgcggttgatcttcgagcggttcggcaggttctggggcgccttcagcgtcggtgatctgctgatcctcaacgcgctgacgatcgtcaccgaattcatcggtgtggcactggctctcggcttcctgggttgcccgaagatcgtcgccgtcccggccgccgcggcgctgctgttcgccgtcgtggccggcggctcgttccgccgctgggagcggttgatgttcctgctgatcgcggtgaacgtgctgatcttcccgatggtcatgttggtgcatccggccccgaaagcgactgtggccgggttgatcccgcagttcccgggcgggctcaactcgaccgtgctgctgctggtggtcgcgatcgtgggcaccaccgtcgcgccgtggcagctgttcttccagcagtccaacgtggtcgacaagcgcatcaccgcgcgctggatcccttacgggcgagccgatttggtgatcgggatcgtggtggtcatggtcggggcgacggcgctgatggcggtgacggcgttcggattggccgggaccgccgctgccggccacttcaccgacgccggggcggtggccgccgggctgtcggcgcacctgggccgcacggtcggggtgttgttcgcgatcatcctgctggacgcctcgctgatcggcgccaacgccgtcggcctggcgacctcctacgcggtcggtgacgccatgggcaagcggcactcgttgcactggaagatcaccgaggcgccgctgttctacggcggctacgcggtgctgctcgcggtgtcggccgcggtctccttcagcccggaccacatcctgggcctggtgacccagggcgtgcaggcgctggccggcgtgctgctgccctcggcgaccgtcttcctggtgttgctgtgcaacgaccgggcggtgctggggccgtgggtgaacacggtgcggcagaacatcgccgcgtggaccatcgtgtggtgcctggtgctgttgtcgctggcgctgacggcgaccacgttcttccccgacctgtccaccggcaccatcgaagccgggctggcggccggtgccgtgctcggcgtcgtcgccggtgcggtgatgatcgtcgtgggccggcgccagcgcgacctcgccgaggccgaggccatcgtgcgtacgctgggcggcggcctggatcccgagcaggtcgacgagctcgacgacgcgtcgtcgctgacccgcgccgagcggcgggccgtgcgccggcaggaccgggagaactggcaaacccccagcctggccctgctcgaccggccggcgatgtcgccgatgcgccgggcggggctgttcaccctgcggggctacctggtggtggccgtggtgttcgtcatcatcaagctcgtgcaggccggcgtggtcggcccggctggctcactgtgaatcactgtgaatcagtgggcagcagaacgattttcccgtgggtgtgccgctgctcgagctcggcgaacgcgtcggcgacccgatccagcggataggtcgcggcgatgtcgaactccagggcgccggagacgatcagatcggccatctcggccagcacttccggggtcgacgcctcggcgctgccttcggtcttggcgcccacttccgcggccttctcgaaggagatgatcgtgtcgatccgctccggtggcacaccgaggtccacggcgagctgcacgtactgcgggccgaaaaggtcgatgaacgcgtcgattccgtccggcgccgcctcgcgcagccgatcggccagaccgtccccgtaggcgatcgggacgacaccgtgcgcgcgcagccagtccgcgttgcccgggccggcgatgccgagcacccgcgccctgcgcagcaccagcagctgcgtgaccaggctgcccaccccgcccgcggccgccgacaccgcgaccgtctcacccggttgcggcgccaccgcacgcaccgcggcgtaggccgtcacacccaccacatacagcgaacccgccacctcccaactcagttcgggcggcttgcggatcaactgccccaccgggacggcggtgtgggtggcatggctggaccggcgcagactgaaccccaaaacctcgtcgccgaccgcgaattcggtcacccccggccccaccgcggtgaccacgccggccaggtcgctgccctcaccggaggggaaggtggccgggaacctctcgtgcaacgccccgacccggatggcggcctccccgggattgatcccggcggcgcgcacctcgacgaccacctcgcccggcccgggcgcgggcatctcgatgtcggcgacatacaacacctcgcgtccgccgtaccggtcgaaccgtacggcgcgtgccgctgcagccgtcatgccgttcccctccccgtcgaatgcccgcctccgccagcataggcgcgcggcggcactacccaccggccgagaattgggcatatgttcataacagctgcccgatgcccaccggcgtttcgccggcggcgttggggcggtggtgaacctcgttgggggaaggaagctgcgtgcaggccgctcggatcggcatcgccggctgcgctgccgtcgtcatcgcggccgccggttgcggaggcggcggcaagggctcgtcgccgggctccggttcgcccacgccgccgagcagttcgggcgccgtcaccggcccgccgccgggacaacccagcgactacggctacctgctgatcaagccgagcgacgtcggcggaggtctgagcgctccccagtcaccgatgctcaaccccaacaatgccccaggggccgcgcagcttttcgccaacgccgacagcagccggcggctgtgggacaccatcgtgatcgccgccgacgccccggccgccaccgccgaactggccgccaccaagagcagctacgccggcaaggtgaacggcgactggcgcccggttgccgtcggcgccaacgggacaacgatttcgggcggctcctcggacaacacccaggcgatgacggtgctgttgttcaccgagggcagggccctggtcaccctggaattcgacagcgcgcccaacgacccgatcgacccggccgtcgcggtcgacatcgcacgcaagcaggacgccgcgatcaggaccgggctgcccggctagccgcgaaagaccgccggggtcaatgtgtttcggtgacggcaacggatgctgcgagccggcggagccgaaaccggctgcggccgtggctatctgacgatggccggttgccggtcaggccacgacctggatggggtcgccgacgttgacctcgttgaagtaccacgcggcgttgtcggggctcaggttgatgtatccatggctgacgttcgcgtagccctgcgagtcgaccgaccacggcgccgaatgcacgtacaccccgctccaggtgacccgaaccgcgtactgggcggtgatcttgtagccctccggcgagctgagcgggatgccgatggtgcgcgagtccatcaccaccgaacgctgcttttccagcgcggtgaaattaccgatcggggtgggccggctgggtttgcccatcgacgccggcatggtgcgcagcacctcgccgttgcggctcacggtgaaggtgtgtttggagatgctggcaacgcccagcagcgcgtcgccggtgtcgaaaccggtggtcagcgcctgcacgccgaccgaaacgtggccgtgcgcgggccaataccggttcgggacgaaccggacgaccgtgttgtcgtcggcccactcgaaatgcccgcggacaccggccggcgacaccacgtgaatcgaccgctcgacggcggcccggtcggccgccggtgcggtgaacgtcacgacgatcgggtgggccacacccaccacggccccgttggcgggcaaaatcgaggcgatgccggggacgggctgcggcaacggcaccgaagcgccgccgcggccgaccggcgctaccagggccatgaccgtgatcgcgaccataacaaatagataacgacccgctcgacgcatagcgtccacccttcgagatggtgcgatcaacacaccgatattctacttgttgtccgccgaccaccggtttcagcaaacaatgacagtccggttgggtcggcgcggtcgcgttccgatcaccggttgggtgcaatcgcggcgaggagtgggcatggctggtgaggatcactacacgcgtccctgcgcggactcggcggcgctggtgctgatcgacgtgcaacgcgatttctatgccgacgacgccccgatgcgagtcgagggaacgagtgcggccctcggcgcgatggccgagctggcccgccccttccggcgccgcgagctgccgatcgtgcacgtggtgcgcctgtaccgggccgacgggtcgaacgccgacccggtgcggcgccgctttatcgaggacggcgcccgcgtcgcggtgccgggcagccccggttcacagatcgcgcccgagctgttgccgaaagccgttgagctggaccaccaattgctgctctccggtggcttccagcagatcgggccggccgagcacgtgatgtacaagccgcgctggggagccttctacggcaccaagctcgtgcagcatctgcgcgaaagcggcacggacacactggttttcgcgggctgcaattttcccaactgtccccgcacgtcgatctacgaggcgtccgaacgcgactttcgcatcgtgctggtggccgacgccatctcgggtttgtacgaccgcggcgcccaggaatgccgggccatcggggtggcggtgcgcgacaccgcgcagacgctggattggctcggcgggtagccgcgggttagcctcggcgagatcgcaaggccgagcccgaccacgacaggagtgcgggtgctgttccgtcagctggagtacttcgtggcggtggcctccgagcggcacttcgcccgggccgccgagaagtgcttcgtgtcccagccggcgctgtccgccgcgatcgccaagctggaaaaggagctgaacgtcacgctgatcaatcgtggccacagtttcgagggcctcacccccgagggtgagcgattggtggtgtgggccaggcggattctcgccgagcacgacgcgttcaaggccgaggtcgacgccgtgcggtcgggggtcaccgggacgcttcggctgggcaccgtgccgaccgcgtccaccaccgcgtccctgctgctgtccgcgttctgctccgcgcacccgttggtgaaggtgcagatcctatcccggctgtcggccggcgagctgtaccggcggttgcgcgagttcgaactcgacgccgccatcgcccacaccgcgcccgacgacatccccgacgtgaacctggtgccgctctaccgggagcgttatgtgttgctggcaccggcggacctgctggcatccggcgccgccaccatgacctgggtgcaggccgcccagttgccgctggccctgctcaccccggacatgcgggaccgccagatcatcgaccgggcgttcgccgaccacggcatcacgttgcacccgcaggtcgaaaccgactccgtggcttcgctgttcgcgcaggcgtcggcgggtagttgggcgtccatcgtgccgcacacctggctgtgggcatcgccgctgggcgccggcatccgggcggtggagttggtcgatccggtgctcaccgcggacgtggtgctggccaccaagtcgcacggtcccggctcgccgatcgcgcgggcgctggccgcgtccgccggccggctgcagctgaacgacttcttcgacgcgcagctgctgggcgtcacgcgccggcgctgaccgcggccggcgacgccgcgctggccgggttccggttggccaggtggccgctttccaccccggcggtcggatcgagctcgcagtcgatcagcgacggcccgccggagccgatcgcctccgtcagcgccgcccgcagttcggccgccgtgctgacgtgatatcccttgccgccgaaagcctccgcgatcagctcgtggcgggcccgggcgctgagcacggtgggcgccgggtcatccccgtgcggggcctcgtcgccgcggtagacaccgccgttgttgaggatgacgacggtcaccggcaggcggtagcggcagatggtctcgatctccatcccgctgaagccgaacgcgctgtcgccctcgatcgcgaccaccggccgaccggtctcgaccgcggcgccgatggcgaagcccatgccgatgcccatcacgccccaggttccggtgtcgagccggtgccgaggcagttccatgtcgacgacgttgcgggccaggtcgagcgcgttggctccctcgttgaccacgtagacgtcgcggttgtcttgcagcacagcgcgaatcgcgcccagcgcgttgtagaaccgcatcgggtgcgggtcctcggcgaggcgctcgcgcatcttggcgtcgttgtgggcccggcgctcggccagttcctcggtccaccgcgccggtacggtgatcggccgggcggccagcgcgtcgcacagcgcggacatcaccgagccgatgtcgccggccagcggcgcggcgatctgctggttgctgtcgaactccgacggctcgatgtcgacctggacgaacttgacgccggccgaccattgcggcgattccccatgtcccagaagccaattcaaccgggcgccgaccaacagcaccgcgtcggcgcgcccgatggccagcgaccgcgcggccgcgacggactgcgggtgcgcgtccggtagcagccccttggccatcgacatcggcaggaacggaatcccggttgactcgacgaatcgccgaatctcgttgtcggcctgggcgtatgccgcgcccttgcccagcacgatcaacggccgccgggcgtcggccagaacgtccagcgcgcgatcgaccgcctcgggcgcgggcagctggcggggggcggggtcgacgaccccgccacagcgtgccggcggcggccgaagcgtccatggcctggcccaggacgtcgccggggatgtccaggtagacaccgccggggcggccggagaccgccgtccgcacggcgcgcgcgacgccgcggccgatgtcgtcgacccggttgatccggtacgccgccttcgcgaaaggccttgcggcgtccagctggtcgaggtcctggtaatcgccgcggcgcagatcgaccagcgcccgatcgctcgagccggagatctggatcatcgggaagcagttcgtcgtggcgttcgccagcgcgggcagggcgttgaggaagccgggtcccgacgtggtcaggcacaccccgggacgacgggtgaggaagcccgcggccgccgccgcgttgccggccgaggcctcctgccgaaagccgaggtagcggatgcccgacgcctgcgcgacgcgggccaggtcggtgatcggaatgccgacgatgccgtagatggtcgcgacatcgttggcccgcagcgcctgcaccaccagatggaagccgtcgatcagccgtgcggattccggcgccgggccggcggatgccgaggttgcggacatgtggcgactcctgccgtgcgggtgtgggtactgcccagccatcacaatgaccccgccgaccgtcaggtgtccaagtcgaacgcgctatccggccattcacgacgtttatcgcggcaggtcagcgccgggaccgccggcgtcgatagttggagcttatcgatcgtgagcggatcggtattggacgcagcgcaacggcgcccggcatggtggcagcgacggcacaacgggaaaggatgtggcgatgacgtccgaggcgacaccgagcgcgacggccgccggaccgcggttggccgacctggtcgaggcggccgcgcagcgggcgccgcgggcgccggcgctgctggtcgcctccgagcgcaacccgatcgcgtacgcggatctggtccggctcgtcgatgacctggccgcccggctgcgggccgccggtttggggccgggcgaccgggtcgggctgcgcgccggcagcaaccccgaattcgtggtcgcgctgctggccgcgtcgcgggcggatctcgttgtggcgccgctggatccggccctgcccgccgccgaccagctgtcccgcagccgggcggtgggcgctcgggcggtgctcgtcgaccggctcggcgagggccagacggcacccgagagcgccccctgctggccggtcaccgtcacagtcggacccgacgacggcgccccgacggtcgacctgaccgtcaccgcggcgcccacacacgacgtgaccgcgccgcagggcctgcgcgacgacgacgccatgatcatgttcaccgggggaaccaccggggcaccgaaaatggtgccctggacccggcacaacatcgccgcctcgatccggtccatcgtcgccggatacgggctggggccgcgggatgcgacggtggcggtgatgccgctctaccacgggcacggtctgctggccgcgctgctggccaccctggcatccgggggagcggtgttgttgcccgcgcgcggaaagttctcggcgcacaccttctgggacgacatcgccgccgtcggcgccacctggtacacggccgtcccgaccatccatcagatcctgctggagcgtgcccgcaccgaagcgccgcgcggcacccacgcgctgcggttcatccgcagctgcagcgcgccgctgaccgccgagaccgcgcaggcgctgcaggacaccttcggtgcgcccgtggtgtgcgccttcgggatgaccgaggccacccaccaggtgtccaccaccgccatcgatggcgccgggcacagcgaaaaccccggcgccacaccgggtctcgtcggccggtcgaccggcccggacatccggatcgccgggccggacgggcaatcgctgcccgcggacaccgtcggcgaggtctggctgcgcggcgccaccgtggtgcgcggctacctcggcgatccggcgatcaccgccgccaacttcaccgacgggtggctgcacaccggcgaccttggcaccctgtcggccgccggcgacctggtcatccgcggccggatcaaggaactgatcaaccgaggcggggagaagatctcgccggaacgggtcgagggtgtgctggccggccaccccgacgtgctggaggcggccgtgttcggccggccggaccagctgtacggcgaaaccgtggcagcggtgatcgtcacccgcggctcggcggcgccgacggccgacgaactggcgtcgttctgccgggaacggctggcgcccttcgaggtgccggccgagttccggcgggccgccgagctgccgcacaccgcgaagggctcgctggaccgccgcgcggtggccgaacaattcggcgaaagcgcttgaccggcagtgtgattcgggtcagaccgcggcggtcgccactcgggcggccgcggattccggcatcggctcgtagcgggcgaacgaccgggtgaacgaggccgcgccgtgcgccagcgaccgcaggtcgatggcgtagcgggtcagctccacctgcggcacctcggccttgaccacggtgcgctcgtgaccggcggtgtcggtgccgagcacgcggccgcgccggccggacagatcgcccatcaccgcaccgacgaaatcgtcgggcaccagcaccgagatctcgtcgatgggctcgagcaacaccaccttggtggccgcggccgcctcccgcagcgccagcgcgcccgccatctggaacgcgaagtccgacgagtcgacgctgtgcgccttgccgtcgagcagggtgacgcgaatgtcgaccaccgggtagcccgcgtgcacacccttttccatctgggcgcgcacccccttctccacgctcggaatgaactgccgcggcaccgccccgccgaccaccttgtcgacgaactcgaacccggagccttccggcagcggctccacctcgatgtcgcacaccgcgtactggccgtggccgccggactgtttgacgtgccggccgtgccctttggccttgcccgcgaacgtctctcgcagcgggagccgcagctccacggtgtccaccgtgacgccgtaccggttggccagcgcgtccagcacgacaccggcgtgcgattcgcccatgcaccacagcacgatctggtgggtctcctggttttgctcgatccgcagcgtcggatcctcggcggccagccggcccagccccaccgacagcttgtcctcgtcggtcttggcgtgtgcggcgatcgcgaccggcagcagcggctcgggcatggtccagggcttgagcaccagcggctcggacttgtccgacagcgtgtcgccggtttcggcccggctcagcttgccgatcgcgcagatgtcaccggccaccacggccgaggccgggcgttgctgcttgcccagcgggaaggacagcaccccgatgcgctcgtcctcgtcgtgatcggggtgggcatggccgttcccgttgccggtgccgaagaacgacgcaaaatggcccgacacgtgaaccgtcgcgtcgggcctgatggtcccggagaacacccggaccaggctgaccctgcccacgtaggggtccgacgtcgtcttcaccacctcggcgagcaacgggccgtcggggtcgcaggccagcccggcgcgcggcgcgccgacctgggtgaagacctccggcagcgggtgttccatcggcgacgggaagccgcgggtggcgacctccagcagctccagggtgccgacgccggtgctgctgcagaccgggatcaccgggaagaacgacccgcgggcgacggcccgctccaggtcggcgatgagcaccgtttcgtcgatggactccccacccaggtaccgctccatcagcgactcgtcctcggactcctcgatgatcccctcgatcagggtgccgcgggcggcctcgatctgcgcggcgtcggcgggatccggcggccgcacagcgcgtttgccgtcggcgtaggcgtagcgctgctgcgacaacaggccgatcaggccggtgcaggccggcagaccggtgggcaggtacagcggtaaaaccttgtcgccgaacgcgttctgcgcggcggccagcgcctcggcgtagttggcgcgggcgtggtcgagcttggtgatcaccaccgcgcggggcatgcccacctggttgcattcctgccacaacagtttggtgggctcgtcgacaccctcgttggccgcgatcacgaacagcgcgcagtcggcggcccgcagcccggcgcgcagctcgccgacgaagtcggcgtatccgggtgtgtcgaccaggttgaccttgacgccgtcgtgcgacagggacgccacggcgacccccaccgaccgttgctggcggatctcggcctcgtcgtagtcgcagaccgtgctgccgtcggcgaccgagccggggcggttcaacaccccggcggcgaccagcagcgcttcgaccagagtggttttgccgccgcccgacggtcccaccagcacgacgttgcgaatctcgcccggactcttggcggtaggagcgtttcccgcgccttgggaagtagttgtcttgtccgccatgactttcctccaggtcgcccggggcgcaccgttgccggcccggctagcacctttctagctacccttcaccgaacttccgtcgaccacaagaccgtcgggccggatcagcgttttcgggccgatccgcccgcacggcgccggcgcctcagggcgcccagccggaccaccgccgcaccgcgatcgcgatcaccggaccgtccaacggaaccgattgatactgagggtatttcgcgcgcaacagccggtagccggtgtccagggccggcccgtcgcggtggatggtggccagaccgtcggcgcgcacccaccacagccgggtccaatcgtcggcgtagtggtcggccagcaggctcacctgcgggttggcgtcgatgttggccagccggcgcagccgccgcgtggtcttgggtttggcgtcgacggccgtgtacaccacgtccgggtcggcgtcatggtccgcgtcggggccttgcgcgagggcgaagacgaccggcaccaggtgtggctgcccgcccggggagacggtggccaaccgggctaccgaggcccggccgaacctcgccctggcgtcgaattcgcccaccagatcagggtagggcgcgcggcagcaaacggcggtaagcctatgagccggctgagaacctggcacatgccgtgcatagctacctgcattacggttatatacacaaaattgtgccgccaggatcctcaggccgggacagtttggtgtttaccgcgacgcaggagggtgacgggatgagcaaatcgcaccaccaccgctcggtctggtggtcatggttggtcggtgtgctgaccgtggtcgggctgggcctcgggctggggtccggcgtggggctggcgccggcgtccgcggcaccgtcgggcctggcgctggaccggttcgccgatcgccccctggcgccgatcgacccgtcggccatggtcggtcaggtggggccgcaagtggtcaacatcgacaccaagttcggctacaacaacgcggtgggcgccggtaccggcatcgtgatcgacccgaacggcgtggtgctcaccaacaaccacgtcatctcgggcgccaccgaaatcagcgcgttcgacgtcggcaacgggcagacctacgccgtcgacgtggtcggctatgaccgcacccaggacatcgccgtgctgcagctgcgcggcgcggccggcctgcccaccgccaccatcggcggcgaggccacggtgggcgagcccatcgtcgcgcttggcaacgtcggcggccagggcggcacccccaacgcggtggccggcaaggtcgtcgcgctcaaccagagcgtctcggcgaccgacacgctgaccggcgcgcaggagaacctcggcggcctgatccaggccgacgcgccgatcaagccgggcgactccggtggcccgatggtgaacagcgccgggcaggtgatcggcgtggacaccgccgccaccgacagctacaagatgtccggcgggcagggcttcgccatcccgatcggccgcgccatggccgtcgccaaccagatccgctccggcgccggctccaacaccgtgcacatcgggcccaccgcattcctcgggctgggcgtgacggacaacaacggcaacggcgcgcgggtgcagcgggtggtcaacaccggcccggccgcggccgcgggcatcgcgcccggcgacgtcatcaccggcgtcgacaccgtcccgatcaacggggcgacgtcgatgaccgaggtgctcgtcccgcaccaccccggtgacaccatcgcggtgcacttccggtccgtcgacggcggcgagcgcaccgcgaacatcaccctggcggaggggccgccggcctgacatccgcgccggtgagagcgggtcggtggccaattcgcttggcaccgggcgtgattcgtcgcggccgggcgaggggggttccgaaactcgcactcagggtacccgtggcatcgtggattcgatgaacgacgcaagagaagctgtcgaacaccatcccgaggaaggcagtcacgtccaggacggtgtcgtcgagcaccccgaggccgaggacttcgacaacgccgccgcgctgcccaccgacccgacgtggttcaagcacgccgtgttctacgaggtgctggtccgcgcgttcttcgacgccaacgccgacggcgccggcgacctgcgcggtctgctggcgcagctggactacctgcagtggctgggcatcgactgcatctggctgcccccgttctacgactcgccgctgcgcgacggcggttacgacatccgggatttctacaaggtgctgccggagttcggcacggtcgaggatttcgtggcgctgctcaacgccgcgcacgagcggggcatccgggtgatcaccgacctggtgatgaatcacacgtcggagtcgcacccctggttccaggagtcccggcacgaccccgacggaccgtacggcgacttctacgtgtggagcgacaccagcgaccgctacgccgatgcccgcatcatcttcgtcgacaccgaggagtccaactggacgttcgacccggtgcgccgccagttttactggcaccggttcttctcccaccagcccgacctgaactacgacaacccggccgtgcaggaagccatgatcgacgtgatccggttctggctcgggctgggaatcgacgggttccggctggacgcggtgccctacctgttcgagcgggagggcaccaactgcgagaacctgccggagacgcacgccttcctcaagcgggtccgcaaggtcgtcgacgacgagttcccgggccgggtgttgctggccgaggccaaccagtggccggccgacgtggtcgagtatttcggcgaccccagcaccggcggcgacgaatgccacatggcgttccacttcccgctgatgccgcgcatcttcatggccgtgcgccgcgagtcgcgattcccgatctcggagatcctggcccagacgccgcagatccccgagatggcgcagtgggggatcttcctgcgcaaccacgacgagttgacgctggagatggtcaccgacgaagagcgcgactacatgtacgccgagtacgccaaggatccgcggatgaaggccaacgtcggcatccgccgccggctggcgccgctgctggacaacgaccgcaaccagatcgagctgttcaccgccctgctgctgtccctgcccggctcgccggtgctctactacggcgacgagatcggcatgggcgacgtgatctggctgggggatcgcgacggggtgcgcacgccgatgcagtggacgccggaccgcaacgccggcttctccaaggccaaccccggccggctgtatctgccacccagccaggacccggtgtacggctaccaggcggtcaacgtggaggcgcaacgcgacacctcgacgtcgctgctcaacttcacccgcaccatgctcgccgtgcggcgccggcacgaggccttcgcgatcggcacgttcgaggagctcggcggatccaacccgtcggtgctggcgttcgtgcggcaggtgtccaacgacggggacaccgtgctgtgcgtcaacaacctgtcgcggttcccgcagccgatcgagctgaatctgcagcactggagcgggtgcatcccggtcgagctgaccgggcacgtggaattcccccgcatcgggcacctgccctacctgctgacgctgccggggcacggtttctattggttccagctgaccgcatgcgaggaggacacatgactcgcgccgcgacggtacacagcgttaggtatgagaaggagcggcgcagatgaccgaacccgccaagctgccgtggtccgattggcttccgcagcaacgttggtacgccggccgcaaccgccggctgaccggcgccgaaccgagcgtgatcgtcgggttgcgcgacgatctggacctggtgctggtcgacgccgactacgccgacggctcacgggaccgctaccaggtcctggtgcgctgggatgccgcaccggtctccgagtacagcacggtggccaccatcggcgccgccgacgaccggaccggcttcgacgcgttgtacgacgacgaggcgccgcagtttttgctctccctgatcgactcgtcggcggtgcgcagcgcgtccggggccgaggtgagattcgccaaggagcccgacgcccagctgccgctcgaggcgatggcgcacgtgtcggacgccgagcagtccaacaccagcgtgatcttcgaccgcgacgccatcttcaaggtgttccgccgggtcagcagcggcatcaaccccgacatcgagctgaaccgggtgctcggccgcgccggcaacccgcacgtcgcccggctgctgggcacctacgagatggcgggtgcggacggcacccccgagacggcctggccgctgggcatggtgaccgagttcgccgccaacgccgcggagggctgggcgatggccaccgccagcgttcgcgacctgttcgccgagggcgatctgtacgcgcacgaggtcggcggcgacttcgccggtgagtcctaccgcctgggcgaggcggtggcgtccgtgcacgccaccctggccgagacgctgggcacctcgcaagccgcgttcccggtggacaacgtgctggcgcggctgtcctcgaccgcggccctggtgcccgagctgaccgagtacgcggccaccatcgaggagcggttcgccaagctggccaccgagaccatcaccgtgcagcgggtgcacggcgacctgcacctgggccaggtgctgcgcaccccggagagctggctgctcatcgacttcgagggcgaaccgggccagccgctcgaggaacgccgcgcgcccgactcaccgctgcgcgacgtggccggcgtgctgcggtcgttcgagtacgccgcctacgggccgctggtggagcagggcgcgcaaaacacggacaagcagctggcggcccgggcccgggaatgggtggagcgcaaccgcaccgcgttctgtgacggctatgcggccgcctccggcatcgacccgcgcgattctgcgccgctgctggccgcctacgaattggacaaggcggtctacgaggccgggtacgaggcgcggcaccggcccggctggctgccgatcccgctgcgctccatcgcccggttgaccacggcctgacccgcgcgccctgcgcgcgccggctccgtctggaagcatgtgcgtgtgccgagtgagatcaacaacagcgaaaccaggttgtcgtgggtgctggcggtgctggccggggtgctgggagccaccgccttcacgcactccgccggctacttcgtgaccttcatgaccggcaacgcccagcgcgcgatgctcggctacttccgcggcgacgtggtgttgtcggtgacggcgggggtgctgatcgtgtgcttcgtcgccggcgtggtgatcgcctcggtgtgccggcggcatttctgggtggaccacccgcacgggcccacggtgctgacgacgttcagcctggtggcggccaccctggtggacgtcatcgacgagggctgggaggagaacctgctcgacttcgcgccgatcatgttggtgacgttcggcatcggcgcgttgaacacgtcgttcgtcaaggacggcgaggtgtcggttccgctgagctacgtgaccggaaccctggtcaagatggggcagggcatcgaacgccacatcgccggtgggacggcggcggactggctgggctattttctgctgttcgccagcttcgtggtgggggccaccgtcggcggcttcatcagtctgttcgtcaacggcacgtcgatgttggtggcggccaccgtgatgtgcgcgttgaccaccggctacacctatttccattccgatcgccgggcgctgctcgacgaggcgtgagacaaagcagcggcagtagcgctgaccggtgcgctactgccgctgctggccggggtcaggtggcgggctgggccggttgcgccggctgggccggttgggccggttgggccggcgccgcggtgatgttgccggaaagcagcacctgctgcatgtccggcttcatcgccatcaattgctggttccagtacggccacgagtgggtgccgttggccgggaagttgaacaccccgttgcgtccgccggcggccgcgtagttgttctggaactgctcgttggtgcgcagcgtcaacccctccaggaacttggccggcacgttgtcaccgcccaaatcgctgggggtgccgttaccgcagtacacccagatgcgggtgttgttggccaccagccgcggaatctggaccatcgggtcgttgcgcttccacgccgggtcggtggacggcccccacatgctgttggcgttgtagccgcccgagtcgttcatggccaggccgatcagcgtgggccaccagccctcggacgggttgaggaagccggaaagcgaagcggcgtaagggaattgctgcggatagtaggcggccaggatcagcgcggagccacccgacatggacagccccaccgcggcgttgccggccggggagacctgcttgttggactgcatccacagcggcatctcctgggtcaggaaggtctcccacttgtaggtgtagttttgcccgttgcccgacgacggctgataccagttgctgtagaagctggactgaccgccgaccggcatgatcaccgaaagaccggactggtagaactcctcgaacgccggggtgttgatgtcccaaccgttgtagtcgtcctgcgcgcgcaggccgtccagcaggtagaccgcgtgcggcccgccgccctggaactggaccttgatgttgcggcccatcgacggcgacggcacctcgaggtattccaccggaagccccggcttggagaaggctcccgcgacgggggagccacccgcggcgacggcgacgccggacagcagggaggcccccacggccgcgatcgccagccggcggggcatggtagccgccgcgccacgcaactttcgcaccttttcgatgaacgacatagctctctacccatcccaactttcatctgccgcaccatgcggtggaatctgttctccgggagtgaaacacagcgggcgggtcgaatcggctcgtcgcggccgcagcgacagatcgcggttggctaacgattgtgcctcggccgggaatcgtcacggtcgggtcacgatcgactctcggaaccgtgcggcgatcttgcgccgcgacggcgcatgcgctagcgggaccagcaggcctaggcgaccaggcggcgcagaagtgttgaggccgtgaggattccggtcaccgccgccgccgccagcaccgcgatgtcgaccgggttgaagggtgtgccgatcagcagcgcccgcagcgcgttgacctcgtagctgagcgggttgatcttgctcagcccgcagcgcgttgacctcgtagctgagcgggttgatcttgctcagcacgtgcaaccaggtcggcatcagctcgaccgggtacagcgcgttggaggcgaagaacaacggcatcgtgatcgcttgcccgatgcccattagccgatcgcggttgcgcaccaaaccggccagcgtcatcgacaggcaggcgaagaacgcggcacccagcatgacgatgcccatcgccgccaggatccgtaatggattgacggtcaagccgattcgcatcaggtaggccaacgccagcaccccgacgacctgggccagcgagcgcacgccggccgcgaaggccttgccggtgaccagcgccgacgccggggccggggtcaccatgaatttggccagcacgccggcgtcgcgatcccaaatgatctgtatcccatagaaaatggagatgaacagcgccgactgggcgatgatgcccggtgccaggaaggccagatacgacacggatccggtgttgatcatgtgcaggtggctgaacgtggtgccgaagaccagcagccacagggccggttgcaccatccgggtgaccagttcggtccggtcgtgctgcaacttctgcatctcgacgatcgcgaacgccccgatccgactggacagcgcgcccacccgctgccatccgcgcggcgcccggaccagcgtggcggccgcggcgttgtcaaccgacacggcgagccaccttcctgctggagcggacttgccggatggaccccgatggccgcgggtgcgccgcgtcgtcgccgcccaggtcggaggccgcgtagtggcggaacacgtcctcgagcgtcgcgtgcggcgacacccgcgatatccgggccttcagctcgtcgggtgcgccgaccgcgcgcagcgcgccgcggtgcatcagcgccactcgatcgcacagcgcgtcggcttcctccatgtagtgggtggtcagcagcacggtcatggcgaaccgggcctgcatcttctgcacgtgctcccagacgccgtcgcgcgcgatcgggtccagcccgacggtcggttcgtccagcaccagcagcgacggccggttgaccagcgcctgggcgacctcgaggcgacggatcatgccgccggagtaggccgacgccagccggtcggctacgtcgagcaggtccatcgcggccagcgcctgatcgacccgctgggcgcgctcggcgcccggcacaccgtacaaccgggcgaaccacgcgacgttctgccggccggtgagcgcgggctcgaccgaaagctgttgcggcacatagccgatattggcgcggatatcggtggttcggcggcgcgcgtccagtccgaagatgtgcagctcgccctgctggaccggggccagcgtggtcagcatccggaccatggtcgtctttccggcgccgttgggccccagcaggcccatcgtttcgccgggccgcacctgcaatgtcacgtcgtcgacggcggtgaactggccgtagcggtaggtcaggtgcttggcgtcgatcgccaccggcagcggcccggtcatggtcgccgctcccgcagtttttgggtcatcatgtcgaggacctccaatcctcttgtcagagcctcgatttggtcgtcgtcgagttcgtcgaccacctcggacagcaatgcccgccgggcggcccgggactcgtcgacgatctgctgcgcggactcggtgagccgcagctggcacacccggcggtcggtgtccgcggcggcgcgcagcaggaatccgcccgacaccagcttggtgaccagggtcgaggcggtgttgggcaccaggccgagctcggcggccgcggcgctgaccgagatcccgggccgccgcccgaccagccacagcaattccgactgggactccgagagccgcgccggatcgaacgcgcgaccggccgacctgcgcagttggcggcgaaaccggccgaccacgccgaacagctcggaggttacgtccgtgcgtgctttcaccccgcccataatacctctgtaaccgagctatttatagggccgaacggagccgccaccaggggcacggtcacttggtgaggcggtgcagcaccacgtcgctcacggcgccgtcggcggcgcacgcggtcaggtaggtgcagaacggctggcggcggcgatccgtcggcgagcccggattgagcagccgcagcccggttcgggtggtggtgtcccaggggatgtggctgtgcccgaacaccagcacctggctgtccggataccgccgcgacatccgcgcctcccggcccgcggcggcgccggtctcgtgcacgacggtgaaccgcacgcccgccagggtgacgtcggcccgctcgggcagccgagcccgaagcgccgggccgtcgttgttgccccagcaggccaccagccgggcggcccggccgtcgagctcgtcgaagaactccggtgccgtccagtcgccggcgtggatcacgacgtcggccccggccacctcgtcccacacctgcgcgggcagatcgcgggcccgcccggggatgtgggtgtcggcgatcagcagcagcctcacccggccattgtgcgtgccgggcgcggtcacccgaaccagcgccgcggcatataccatacggggtagggtataaatggatatggcaatcgacagcggccgcacccgcaaagccgacgccgcccggcacgaccccggcgacatcgacgtcgtcctgacccggctgcgccgggcgcacggtcagctgggtggcgtcatcgcgatgatcgagcagggccgcagctgcaaggacgtggtcacccagctggccgcggtgtcgaaggcgctggaccgggcgggcttcaagatcatcgcctcgggcttgcgcgattgcatcacgcggaccgagcagcaaccgcccctgtcgatcgatgagctggaaaaactgttcctgagcctggcctgactgcggggccggaacgacgagcggtcgcaaacaggaggaatcacaggtgacatcgaaattgagcaccacgctgcacacctcgttcccggacgcggtggaccggatcacaaaagcactggcggatcagggttttggcgtactgaccaccatcgacgtgaaagccacgctgaaacaaaagctcggcgcggacatggaggactacctgatcctgggcgcctgcaacccggcgctggcgcaccgcgcgctgggcatcgatcgccagatcggtcagttgctgccgtgcaacgtggtggtgcggtccgatcccgccgagggggatgcggtgctggtcgaggcgatggacccgcaactcatggtcaaggtgaccggcgaggcgggggccttgcaggaggtcgccgaccaggccaccgccaagctgcaagcggcgatcagcgcgctcgccggctgatcagccgcgttcgctgcgggcttcggcgccggtttcaccggcgtcgaacgagtcgtccgagcccgccgcaccgacataggagccgtcgtctttgcccttgcccgcgcgggagcgagcctggtgcttttcgggttcgacgtcttcctcggcccggtggcccttgtggtctggcatgcgccttcctttcctgcggtcagcgttgcgggtgggattcccgcgacggctcgtccgaaacggcgccgcgcacccaggcacctaggccgccagaaagtccagcagtgccgcgttgaactcttgcgcgtggctgatgtggcaaccgtgcggcccgtcggcgatcacgcacagccggctgcccggtatcgcccggtgggtgcgccgcgccgacccggcgagcggcacggattcgtcgccctcgccgtggatgatcagcgccggcaccgacacccgggtcaggtcgggacggaagtcggtgttggcccaggcggccatgcaggccagcgacgcctccttgccggcctgcttgcatagcctgagcgcctcggcgcgggtcgcccggctcacccgcaattgtccgttggcggagaagaactcggtcatctgatggtcgtagaaggcgtcctggtccttgacgaacgacgccgtcgcccgcgccgcgtccttcatggtcagcggcccgtccggattgtcggtggtctgcaacaggtacggcgtcaccgaggaggcgaacaccacgctgcgcacccgctcggggccgtaggtcgacaggtagcgggcgacctcgccgccgcccatcgaggagcccaccagggtgaggtcgcgcaggtcgagggattcgaccagggtgtgcaggtcctgcgtgagctgggagtagctgtacccggtgagcggcttgtcgctgcgcccgaaaccgcgccggtcgtaggtgaccacccgatagccggcggcgtgcagcaccgggacctgtgccgaccacgactggccggacagcggccacgggtgcatgagcagcaccggtctgccgggcccgccggtgtcgtcgacatgcagccgggtgtccttgagaagtccatggtgggcgatcacatcgggcatgaaacgaccttccgcggcggtggagttcgctggctcaccggctactacccgtgaccgtccggggctaaccgtggccgggcgctattgttggcagccgaaaccaaggagacacccaatgcgcaccttcgaatcagtagccgacctcgccgccgcggccggggagacgctgggacacagtgactgggtcaccatcacccaggaagacgtcaacctgttcgccgacgcgaccggcgatcaccagtggatccacgtcgacccggagcgggcggcgtcgggcccgttcggcaccaccatcgcccacgggttcatgacgctggcgctgctgccgcgactgcagcaccagatctacaccgtcaacggcatcaagctggcaatcaactacgggctcaacaaggttcgtttccccgccccggtgccggtcggctcccgggtgcgcgcgcagagttcgctggtcggcgtcgacgacctgggcaacggcgcggtgcaggcgacggtgtcgaccaccgtcgagatcgacgggtcggccaagccggcgtgcgtggccgaaagcatcgtccgctacatctcctgaccatcgccggccgtcgactcatttgggtccgaaaccgcttgtcggcgagactaagtcgacgccgggcgagaaccctaaaattccgcgacggcgtgttccaggcgttcggccaaccgcgcctgggcctcggcccgccgggtcggaatgtgcgccgacgggaaaggcgttgacacgggctcgtattcgcgcagcgtgcggcgggccaccgtcatcttgtgcagctcggtggcgccgtcggcgatgcccagcgactcggcggccaccagcatcttgacgaacggcatctcgtcggagacgccgagcgcgccgtgcaggtgcagggcccgttgggcgacgtcgtgcagcacctgcggcatggccactttcaccgccgcgatgtcgcggcgcaccttctggtagtcgtggtgcttgtcgatcaaccacgcggtgcgcaacaccagcaagcggaactgctcgatctggatccagctgtcggcgatcttctcctgggtcatctggaaatcggccagccgcccgtgccgggtcttgcgggacaccgcccgttcgcacatcatgtcaaaggcgctgcgcgccaaggcgatcgtgcgcatcgcgtggtgaatccggccaccgcccagccgggtctgggcgatcatgaacgcctgcccctcgccgcccagcacgtggtcggcgggcacccggacgtcggtgtagcggacgtagccgtggctggcccggctggaggactcggcccccaccccgacgttgcgcacgatctcgatgcccggtgtctcggccggaacaatgaacagcgacatcttgtcgtaggtgcgggcctccgggttggtgaccgccatgacgatgaagaacgacgcgtgtttggcgttggtggagaaccacttctcgccgttgatcacccagtagtcgccgtcgcgggtggccgcggtgacgaattgcccgggatccgaaccaccctgcggctcggtcatcgaatagcaggaggtgatctcgccgtccagcagcggctgcaggtagcgggccttctgttcgtcggtgccgaacagcgccagtatctcggcgttgccggaatccggtgcttgacaaccgaataccgacggggcccagcgtgagcgtccgaggatttcgttgagcagcgccagcttgacctgaccgaagccctggccgcccaattccggtcgcaggtgggcggcccacaggccctggtccttcacctgctgctgtaacggccgcaggatggccatcatctcggcgttcttcttgtcgtagggatccagggccaccaggtcgagcggctccagctcttcggccatgaatttctcgacccaatccagcttcgcctggtattcggggtcagtctcgaagtcccacaccgtggccaaccattccccggcgccgcgccgcgccggactcgtcgatgaagccaccccatcctagagcgacggcgccaccggcggtgagcaggactaggcgccctgaccgcgggtgtcgatgatctgctgagcgatctcgaccagtttcacctggctctcctgggacagccgtcgcagcagatcgaaggcccgcacgtcgtccacgccgaaacgttccatgatgatgcccttggcctgaccgatgcggtcgcgggtggacaccgccgaatacagctgctcggcacggcttccggccaggatcgcggcggcggcgtgggcggcgaacaccgagccgatggtctcggcctcggtgtcccacgcgtcgggccggtgcgagaacaggttcagcgcccccgcggtgcggtccgcggtgtagagcttgaaggacaggctgctgagcacacccagctgcacggccgcgggcgcgtagcgcggccagcgcggctcgcgccgcagatcgtcgctgcgcacgatcgtctcctgcagcgcggcctgcgcgcagggtccctcaccgaagtcgtgttgcaggacgtcgagccgtgcggccaggctgtcggtgtcggccagggtctcgaactcgccgccctttcgcaccagcagcactccggcgatgtcggctcccggtatcacctcgaccgccgccgcggtcacctcggccagcacctgatcgagccgtcgcggcgcggccatcccgcggaccagctcggccatccgcacggccagctggtgccgggaatccgggtccactgcatccataacgtcccgattctgcccgatccgccgcgagtttgtggccggcagcggcgaaaccggcgttgccctaagcgggttcagcgcaatttcggtaagacattgtcccggtagaagtcgatggcgaccatcgggtcgtcctgcggaaagtgcaggaagggaacggcgcccgcgtccaggacccgctgcgcggcctcgacgtgccgacccgcgtcggtgccgaccgtccagccacccaacaccttgtcggtgggattggactcggcggcccgctggatgtccaccggatccggctggtcgaccgcgccggccgtgaagcgccacagcgtggccgcgcgggcggccacggcgtcatcgccgacgacggcgaacatctcggcccgtttccccagggtcgctacgtcacgcccggccgcttgggctccagcaccgaaggccgccaacagttttggattggtgacgtcgccggactgggtgatccagccgtcgccgaactgcccggccagcttcgcgctcttcgggccgccagccgccacgaagatcggcggcggggtggccggcacgtcgtacagctttagtgaattcgtctgaaagtagcggccggagaacgagattcgcgacccgctccacagctggcggatcagcgcgatcgcctcggccagccgttcgtggcgttcggtgtagttgccgtagccgttggtggtggcctgctcgttgagccgctcgccggtgcccactcccagaaacaccctgccggggttgaggattgccagcgaggcgaacgcctgggccaccgtggcggggtgatagcggtaggtcggacaggtcaccccggtgccgaacgagacgtggctggtgctgctgcccaccaacgccagcgtcagccacggaaacatcgaatggccctcgttgtcctgccacggctggatgtgatcgctggcccacacgtgggtgaagccggcccgttcggccgcctgcgcctgtgccaccaaccggtcggtgcggaactgctcgtgggagagcacaaacccgacgcccttgcccgcgggcgccggcggtgcgccggatcggccgtgcccggcgcccggcttcgcgcatgcctggaccgcggacgcgagcacgccggcaccgaccgccagccgccccaacgttcgccgcgaaatgccggtcacccccgtcggcatacccgccaccgccggcctcacacacaccgggtacgcactagcctcgggtggatgaccccgcaggtccgcccggccgaccgggccgacatccgcgcactgtcggccacgctggcccgcgcgttctacgacgacccggtgatggtctggctgttccccgatcggcgcaagcgcatcgcgcggctgtctcgggtgttcgcgacgatgacccgccaccaccacctggccggcggcggcgtcgaggtggcctgtgcgggcgccgggatcggcgccgcggcgttgtgggatccgccccaccgatggcgggagaccccgcgcgcgcagctggcgatgacgccgacctacctgcgggtgttcgggctgcgttcgatgcgcggccgcgcggtgcaggagctgatgaaaagcgtgcaccccgaggagccgcattggtacctcgccgtgatcggcagcgatcccggcgtccgcggacagggtttcggtcaggccctgatgaggtcgcggctggaccgctgcgacgccgagcactgccctgcctacctggagtcgaccaaacccgaaaacgtcccgtactaccagcgtttcggcttcaccgtcacccgtgagatcgtcctgccggacggcggtccgagcatgtgggcgatgtggcggccgccccggtgatccgtggcgcgacgcgcgccggccgcgtcgtttaaccaccccgggcggcgggcaaccgtgtcggcatgagcgataaccctcgaggcgacgaactggtggatcccgccgaccttcccgaggagggcggcccgggtgacaccctgaacgcgagcgaaggtaccgactcggacgaggtgcgcaacgacgacggcgacatcgtcgtcgatcccccggagggctggagcgaggcggatcgattcggcgtgacggccggggaggaacgcgagggcgagtccctcgacgaccggctggccgccgaggagcccgacgtgcccgacgccatcgagccggtggacgacctgccgcggcgcgcgcaccggggccaggttgacggcacccccgaggacggcgactcactgtacgacgtcgtcgacgagtaagtcagtgctcgcgtgtttactgcagccgacgtgatctagggcgtgctgtgccagccggcgatgccggtggcgatcatccgcaactgcttgacggccagccggcggatgtcctcgcgcgcctcggcgctctgcgaatcctcgatggcctcggcgatgacgatcatggcgttgacgaacagggtcgccagcacgttgaggtcctcggtggtccactcgtgcaggccgggaaaccgggccaggtcggtggccagctcggaggtgatcagccggatctcggtgcggatggcgtagcgcagcaccgacagcccgctgttgcgctcgcgggcgatcagccgccaatgctcgcgccggtccgcgacgctggccaccaggatctccaccgatgactcgatcacccggttcgggtcgagcttgccggcccgggcgtcgcgcagggtgtcgcgcaggctgcggaacgactcgtcgatcagcaccagacccagggattccatcgactcgaagtgccggtagaacgccgccggcacgatcccgacctctcgggtcacctcgcgcaggctcaggctggagaaactgcggtcctgcagcagcttgagggcggcggcgatgatggcgcgacgggtcgcctccttgcgctcttcccgtgactggctttcgcgggagcgctcgcgtccggagccgcgcacccgtgagctaggagtacggctgttcactatgtgaaccctaccacatacgggcagtaaacccttgactgctcggccggggcggagcaacggtgtacgtatgttcactcaaactgttcaggcttccggccgggtcctcgcgcggaccgtgcggcagcgggtgctgggttcggagctgctcgacctgctgaccggtccgcacggcgtcgatcgttacaccgagctggtggcaccgacgtggacgctgggcgaggcccgcgccaaagtgaccgacgtgcgccgcaccacgccgcgcagcgtcacgctcaccctggagcccaacgacaccttcctgtccagccataccgtcacagccggccagtacgtcaacctcaccgtggagatcgacgggcggcggcacacccggtgctattcgccggccaaccgcgaagggacggccaccctcgagttgaccatcggccggcacgacggcgggctggtctcgaaccatctgtacgaccacgcccgacgcggcatggtggtcggcctggccggcgtcggcggcgatttcgtgttgccgaccccgcgcccgcggcgcgtcctgttcgtctccgggggcagcggtatcaccccggtgatggcgatggtgcgcaccctggtttcccagcggcatcgcggcgagatcgccttcattcactacgcgccgacccccgccgaggcctgctaccgcgaggaattggccgcgctgccgtcggtgcgggtgctgcacgggtacacccgatccgcgggcggcgacctttccggacgcttcgggcccgaccacctggccgccgcgatgcccgcaccagatgcggtgttcgtctgcggcccaacatctttggtcgatgccgtccgagagcactgcgacaacgtctacaccgaaagcttcactccgccggtgctcgaggcgccggccgacccgtccggcggacgagtcacgttctccgacagcggcgtcgacgtcgtcgacgacgggcggtccttgctggagcaggccgaggccgccggactgtccccgcaaaacgggtgccggatgggcatctgtcacacctgcacgcggcgcaaaaccgccggcaccgtgcgcaacctggtcaccggtgcggtctcgaccgctcccgatgaggacgtgcagatctgcgtgtccgttccggtcggtgacgtggacctgtccctctgaggaggaaaaaccgtgacacacaacaagataaccctgacccccgaacaggccgaggaattcggccgtgagctcgacgccctcaaggaacgggtgatggccgacctcggcgaaaaggatgccgactacattcgccgcgtcatcaaggcgcagcgcgcgctggaagtcggtggccgcgccctgctcttcctgcccccggcatggctgctgggcaccaccatgctgggcctgtcgaagatattggacaacatggagatcggccacaacgtcatgcacggccagtacgactggatgcgcgacccggcgatcagcggccggtcctttgaatgggacaccgcgtgcccggccgaccagtggcggcactcgcacaactacatgcaccacacccacaccaacatcgtcggcatggaccgcgacatcgggtacgggatcctgcggatgagcgaagaccagccgtggcagccgtatttcctcggcaacccgctctacgcgttcctgctgatggtgctgttccagtacggggtggcgctgcacgagctggaaaccgaacgcatccgctccggagagatccggctggcggacaagcgcgaggtgctgcgcgaaatctggcagaagacccgccgccagacgctcaaggactatgtcgcgttcccgctgctggccgggcccttcgcgccgttcgtgttcaccggcaacctcgccgccaacctgatccgcaacgtgtggtcgtacatgatcatcttctgcggccacttcccggacggcacacaggaattcaccgtcgaagagacgcaggacgagtcgcgcggcatgtggtacttccgccagatcctcggctcggcaaacctgaccggcggcaagctgtttcatctactctccggcaacctgtcgcaccagatcgagcaccacctgttccccgacatgccggcccggcgctacgccgagatcgcgccggaggtacaggcgatctgccaacgctacggcgtcgcgtacaaccgcgggccgctgctgcgccagttcggcaccgtcgtgcgcaagatcgtcaagctgtcgttcccggacgcgtgggtccccggcgccgccaagcccgccgaccgcgagccggtggccgcctgagcgactcccgagcgtgggggccatgtacggattgcggacgcctcgcctacacagcccccacgctcggcgcaacgggatggctcagcgcaccgccgtcggggcgtcggcggccttgacgagttccacctcgggccgggcgggcaccccatcggccaggaaccaccggaaggccaggttgccacgcggatagcccagcgtggtaacggaattcgggtgcggcgtgcggtcgcgggacaacacgatcgtcaccgtgccgtcgctgttggcgacggcgctgtggccgttgatcgagcaccgggcgtcggggccctccgcggcgccgtaggtggccatgaactggttccacaccaccatgttccagaaccggcaggacgggggccggtgcgtgatgaccagggcctcgtcgtcgtcgagcacgaaactgccgtaggagtagcaggcatcgcgtgccgaccagccgaagttggcgtcgggcacctgataggggtcggcgaatgcgtttgcggcgtgggcggtttcgtgcccgagcgcgtgctggtcatcaacccggttgccgaccgccagcgggacgatggcgaacatggtgcgcagccaggtcgcgaccgcgcgcagccgggcggcggtctcggcgtcgccgtgccggatcggcgcgggctcatcgagcgcctcgattcgccacgtcaccgggcgcccggtcagcgggtcggcctggtagtcgcgggtcatcagcaccgccgcatcgggtgtcgggggaaattcgaaggagaagttgccgtcggcgtcgacgtccaggtcgctgtcgcggacgatcgcgacgacccggtccgaccacgccccgagtgacggttcgttgtaggcggtcaccgaaaagtacacgctgtcacccttgttgccgctgatccggtaccggcgcttcggatccaccgggcagatgaagtagtaggcgtcggtgttgtcgccgccccagcgccggtcgcggcgaaacggcgtgttcaccgcgacgaactgcggccggtcgggctcggggaacaggtaggtgtcgaacgccacgcccagggtggtggcgagcatgcggtagccgtcggcgatgtgccggtcgtcgctgaccgcgcggtcgccctccaggaaggagcggtcgagctcgcccagggcggccagcaattcccgccatgcggcggtcgattcgtgcgtcatgcgctgattcctttcaggagcaacctggtggtgcgatcgacccacgcgtcgtcgagctcggtggggcgggtcagcagggccaccaaggtgacacccgcgatggtctcggccagttcggcagcggtgacgtcgggccgtgcctcgccgcgcgccgcggcggcggcgagccagtcggccaggccgccgccgatggcgccggcgaaccgctccagcagcgccgaatgcaggctcggatcggcggccatttcgccgatcagcccgggcagggcggccctggcggccggggtggtgaggaaaaccattgtgcggcgcaccatctcgcgcaggtcgtcggccgtcgacccggtgtcggggatggcggtgtcggcgccgaccgggaacaccgcctcgtgcaccaggtgcgccttgctgggccagcggcggtagatcgcgggcttgctggtgccggctcgctgcgcgatggcggagaccagcagcccgggatagcccgtctcggccagcagctccaccgtcgcgcgcagcaccgcggcatcgatccggggatcacggggacggccaaaatccactaccattacgaaactcagagtaacataagtcggcgtgaccgttcgcctcgaagacctggccgagccgcagttcagcgccgagggccaacagatcctggacatgatggccgcgatggccccgcagtgcccgctggatgccgacgcgctgcacgcccaggccagcgccgacaccggcctgcacgacttcgggcccgacgactaccgggagcgcctcgccgtctacctgaccgcgctgcgcgaaatcgacgggctgcacgccgccgggacggtcaacttctacggtcagctgctgcagatcctcaagaaccggctgctgctgaccgacctgctcaagcgccatcccgagatccacgacatcgaactgcactccccggtggtgatcgccgggctgccccgcaccggcaccacccacctgcacaacctgctggccgcgccaccaaccttccgcaccatgccctactgggaaagcgtggagccgtttccgatgcccaatgaggttggcgtgcaaccggatccgcggcgaacccggatggacgtcgcggtcggggtgatcaacacggtgatgccgcatttcgcgctaatgcacgagatgaccaccgatcacgtccacgaggagatccagttgctggccaacgacgtgtccaccatgctgctggagacgctcgccgaggtgccgcgctggcgcgcctactaccaggcccacgatcagacgccgcactacgaatatctggccacccagctgcgggcgatgcagttcctgcgcggcggccggcgctggctgctcaagtcgccccagcatctcgagcaggtgccggtgctggatcgggtgttcccggacagcatcgtcgtgttcacccaccgcgacccggtgccggtggcgctgtcgatgatcgcgatgatcacctactcggcccgcatgcaccgctcgccggtgccggtgcgccagatcgccgagtcctggatcgaccgcctggggcagatgctggccgcgctggtccgtgaccgcgacgtcatcggcccggaccgttcgatcgacatccgcttcgacgacttcatggccgacgaactcggcgtggccgagcgggtatacgccctggcggacgagccgttcaccgacgacgcgcgcgcggccgtcgccgactacctggcgggtcaccgccgcggccggctgggcaacgtcgaaacgtccttcgagatgttcgggttggacgaggagagcctgcgcgagcgtttcgccccctacgtcgagcggttcctggcctaatcccgcgccggcggctactttctcaacacatggtcaccatgcccgagctcgacggcgtcgaacaccgctacgtggatctcggagacgacgtgacgatccatgtcgcggacgcgggtccggcgagcggcccggcggtgatgctggtgcacggcttcccgcagaactggtgggagtggcgcgcgttgatcgggccgctggccgccgacggctaccgggtgctgtgtccggacctgcgcggcgccgggtggagttcggcgccgcggtcgagttaccgcaaggacgagatggccgacgacctggccggggtgctcgatcgcctgggcgtccggtcggtcgacctggtggcccacgactggggcggaccggtcgcgttcatcatgatgctgcgccacccggaaaaggtgaccggcttcttcggggtgaacacctcggcgccgttcgtgaagcgctcgctgtcgacgatccgcaatgtgtggcggttctggtatcagatcccgatctcgttgccggtcatcggcccccgcgtgatcagcaccccggattcccggttcgtgcggctgctggggtcctgggtcggcggcggctacacgctgcccgaggaggatgtccgcctctacctcgagtgcatgcgccaaccggggcacgccgaggcgggctcgcggtggtatcggtcgtttcagaccagggagatgctgagctggatgcgcggggagtacgacggcgcccgcgtgcacgttccggtgcgctggctgtcgggcaccgaggacccggtgctcaccccggacctgttggacggatacgccgagcggatcgacgactttcagctggagctggtcgacggcgtcgggcattggatcgtcgaccagcggcccgatctggtgctggaccgggtgcgggccttcctgcgccgcgaaacttaaactaaggcgccggttttcggcgtgtcgtgtgcgtgacgtaagtgtcgtggcgtgccgggcggtacgcgccgcgcgccctagtcgacgccgatggtgacctcggtcgatttgatgaacacggtcgccggcttaccgacctcgaggccgaggtcggtcgcggcatccctggtgaccgacgacgtgacgacctggtcgccgccgtccagcgtcaccttcaccacggccatcacggtgccgagttcgacctcggtgatggtccccctgagctggtttcgggtcgagagccgcatcgcaagaacctccatgtcgcaacggtcgggatctgcggtgagcgtagccctaccggctcggcccggaatagcttgggagacttccacttacgcgagcggacgggcctagtgccgggggccgagcagagctacggacgcatccacggccggttccacgattcctcggaccggttttccgtcttcgaccgcaagtgcggtcagctcccgcagcccgccgagcaggatcacggccagcggcgcggtcagcggaggaagctgcgcgcggcggaatccgggactggcgctcaggtcgatcagcaggctggtcagcaactgcagcccgcggcgctgcaccgggcgcgcggccgcacccagcgagggcagctcgcggatccagctcaacgtgatggccggtcgcgcctcgatgtatcccacgtaggcctcgaccgcctggcggatctgcacgtgccaatccgcctcgggatcgaccgaggccgcgatcttggcccccaatttctcgatgtcgaccgccagcagctcgagaaagcactcttccttgccggcgaagtggtcgtagaaggtgcgcttggaggtccgtgcgcagcggacgacgtcggcgacggtgctggcgcggtagccgcgctcgccgatcgaggtggccagaccgtcgagcaatcggagccgaaatggatcgatctcgccgagatcgggctcgccatccgttgcggtcattgctgaggtcacggccggcgccccctctcggttcgaaacgcatcttgtcagctttggtactgcagagtaccgtatttcgaaaggtctgtggtacatcgcggtaccaaccccggcccggggcagatgttgggagcaatgcatgagcgaagtagccaccgccccgccggccgcggtccacctgcctcccgcggtccgagcccgaaactgttgcagggcatcgggtttgccgtgtcgcgccgaaccatgatgcgacggctttcccgccgttacggcaacgtcttcacgctgcgcctgccgatgtgggggcccgtcgtcatggtcagcgatccccagctcgccaagcagatcttcaccaccaccccggacgaactgggcaacatccagcccaatttgagcaggctgttcggctccggctcggtgttcgggctcgagggcgacgaccaccgccggcggcgacggctgctggcgccgccgtttcacggcaagagcatgaagaactacgagagcatcatcgaagaggagacgctgcgcgagacggccggctggccggagggcgagtcattcccgacgttgccgccgatgatgcggatcacgctcaacgcgatcctgcgcgcggtcttcggggccgagggcgccgagctcgacgagctgcgccggctcatcccgccctgggtcaccctgggttcacggcttgcggcgctgccgaagccgcagcgctacccgcgattcggcccatggggtcaactggacaggtggcgccgccactacgacggcgtcatcgagaggctgatcgccgcggagcaggccgacccgaacttcgccgagcggaccgacgtgctggcgctgctgctgcgcagcacctacgacgacggtgcggccatgtcgcacaaggagatcggcgacgagctgttgaccctgctggccgccgggcacgagaccacggcgtcgacgctggcgtgggcgttcgagcggatcagccggcaccccgagctgttggcgcggctggtcgaggaggccgacaacggcggcaacgagctgcgccaggcgacgatcctggaggtgcaacgggcaaggaccgtcatcgatttcgccggccgccacgtctatcccgacgtgtaccggctcggcgaatgggtgatcccgcgcggctattcgatcatcgtcggcatcgcgcagatccacgacaaccccgatgtgttccccgacccccggcggttcgacccgcaacgcttcatcgacaacaagccgtcggcgctgtcctggatcccgttcggtggcgggacgcgccggtgcgtcggggcggcgttcgcgaacatggagatggacgtggtgctacgaacggtgttgcgccacttcaccattgaaaccaccgacgcaccggacgagccctggcactgccgcggcgtggccttcacccccaaacacggcgggcggatcgtggtgcaccggcgctgagccgggcgcggttcagctaccggaggtggcccggcgcggcagtttccagcccgggcggatgtagtggcaggtgtacccgttggggtagcgctgcaggtaatcctggtgctcgggctcggcttcccagaagtcgccggccgggctgacctcggtcaccaccttgccgggccataaaccggaggcctccacatcggcgatggtgtccagcgcgatccgcttctgctcgtcgtcggtgtagaagatcgccgagcggtagctgggtccgcggtcgttgccctgccggtctttcgttgtcggatcgtggatctggaagaagaactccaggatctgccggtagtcggtgaccgccgggtcgtagatgatctcgacggcctcggcgtgggtgccgtggttgcggtaggtcgcgttggggacgtcaccgccggtgtagccgacccgggtggacaccacgccgggttgcttgcggatgagttcttgcatgccccagaagcacccgccggccagaatcgctttctgcgtgttcgtcatgtcatcgcctcgtttcgctctcgccgaatggccgcagtccccctccgattatcctgacgttcgccatcgaatacacccgcgaggcaaagctctcgacaaactgcggtagaacgtgttctagttttggcgtgagcagcccgcaattctcccgcagtgagctcgtcgatgccttcgcgaacttcgaagcgacggtcgatgccgcggcccaatcgcacgactgggatgcctgggtcgagcactacacccccgacgtggagtacgtcgagcacgcggccggcaccatgcacggccgcgacgaggtgcgccagtggatcaagcggaccatgacgacctatcccggcagccacatggtcgcgttcccgtcgctgtggtcggtggtcgacgaggagcgcggccggatcatctgcgaactcgacaacccgatgaaagaccccggcgacggcagcgtcatcaccgcgaccaacatctcgatcatcacctacgctggcgacggtctctggtcgcggcaggaggacgtctacaacccgttgcgcttcctgcgcgccgcgatgaagtggtgccgcaaggcgcaggcgctgggcaccctcgacgacgcggccgcgcagtggatgcgtcagaacgggggcgcgcagtgagcggcaaacccaaactggtcatcggcgccaacggttttctgggttcgcacgtgacccgccagctcgtcgccgacggggcgcaggtccgcgcgatggtgcgcgccggcgccaatacccgtggtatcgacgacctttcgctgacccgcttccacggcgacgtgttcgacaccgcggtgctgtcggaggcgatggacggcgtcgacgacgtctactactgcgtggtcgacacccgcgcctggttgcgcgacacctcgccgctgtttcgcaccaatgtcgaagggctgcgcaacgttctggatgtggccgtcacccaacctgagctgcgcaagttcatcttcaccagcacctacgcgacggtcgggcgacggcgcgggcacgtggcgaccgaggacgacgtcatcggcacccgcgggctgtccgactacgtcaaatcccgcgtgcaggccgaaaacctggtgatgcgctatgtggccgaggccgggctgcccgcggtcgcgatgtgcgtgtcgaccacctacggcagcggcgactggggccgcaccccgcacggcgccttcatcgccggggccgtgttcggcaagttgccgttcaccatggagggcatccagctggaagtcgtcggcgtcaccgacgccgcgaaggccatggtcctggccgccgaccgcggccgtgtcggcgagcggtacctgatctccgagcggatgatcgcgctcaaagaggtggtgcggatcgccgccgacgaagccggggtgccgccaccgcggcgctcgatctccgtcccgacgctgtatgcccttggcgcactgggcgatctgcgcgcccggctcaccggcaaggacgccgaactcagcctcgcctcggtgcgaatgatgcgcgccgaggcgcccgtcgaccacagcaaggccgtccgcgaactcggttggcagccacgcccggtcgaggagtccattcgcgaggcggcgcggttctgggcggcgatgcgaaatgccaagggcaagagcgtgactccccgctgaacaccacgccgatcaccgtttaggatgcgccgcggcccgtcgcgggcgactagcctcggccggtatcggggcccattgaacgcgtcgaactgcagctcaccggacgcttgtgcccgcggtggcgaacatggcgcaataccaccgctacgcattcggctgaccgggaagggttgggcgcggatgggcgttgcacacctcaccggcgtcttgaggaggaaccaccatggcccacccggaaatcaaagagcccagtgcgggacacccgatcaccatcgagccgacgcggggccgggtgcaggtacgtgtcaacggcgagctgatcgccgacagcagcgccgcgctggaattgcgtgaagcgacattgcctgcggtgcaatacattccgttcaccgacgtggcgcaggaccggctcacccgcaccgacaccagcacctactgcccgttcaagggcgaggccagctactacagcgtgaccacctcggccggcgacaccgtcgacgacgtgatctggacctacgagcagccctaccccgcggtggcggcgatcgccgggcacgccgcgttctaccccgacaaggccgagatcagcatctcgaccgactgagctcagtagccgatccatccgggcatcgcgttatccaccgcccgggtgtcgctgtacacgcgcatcgacacgatcagcccgtcgcgggtgtcgaaaatgcacacgaacgggctgtcgtactcgacgcccgcggaggtggttccggcggcctgcgcctccaccacgaccgtctcgccctcgttgacacagcgcaccaggtcgatggtcagctccaggtcctgtttgcgccgctcgatcgcccgccgcaaggtgtccttgtcgcaagccgcgcgggtgtagagcgtccagtagctgaagtcgtcgctgagcagcgcgaagccctcgtccagatcgccgccctcggtggtgctctgtaagaacatccaggccagttcgccctgaggatcatcgaacggcgtcatcacaccgcaatattgacgtggcacgcagttcacggtcaatcagggcaaatcggagagcatcgggtgaagagcagcgcgcgcaccgtggtgtttcccggagcggtcagcttcgggcacaccttggcgcccctccgccgcggcctgggcgatccctgtttcctggccccgggcgacggctcgatctggcggaccagcctgctgcccagcggcccggtcaccgcccggatcagccgcgcggggaccaacgccgtgcagtgtgtggcgtggggagccggcgcggcgcagttcgtcgacatgctgcccgcgatgctgggcagcgaggacgacgcctcggacttcgtgccgcggcatccgacggtcgccgccgcgcagcggcgcgtcccgcacctgcggctaggccgcaccgggctggtgctcgaagcgctgatcccggcgatcatcgagcagcgggtgccgggcgcggacgcgttccgctcctggcgcgtgctggtgtcgaagtacggcacgccggcgccgggaccggcgccggagcggatgagggtcccgccgtcggcgcaggcgtggcgcagcatcccgtcgtgggagttccaccgcgccaacgtcgacccgcggcgggcgcagacggtggtgacctgtgcgcggcgcgccgcctcgctggaacggctggtgtcgcggccggccgcgcaggcgcgcgcggcgttgacgtcgctgccgggggtgggggagtggactgccgccgagacggcgcaacgggccttcggcgacgccgacgccgtgtcggtgggcgactaccacattcccaagatggtcggctggacgctgctgggccgtcccgtcgacgacgcgggcatgctcgaattactggagccgatgcggccgcatcgccagcgggtggtccggttgctcgaagccagcgggctggctcgtgaaccccggcgggggccgcggcttccggtccagcaaatccactcgctttgattcgcggcgtttttcgcaccttggcatcgggtactcgacagcccaagtgaccgagtgtgaaccgagggaaggaagccaggaacaagcgatgagtgagttcacaattccgggattgaccgacaagcaggcggcgcggctcaccgaactgctgcaaaagcaactgagcacctacaacgatcttcacctgacgctcaagcacattcactggaacgtggtgggccccaacttcatcggcgtgcacgagatgatcgacccgcaagtcgaggcggtccgcggtttcgccgacgacgtcgcggaacgcattgcggcgcttggtgcttcgccgcagggcacgcccggagccatcatcaaggaccggtcgtgggacgactactcggtgggccgcgacaccgtccaggcgcacttggccgccctcgatctcgtctacaacggggtgatcgaagacatccgccaatacatcgacgagacggacgaactcgaccaggtgacccaggacctgttgatcgggcaggcggcgcagctcgagaagttccaatggttcgtccgggcacacctggaaagcgccggcgggcagttggcgcacaagggcaaaagcaccgaacgcgccgccgcgcagagcgcgcgcggcaaatcctgacccaccccgcagcgaacgacggatcgccccggcgcagcgccggggcgatcgcgcgtccggcccctcaggaataagtggaccgtagtccggttataccgggtagtccgcaacatcgaggaggccaaatgcctgcagtcacggccaacacgctcaccttgccgcgggtcggtggccccggccccgccgacacggaacgcccggtgcgatccatcaccaccggcccgcggggctacgagggcgaagggttcccggtggtgcgcgccttcgccggggtcagcaccgccgccctggacccgttcgtgcacatggaccagctgggcgaggtcgactatcagcccggcgagccccggggcaccgactggcacccgcaccgcggcttcgaaaccgtgacctatctgctcgacgggaagttcgcccaccaggactcgtacgggggcgggggcctgatcaccgacggcgccacccagtggatgaccgccgggtcgggcatcttgcacatcgagacgccaccggccgaacttgtcgacagcggtgggctgttccacggcatccagctgtgggtgaacctgccccgcaaggacaagttcaccccgccccgctaccaggccatcgaaggcggcgacgtcgcgttactggcctccgacgacggcggcgcgctgctgcgcatcatcgccggcgaggtcgacgggcaccacggcccgggcgtcacccacacgccgatcacgctggcgcacgcgacgatcgcgaacggcgcgcggctcaaccttccgtggcggcgcgatttcaacgcgctggtgtacgtgctgtccggcgacggctacgtcggcccggtcgcgcacccgattcgtccggggcagttggccgtgctggggcagggtgaccggatcaccgtcggcgcgcgcgaggtccaggattcggggccggatcgcggcgccattgatgtgctgctgctcggcgggcggcccattcgcgagccggtattccactacgggcctttcgtgatgaacacgcgcacggaattgatcgaggcgctgcaggactaccaagccggaaagtttggcagcattccgccaaacgcgctaatgccgcaccgccgcgatggcacactctgagaatgcttccacgggggaatcgcaggccagggcgtccgcctgcggccaaagccgatgaaacccggcaacgcatcattcaggccgctcgcctggttttcagcgaacgcggttatgacggcgcgaccttccaggccatcgcggcgcgcgccgatttgacccggccggcgatcaatcactacttcgcgagcaagcgggcgctgtatcaggaagtgatggacgagacgaatgaattcgtcatcggggtcgggataaaagaggcagaccgcgaaaccacgctggtggggcggctcacggcattcatctccgcggcggtgaaagccaatgccgagaatccggcgggttccgcattcattttcggcggcgtcctggaatcgcagcggcaccccgaatggaacacagcggaaaacgattccgtgcgcattgcccgcgaattcttgatccgcgtggtcaacgacgcgatcgagcacggcgaggtcgcggccgacatcgacgcgtcggccttggtggagaccctgctcgtggtgatgtgcggggtggggctgtacgcgggctacgtcgagacctatcaggagatgctggccgtcaccggcatgctgcgacagctgctggaaggcgcgctgtggcgtcccgggtcctaagcgcggacgggcgcgcagtgaagttgcgcacaaagcgtataggctaactaacttatcccggtagcatggtccggacatgactgatctggactcctcgctgccgccgtccgtccggaccgccggcgacagctggaccatcaccgaactcgtcggcgccaccgcgttgggcgtcgccgcggcgcgtgcggcggagaccgccggtcccgatccgctgatccgcgacgaattcgccggtctgctggtgtcgtccgccagcccggcctgggcgcggctggccgacccggagctgtcctggctcgacgacgatccgcacggcaaacgcgcgcaccgcgtcggcatcgactaccaggccgtgcgcacccactacttcgacgagtacttcgacggcgcgctgcgtgccgggatccggcaggtggtgatcctggccgccgggctggactcgcgggcctaccgactgaactggcccgccggcaccaccgtctacgagatcgaccagcccaaggtgctggagtacaagaccgagaccctgcagcggcacggcgccacccccgccgccgtccggcgtcccgtcccagtcgacctgcgtgacgactggcccgcggccctgaccgccgccggcttccaggccgcccggcccaccgcctggctggccgaaggactgctgccctacctgccgagcgacgcccaggaccggctgttcgagatggtcaccgcgctcagcgccgccggcagccaggtcgccgtcgaggtgttcggcatgaactcgcgcagcaacgcgcagcgctggctgcggatgcgcgagcggctgggcctggacgtcaacgtcgccgcgctgacctaccacgagccggaccgctcggatgccgccgcctggctggccagacacggctggcgggtgcacagcgtcgacaaccgcgacgagatggcccggctgggccgcccggtacccgaggacctgtccgacgaggcggtccgcagcacgttgctgcgcgcccacctcggcgggtccaccggctgacttcccccgaggattccaaggagcaaacgccatgagctcactgcgcacccacgacgacacctgggacatcaagagcagtgtcggcaccaccgcggtgatggtggccgccgcccgcgccgtcgagaccgagcagcccgacccgctgatccgcgacccgtacgccaagctgctggtcaccaactccggcgccggcgtgctgtgggaggccatgctcgaccccgacatcgccgcccgggtggaggccctggacgaggaatcggcggcgcacctgcaccacatgcgcggctaccaggcggtgcggacccacttcttcgacacctacttcgccgacgccgtcgccgccgggatccggcagatcgtgatcctggcctcgggactggactcccgggcgtaccggctggactggccggccggcaccaccgtctacgagatcgatcagccgcaggtgctggcctacaaatccaccaccctcgccgagaacggggtgacgccgtccgccgatcgccgcgaggtcgccgtcgatctgcgccaggactggccggccgcgctgcgcgccgccggcttcgaccccacccagcgcaccgcctggctggccgaagggctgctgatgtacctgcccgccgaggcgcaggaccggctgttcaccctgatcggcgagctcagcccggccggcagccgggtggccgccgaaaccgcgcccaaccacgccgacgagcggcgccagcagatgcgggaacggttcaagaaggtggccgacgagatcggcttcgagcagaccgtcgacgtcggcgagctgatgtaccgcgacgaccaccgcgccgacgtcaccgagtggctcaacgcgcacggctggcgcgccacggccgagcactcgaccgccgcgatgcgccggctcggtcgctggatcgagaacgtcccgctggccgacgacaaggacgccttctccgacttcgtcgtcgccgagcgccgctaaggggcattcccggctggcgcgcggccccggttaccgggatttgacctggtcatcgggaacaatggtcagccattatgggcagcgctggaaccggtcacccgcgccgctgggtgctgttgaaggggcggctcgtcgccagcgtcgcgtcggcgttcgtcatggccgtcaccggtgtcggctggaccggctatcacaccgcgctgggccggatcatcatctcgcatgccctgcccaacggggcgatgtcgctcggcgacaaccagaacatcctgctgatgggcctggacagccggttggaccagaacggccggccgctgccgccggaaatctacgacgcgctgcacgccggcgacgaaagctccggcggctacaacgccaatgtccttatcatcgttcatctttcggatggtgacgggcccgtcaccgcggtgtcgatcccgcgcgacgactacgccgagttgccgggctgcccgggatcggtgtgtgccggcaagatcaaacaggcctacgggctggcctatcagcagtcgctgaatgcgcaggccgccgggaattccggcgccggggccaccgacctggccgctcgcgagcagaccgcccgcgaggccggccgcaaggccgagatcggcgccgtcaccgactttctgggcatctcggtcgaccacttcgtcgaggtcaccctgggcgccttcttccagatcgccaaggcggtcgagccgatcacggtgtgcctggccggcgacacccgggacagctattcgggggccgacttccaccagggcgtgcagcgcatcgacgcggccgaggcgatggccttcgtgaggcagcggcgcgacgaaaacgacggctccttcaccgatttcgaccggacccgccgccagcaggcgttcctggtttcgctggtcgaggcggcgcgcagcggcggcgcgctgtccagtgtcagcgggttgcgcaagctgctgcaggtcgcccgggacaacgtcgccgtcgacgccgggctggacctgatgcagttcgccgcgcgggcctcgcaactggccgggcggccgctgtcgctgtacaccctgccgatctcgggcttcggcaaggaccccaacggctccgacatcaacctggtcgaccttcccacgatccggcgcatcgtcaacgaacgcttcatgtccgacgcgccggccgcgctggacgcggcggtcccgggctcccagccgccgcccgcccccgccgagcccgcggtcctcgacgtcgtcaacgccaccacacacgacgggctggccgccgccctcgaggaggcgctggccggccgcgggttcacccggggcagcgccacgactgcccccacccaggccgaggacagcagcatcgaatacggccccggcgccgaggcggccgcgcggctgctggccgaccaactgcacctgccggccaccgcgcagagcgcggtcgcgcccggcaccgtgcggctgaccgtcggcaccgcgttcccggccgccgactacctcgcccatcccggcgcctcggggtcgggacaggtgagcacggtgtccgccaccggcaccggcgatcacgcccccgcgccgaccgacctcagccagatgacggccaccagcgtcccctgcgtcaagtaaccgcggggcgctgccgcgggccggatccttcctattgctctcccaaccagatggttaggatcgcggttatcaccgatgagcggccgccgcgcagcgcgactctgctcgggaaggacaatgatgaccaccgaatcggttgcatcgaagaccacaacttcggccaacgggaccgcatcggccgacatcgccggcacggttgcccggcttcgtcagaccttcgccaccggacgcacccgcgacgtcgaatggcgcaagcgccaactgctccaactgcagaagctgatggaggagaacgaggccgcgatcgccgccgcgctggccgaagacctggaccgcggcccgttcgaggcctacatcgccgacatcgccaccaccgccggtgaggccaagtacgcggccaaacgggtgcgcaagtggacccggcgccgctatcagctgctggagctgccgcagctgcccggccgcggctgggtggagtacgaaccctacggcaccgtgctgatcatcggcgcctggaactaccccttctacctcaccctcggcccggccgtcggggcgatcgccgccggcaacgccgtcatcctcaagccgtcggagatcgcggccgcgtcctcgcgggtgatggccgagctggtgccgaaataccttgacaacgacgccatcgcggtgatcgagggcgacggggcgaccagccaggagctcatcgcccagggcctggaccgggtgatgttcaccggcggcaccgaaatcgggcgcaaggtctacgagggcgcggccccgcacctgacgccgtgcaccctggagctgggcggcaagagcccggtcatcgtcgcggccgacgccgacgtggaggtggcggccaagcggatcgcctggatgaaactgctcaacgccgggcagacctgtgtggcacccgattacgtgttggcggacgccaagatccgcgacgagctggtggacaagatcggtgccgccatcaccaagttcaccgccgacaagcccgagggcatgcgggtggtcaaccagcgccagttcgaccggatcagcagctacctgtccgggtcggacggcaaggtcaccgtcggcggggcgtgcgacccgtccaccctgcgcatccagcccgccgtggtggtcgaccccgaccccgacgggccgctgatgcgcaacgagatcttcggaccggtgctgccggtgatcaccgtccaaaacctggacgaggcaatacgtttcgtgaactcacggcccaagccgctgtcggcatacctgttcaccaagacgcgcgagacccgcgagcgggtgatcaaggaagtgccggccggcggcatgctgatcaaccacctcgccttccaggtgtcgacggccaagctgccgttcggcggggtcggcgcgtcgggaatgggcgcctaccacggtcgctacggcttcgaggagttcagccaccgcaagtcggtgttgaccaaacccacccgtcccgacctgtcgagcttcatctaccctccgtacacggagcgggccttcaagatggcccgcaagatgttctgaccgctggcttcaccgaatcggttgccagacagagcttttcacagcagagaggaatcttatgcccggagtgcaggatcgcgtcatcgtcgtcaccggagccggtggcgggctgggccgtgagtacgccctgacgctggcccgcgagggtgccagcgtggtcgtcaacgacctcggcggggcccgcgacggcaccggcgccggccacaacatggccgaccaggtggtcaaggagatcaaggacgccggcggccgcgcggtggccaactacgacagcgtggccgagcccgcgggcgctgagaacatcatcaaaaccgcgcttgatgagttcggcgccgtgcacggcgtggtgagcaacgccgggatcctgcgcgacggcaccttccacaagatgttgttcgagaactgggacgccgtgctcaaggtgcacctgtacggcgggtacaacgtgatccgcgccgcctggccgcacttccgcgagcagagctacggccgggtcgtcgtcgccacctccaccagcggcctgttcggcaacttcggccaaaccaattacggggcagccaaactcggcctggttggcctgatcaacagcctggcgctggagggggccaagtacaacatccacgccaacgcgatcgccccgatcgcggcgacccggatgaccgaggacatcctgcccaaggaagtgctggccaagctgacccccgagtacgtcgcgccggtggtcgcctacctgtgcactgaggaaaaccccaacagcgcttcggttttcgtggtcggtggcggcaaggtgcagcgcgtcgcgctgttccagaacgccggcgtcacctacgacaagccgccgacggtgcaggacgtcgccgcgcggtgggacgagatcaccgacctgtccgcggccaagcaggccgacttcaagctggggtaggcagcgggcggtcggcgggtcaggcgagcagcgccgcgcgcaggcgttgcacgtctgcctcgccgaccccggcgtcgcgcaggtaggcctgcagcgacccgaacttctcgtcgatggtttgccgagcggcggccaggtactcctcgcgcacccccagcacaccgtcggacagccgcgcctcggtccaggtcaccacctccggggtcagctcggtgtcctggcgctgcgcgatcatcgccgagatctgcgcgcgcagcgcgggcgcggcgtcgttgctgcgcagaaagtcggcgacgatgacgtcgcggtcgacgccgatcgcttcgagcaccgtcgccaccacgaacccggtgcggtccttgccggcgaagcagtgggtgagcaccgcacgcccggcgcccagcagcgagatgacccggtgcagcgctcgctgcgccccgttacgcgttgggaattgccggtattcgtcgatcatgtagcgggtggcggcctcgtcgacggactccgccgactgctcggcccccgtcgccggtgagcagccgctggaaggcgtgctcgtgcggcgcctggtcgtcggtgccggcctcgtgctcgccgagatcgggaaagggcagcaggtgcacctcgaccccgtcgggaacccggcccgggccgcgccgggccacctcgcgggccgcgcgcaggtcggcgacgtcggtgatgcccagccggcgcagcgtcgcgcggccctcgtcgtcgagcccgctcagctcgccggaccggaacagccggcccggccgcagcatgggcgcaccgtcggcgacgtcacgaaagttccacgcgccggacagttctcgcagcgcctcaggcatgcgcggtgaccgccgcggcgagcgcagacttttcccggcccagttcggcgcgggcgatggtccgcatgtgcacctcgtccgggccgtcgaagatccgcatggcgcgatgccagccgtacagccgggccagcaccgtgtcgtcgctgaccccggcggcgccgtgcacctggatggcccggtcgatgacgtcacaggccaccttcggcgccaccgccttgatctgggagaccagcagatgcgcggccttgttgccgtgctggtcgatggtccacgccgccttctcgcagagcagccgcgcctggtcgatttcgttgcgggacttggcaatcgactcccggaccacgccctgctcggccagcgggcggccgaacgccacccgcttttgggcccggttgaccatcagcgccagcgcccgctcggccccgccgagggcgcgcatgcagtggtggatgcggccgggaccgagccgggcctgggcgatcgcgaagcccgagccctcctcgccgagcaggttggtgaccggcacccgcacgttgtcgtagacgatctcgcagtggccgtgctggtcctgccagccgaacaccggggtggagcgcaccaccgtcacccccggggtgtccatcggcaccagcaccatcgactgttgttggtggctggccgcgtcggggttggtgcggcccatcacgatcaggatcttgcagcgcgggtccgccgcgcccgacgtccaccacttgcggccgttgatcacgtagtcgccgccgtcgcgcacgatggaggtctcgatgttgcgggcgtcgctggacgcgacggcgggctcggtcatggagaaggcgctgcggatctcgccggccagcaacggctccagccactgcttgcgctgctcctcggtggcgaacaggtgcagcgtctccatgttgccggtgtcgggcgccgcgcagttgagcgcctcgggcgcgatctccaggctccagccggtgatctcggccagcggcgcgtattccaggttggtcagacccgactcggcgggcaggaacaggttccacagcccctgctgcttggccttgaccttgagctgttccaccaccggcgggacggtgtggtcgtgcgggccggcctcgtgccggtacttgtcgtattcggcctcggccgcgaagacgtgctcggtcatgaaatcggtcagccgcttgtggtagtcgctggctttggccgacatcgcgaagtccatgcccgtcaccataggacacgggtcgccgcccaccgcgagcagacgcaaaagccccccgacacgccgctgggaatgggcttttgtgtctgctcgcggtagagatgcggcatgaccgaatcccgacccccccttcccgccgttcacccgggacacggccctgcagaaggtgcaagccgccgaggacgcctggaacacccgcgatcccgaccacgtcagcctcgcgtacacgcccgattcacggtggcgcaaccgcgacgagtacatcgtgggccgcgatcagatcgtcgcctttttgacccgcaagtggcagcgcgaactcggctactcgctgcgcaagagcctgtgggacttccacgacaaccgcatcgcggtgcggttccagtacgagtgccgcgaccggtccggccagtggtaccgcagctacggcaacgagctgtgggagttcaccgaatcggggctgatggcccgccgcgaggccagcatcaacgacgtgccgatcgacgagtcgcagcgccgctacttcgggccgcgcccggcgtccgaacacggccgggagattccgctctggtagcgccggcgcggcggcgacggcgcgggccgggtgcggcctgcggcgcggcgcggcgaccgggttagggtgttcacgccaacggggtcgccgatgagttgccggtaggcaaggaaatcagcaaggaaagtagatgtacgcgccatgacaaatgcgcaggccaacgcggtcaaggtaggggtggtcgccgaatccggggccgacgagcggcgggtcgcgctggtgcccaaggcggtggcgtcgctggtgggcagcggcctggcggtggtggtcgagtccggcgcgggcgagcgggccctgctgcccgacgcgctctacaccgaggccggcgccgacatcggggacgcgtgggccgccgacatcgtggtcaaggtcgcgccgccgacggccgacgaggtcgccaagctgcacagcgggcagacgctgatcggcttcctggcgccgcgcaacgccgacaactcgatcggcgctttgaagcaggcgggcgtgcaggccttcgcgctggaggccattccgcggatctcgcgggcccaggcgatggacgcgctgtcgtcgcagggcaacgtggccggctacaaggcggtgctgctggccgcctcggagtcgacccggttcttcccgatgctgacgacggcggcgggcacggtgaaaccggccagcgtgctggtgctcggcgtcggggtggccgggttgcaggcgctggcgacggccaagcggctgggcgcgcgcacgtcgggctacgacgtgcgtcccgaggtcgccgaccaggtgcgctcggtgggcgcgcagtggctcgacctgggcatcgatgcggccggtgagggcggatacgcccgcgagctcaccgaggaagagcgggcccagcagcagaaggccctggaggaggccatcgccgggttcgacgtggtgatcaccacggcgttggtgcccggccgcccggcgccgcgactggtgaccgccgcggcggtcgagtcgatgaagccgggcagcgtggtggtggacctggccggcgagaccggcggcaactgcgagctgaccgagccgggcaagacggtggtcaagcacgacgtcaccatcgccgccccgctgaacctgccggcgaccatgcccgagcacgccagcgagctctacagcaagaacatcaccgcgctgctggacctgctgatcaaagacggcaagctggcccccgacttcgacgacgaagtcgtggcggcggcgtgtgtgacacgggagagtgcatagatgtacgacgaactgttggccaacctggcgatcctggtgctgtccgggttcgtcgggttcgcggtcatctccaaggtgcccaacacgctgcacacgccgctgatgtcgggcaccaacgccatccacggcatcgtggtgctcggcgcgctggtggtgttcggctcggtcgagcatccgtcgctggcgatgcagatcatcctgttcgtcgcggtggtgttcgggaccctgaacgtcatcggcgggttcatcgtcaccgaccggatgctgggcatgttcaagagcaagaaacccgccaaggctgacgaggcggccaaatgaactacttggtgatcggcctctacatcgtttccttcgcgctgttcatctacggcctgatggggctgaccgggcccaagacggcggtgcgcggcaacctgatcgccgcggtgggcatggccatcgcggtggccgcgacgctgatcaagatccgccacaccgaccaatgggtgctgatcatcgccggcctggtggtgggtgtggtgctcggcgtcccgccggcccgctacaccaagatgacggccatgccgcagctggtggccttcttcaacggcgtcggaggtggcaccgtcgcgctgatcgccctgtcggaattcattgagacatccggcttttcggcgttccagcacggcgagtcaccgacggtgcacatcgtggtggtgtcgttgttcgccgcgatcatcggatcgatctcgttctggggctcgatcatcgcgttcggcaagctgcaggagatcatctccggcgccccgatcggcttcggcaaggcccagcagccgatcaacctgctgctgctggccggcgccgtggccgccgcggtggtgatcggtctgcacgcccatcccggcagcggcggggtgtcgctgtggtggatgatcgggctgctggccgccgccggcgtgctgggcctgatggtggtgctgcccatcggcggcgctgacatgccggtggtcatctcgctgctcaacgcgatgaccgggctctcggccgcggccgcggggttggcgctgaacaacaccgcgatgatcgtggccggcatgatcgtcggcgcctcgggttcgatcctgaccaacctgatggccaaggcgatgaaccgctccatcccggcgatcgtcgccggcggcttcggcggtgggggcgtggcaccgggcggcggtgacggcggcgacaagcacgtcaagtccacctcggcggccgacgccgcgatccagatggcctacgccaaccaggtgatcgtggtgcccggttacggcctggccgtcgcgcaggcccagcacgccgtcaaggacatggccgcgctgctggaggagaagggcgtgccggtgaagtacgccatccacccggtggccggccggatgcccgggcacatgaacgtgctgctggccgaggccgaggtcgactacgacgcgatgaaggacatggacgacatcaacgacgagttcgcccgcaccgacgtcgcgatcgtcatcggcgccaacgacgtcaccaatccggccgcccgcaacgaggcgtccagcccgatctacggcatgccgattctcaacgtggacaaggccaagtcggtgatcgtgctcaagcggtcgatgaactccggcttcgccggcatcgacaacccgctgttctacgccgaggggacgacgatgctgttcggcgacgcgaagaagtcggtgaccgaggtcgccgaggagctcaaggcgctataactggcgctctaacgcggtgcctagacgggcgggtaggccggcggcgggtagccgttgccgtcggtgaccccgcgcaacccccaggtgaggtaccgcatgaagaactcgatttcgtcgcttccgtcgtaatccggactcggatccatcggccccacctctcgactcagcgcattcgaggagaagtctagtcgcatagccgtcgacgggacacccggcgttttgcttaaactgtccaaccagttgattgatagttatccttggccgaaccggggctggcctgcccgtaccgacgatagtgagaacagatgcccgccgacagcagcaccccgaatgggcaaacccgccgcgaagagctgctggccgtcgccaccaagctgttcgccgcgcgcgggtatcacggcacccggatggacgacgtcgccgacgtgatcggcctgaacaaggcgaccgtctaccactactacgccagcaagtcgctgatcctctacgacatctaccagcaggccgccgagcggacgctggccgcggtccacgacgacccctcgatgaccgcccgcgaggcgctgtaccagtacaccgtgcggctgctcgaccagatcgccgccaaccccgagggcgccgccgtctacttccaggagcagccctacatcaccgagtggttcaccaaggaacaggtcgccgcggtccgggaaaaggagacccaggtctacgagcacgtgcacgggctcatcgaccgtgggatcgccagcggggagttctacgagtgcgactcgcacgtcctggcgctcggctacatcggcatgacgctcggcgcctaccggtggttgcgcccgagcggacgccgcagcgccaaggagatcgccgccgagttcagcaccgcgctgctgcgcggcctgatccgcgacgaggagatccgcaccacctcgccgctgggcccctgaccctctcgtcgtagccgacggacgcggaaccgccggcggctccgggccggtaggcgccgcccatttaatggactagtgtctagaaaagttttgggcgctcaacggacggagactgtcatggcgatccgcgtcgcgcacgtcggcaccggaaacgtcggcggactggccctcgccgaactgatcaccaacccgcgctacgagctgaccggggtgtgcgtgtccaccccggagaaggtcggcaaggacgccggcgagctgtgcggcgtcggactcgataccggggtggtcaccggcgtcgccgccgtcggcgacctggacgccgtcatcgccgccaagcccgaatgcgtggtgtactgcgcgatgggcgacacccggctgcccgaggcgatggccgacgtcatgcgcatcctggccgccggcatcaacgtcgtcggatcgtcgcccgggctgctgcaatacccctggggtgtgatgcccgagaagtacatcgcccgcgtggaagacgctgccaggcaaggcaattcgagcatcttcatcagcggtgtcgacccgggcttcgccaatgacctgatcccgctggcactggcgggaacctgtcagcgggtggagcaggtgcgctgcatggagattcacgactacgccagctacaacggcgcggaagtcatgggctacatgggattcggccgtccgctcgacgagatcccgatgctgctgcagccgggagtcctcagcatcgcctggggaaccgcgatccgtcagctggccgccgggctgggcatcgaggtcgacgagatcaccgagtcctaccagcgcgagccggcgccggaggacttcgacatcgcggtgggccgagtggccaagggcacgctggcggtgctgcagttcgagattcgcggcatggtcaacggccaccccgccatcgtcatcgagcacgtcacccggctgcggccggatctgcgccccgacctgccgcagccagccgcgggcgacgggtcctaccgggtcgagatcaccggggagccgtcgtacgccgtcgacatcgtcccgagcagccgcaagggcgaccacaaccacgccgcgatcgcgggagccgcgggccgtatcgtcaacgccatcccggcggtgatcgcggcgccacccggcatccgcaccaccctcgatctgccgctggtgaccggcaaaggcctttacgcaccaagcactttggtgaccacctgaatcgaaaggagacccgcgtgggacgggtagacggcaaggttgcgctgatcagcgggggcgcccgcggcatgggcgccgagcacgcgcggctgctggcggccgagggcgccaaggtggtgatcggcgacatcctcgacgacgagggcaaggccgtggccgacgagatcggcgactcggtgcgctacgtccacctggacgtcacccagcccgaccagtgggacgccgccgtcgaaaccgccgtcggcgaattcggcaagctcaacgtgttggtcaacaacgccggcaccgtcgcgctcgggccgctgaagagcttcgatctggccaagtggcagaaggtgattgacgtcaacctgaccggcaccttcctgggcatgcgggtggccgtcgagccgatgatcgcggccggcggcggctcgatcatcaacatctcctccatcgaggggctgcgcggtgcgcccatggtgcacccctacgtcgcctccaagtggggcgtgcgcggcctggcgaagtccgcggcgctggagctggcgccgcacaacatccgggtcaactccgtgcaccccggcttcatccgcaccccgatgaccaaacacctgcccgacgacatggtgaccgtcccgctcggccgtccggccgagtcccgcgaggtgtcgacgttcgtcttgttcctggccagcgacgagtcgtcgtacgcgaccggcagcgaattcgtgatggacggcggactggtcaccgacgtgccgcacaagcagttctagcgcggtgctataaccgcgaacatgctgcgcgcgttggcggatacggtcggatccactcacgtcgtcaccgaccccgacgtgctggcggcgcgcagcgtcgaccacaccggccgctatcgcgggcgggccagcgcgctggtgcggccgggctcggccgagcaactcgccgaggtgctgcgggtgtgccgggacgccggcgcccacgtgacggtgcagggtgggcggacgtcgctggtggccgggacggtgcccgagcacgacgacgtgttgctgtccaccgaacggctgcaccgcatcgccgacgtcgacaccgtcgagcgtcgcatcgaggtcggcgccggggccacgctggccgcggtgcagcaggccgcgtcggccgccaacctggtgttcggcgtggacctcgcggcccgcgacagcgcgaccgtcggcggcatggcctccacgaatgccggtgggctgcacactgttcggtacggcaacatgggcgagcaggtgctcggcatccaggtcgcgctgcccgacggcgcgctgctgcgccggcgcagccgggtgcgccgggacaacaccggctacgacctgcccgcgctgttcgtcggcgccgagggcacgctgggcgtgatcaccgagctggacctgcgactgcaccccaccccgacgcacacggtgacggcgatctgcgggttcgccgacctcgatgccgtggtggccgccgggcgcacgttccgcgacgtggacggcatcgcggcgctggaattgatcgacggccgggtggctgcgctgacccgcgagcatcgcggcgtgcccgccccggtcgacgccgactggctgctgctggtggagttggccgccgaccacgaccagaccgagcggctcgccggcctgctggacgacgcgccgctcagcggcgaaccggccgtcggcgtggatgccgttgcgcggcaacggttgtggcaggtccgggaggcgctggccgaggtgctcggcgtgtacgggccgccgctgaaggtcgacgtgtcgttgccgctgtcgtcgatcagcgaattcgagagagccgcaatcgatttggtgcacacccacgcgcccgacgcgctgccggtgttgttcggccacatcggcgagggcaacctgcatctgaacgtgttgcactgtgcggccgaccgggagcacgcgctgtatgagccgatgatggatctcatcgcggcaagcggcggcaacgtcagctccgaacacggcgtcggcagccgcaagcggccctacctcggcatgtcccgggagcccgccgacatcgccgcgatgcgcaccgtcaaggccgcactcgacccgacgggctacctcaacgccgcggtgctgttcgactgatcccggccgccggtcagtcggtcggcgccttgatccccaccgcgtggcgcagctgggccaggaactgatcggcgtcgtcgctgcgcacgatgtagtgcgagatcgcgatccggatcaccgtggccgccttcaccgcggcgttgggcccgggcaggtggcgctgcaggccctcgcgcatctgcgggatcacccaggagaactgggcgatggtgtgctcgggctcgacgtcgaccatgcggacgccggagtaggaatgctgatagtcgacgatgaaccgcagcaccgcgtccagcttgtccacacccttgagacccgcggtggccttgaccaggccgctttcgaagatctggcgctcgtaggccgaaaacgccgacagcagctcctctttcgaggcgaaccagcggtacagcgtcgggcgggacaccccggcctgggtggcgacgtcggacaggctgagcttggtcttgccgttgcgaccgagcacctcggcggtggccgccagaatgcgctggcgggtcgaggtgtcggtgtcggcgatcgccgtcgcccggaccgggtggctcatgattcaaactttacgaagtgtcgccgcggtgtcatggtcattcgctcccacgttaggcccgaccgggacgccggcgcaccagaaccgactgctggatggcgcccacggcgccctgctcgtcgaacaacgtgccgatcgtcgtgccgatcccgtccggcccgtagctggtctcggcccggatgccgatccagtcgccgtcggggacccggaacacgtgcacggccagatcggtgttgaggaacgtccacttggtgatgtccagcttgctgccgatgccgttggcgcagtcggccaccgcgaacagccgctgtagccgggtcatcgattcgcccttcaccaggtcgacggtcgggctgatccaggattccccggggccctcgctcagcggctcggtcaaccacagccactgcaggctgtgcacgtagttgcggtcccagtcgcgcgccttgaggttgcggtcgtaggcctcggcccgcggacgcggcagcggcgccgccgcgtgcgccagggatccggtgtcctggtgctgcaaccgccagccgctggcgcgcgccaccggccgcggggcgccgtcgggccccggcgccagcatctgggcgccgagcagttcgatctgcttgccggggcgctgcacctccgcgcgcacccacaggtcgccctcgaccggcaccccacccagcaggtcgatcaccacccgggacagccgggtgtcgtcgcgctgctcgcagcgctccagggcccgcgtcagcagcgccgataccggaccgccgtgctggatcgtcgccgaccaggtgccgcgcgccagatcggtggcccggaacctctcgcccgacgcgttggagtcgatcagctcgtagtaggcgtcggtcatcgtcaacctctccggaaagtcagggcaggccggcgccgggcgtggtcaccgtgacggcatccaaccgggacaggcgggtgccgaccagacgctgaggataggcgtccgtgctcgacaacaaaaacagcgtgcggcgctgcggaccgcccagtgcgcaggcgatggccacgcggtcgccgatatcgatgcggtcgctgacggcgccgccggccacgatccgctcgaactggtgcgccagcgtcatcgccgcccacaccccgccgtcggcgtccagcgcgatgccgtcgggcggcccgtccaggccgtcggcgaagacccgccggcccgacagtgcgccgtcgtcatcgatggcgaacgcgctcagccgccgcccggtggactcggcgacgatcagcgtcgccccgtccggggtgatcgccatgccgttggggaagtccaggtcgtcggccaccacggtcgcacggtcgtcggggtccagccggatgatcgcgccgccggtgaaggcctggcagccgatgtaggcgcggcccgcgcggtcgaccaccatgtcgcccaggtcggccggcgcgatgtcggcgagttcggcgacggtgaccaccgtttcgccgtcgtagcgcaacacccgccggtcgcgcgtggaggcgatcagcaacgagccgtcggggcggaatcccagcccggagggacagtgcccgggcagcggcagggtggtcagcgcgccacccatggtggttgtgtgcaccgcttcgccgagcatgtcggagaaccacagcagaccctcgaaccagcgcgggccctcgccgaagcagaacccgttgaccagtggctcggggatcatccgctcatgccttcggcaaaccttccgctttacaaaacatcgacaaagtgtcatgcaccgcgggtgccggtgtcaatcgagcgcggcgagctcccgcgcgacggcctcatggtaggcgtcgatcctggccgggttggcctgcacgaacagctgatcgggcagcggggcgtccttgtccgcctcgatcgtcatggtgcgggagaacagcgtgatgtcgtggccggggcgggtgaaccggtagcagaccgtgatgcggcccggcaggccgccgttgccgtcgcggtcgtggcccagccggccgatcgaggtgaacacgaacagcgacgggcgcaccgcggcggccagctgccagctgaagatccggtcgccgtcggggccggcctcctcccaggtgtcgcccacccgcagcggaagctcgggccgcttgccgatgtgggcgctgccgggataggtcttggtccagttctgcggattggtgacgaagtcgtacaccgtttcggcggactgggtgaacgcggtctccgagctggtggtgacgatgcccaattgtattgcctccctgtgcgttccgccgcccggccgctacgccgccccgcagtgttgttagccaagctttacaaatcttacgcaaagtgtcacgctgagcgcgaagctgggcgacacgagaggtggaatccgagttgagcaaggtttcccaggaatcgaccgactggacagtgcagggcctgctggatctgttcgaggtgcggcccgacgggcaggaccggttcaccgccgacaccgccggtgatatcggggccgggggcgacgaacgccaggtggtcgagggcacccaggtgctcgcgcaggcgatcgtcgcggtggccaagcggttcgcagacaagtcggtgcgctcggcgcacgccgtgttctcccgcgcagtcgcggtcggaccgcccatcgagctggtcctcgatgtcgtggccgaaggccggtccaccgccaccgccgtcgtcgccgtgcaccagaacggccggcgctgcctgagcatcaccgtgctggccgacgtgcccaccggcgacgtcatccgccatcagctgccccggcccgacgtcgccgggcccgccgacgccaacccctccccgatgccgatggtcggccgggagctgcgcctggtggacgtcgtcgacgtcaacagccccgacgaggtcggcccgccggagctgtacgcctggctgcactacgaccccatccccacccgtgacgacctggccaaggcgctgctggcctacttcaccgggcacctgggcatctccaccaccatgcgcgcgcatccgggcatcggcaccgcccaggcgcacctgaccgtgtccaccgcgccgatgagcatctcggtcgccttccacgagccggtgcgctgggacggctggctgctctacagccacgagagcacccaggtgggcgccggaatgtcgtacgtgcgcggcaccgtgcacaccgaacagggcgagctgttggcctccttcgcgcaggaggcgctgatccgcccgctgcgcaccagcgacaccgcgatcgattcccgggcccgcttctaacggccatgcgtttcaccatcacccacccgatgcacagccatccctacaaccgggagctggtcagcggggacggcatcgccaaggtggccgcggcgaccgaggcggccgggatccacggcttcggcttcaccgaccaccccgcgccgtcgcagcgctggctcgaggccggcgggcatgacgcgttggatcctttcgtggcactgggtttcgccgccgccaccacgtccacgctgcggttgatccccaacattgtggtgctgccgtatcgaaacccgttcgtggtggccaaatccggcgccaccctcgacctgcttctccggcggccgcttcaccctcgccgtcggcgtgggctacctcaagcgcgagttcgcggcgctgggcgtcagttacgacgagcgcgccgagctgttcgaggaggccctgcgggtgatccgcgccgtgtggaccggtgacgacatctcgttcgagggaaggcatttcagcgcccgcggcatcaccgcgcatccccggccggtcagcagcccgcatccgccgatctggatcggcggcaacaccgccgccgcgcgccagcgggtggccgactacggcgacggctggtgcccgtttcccgccccgccgcagctggcccggacggccggcaccgccgtcatcgactcggtggccaaactcgccgacggcatcgccgacctgcgtcgcagatgcgatgcggcgcaacgtgattggtcgacgatcgacatcaccttcaccaacttcgagggtggtagccccgccgacgacgaattcaacgccgacgcctatctcgacggcctggacaagctggccaagctgggggtgacctgggtgagcgtgcacctgcccggcgacagcatggcccacgcgctggagaccctggaccggttccgcaccctggtcgtcgacgccgcctagccgcaaccatggacttctcccgggtagaactttcggcgcaggacgcggccttccagcagagcacgcgcgcgttcctggccgagcacgtcaccgaagaggtgcgccggcgtgatcgcgaaaccggcgaaaacttcagcgagccggtgcatgtggcgctgggtgaagcgggttacctggaatcggactggaagctggagtccgagggcggattcgatccggtacgccggcggatttttcagctcgagatcggccgcgcgcacacgccgtggttccactggggcaccacggcggtggtcgcgcggttggtcaagcaattcggggcgcccgaactcgccgacgcgatcctgcccggcgtgctgtccgggaagatccggctctgcctgggctacaccgaacccgagggcggctccgacgtcgccacctgcaaaacccgggccgtgcgggacgggtcgggctggatcatcaacggctccaagatgttcacctcgaacgcgcagaacgccgagtacgtcttcctgctcaccaacaccgatccgcagcggccgaaacacaagaacctgaccatgttcctggtgccgctcgactcaccgggcatcgagatccagggcatccgcaccgtcgacggcgaccgcaccaacatcgtctactacagtgacgtacgcgtcgacgacctctaccgcatcggcgaggtcaacggcggctggacggtgatgcggttcgccctcgacgccgaacacggcctcaccgacccccaagaccatggcctgcagaacatttcgatgctttccgagcacggccacctgatggccgaggcggccgacagggtcgcggccatcctggccagacccgatgcggccggccgccggccgatcgacgacgagtcggtcaaataccggctcgggcgcggcatggcccgcatcgaggcggccatgtcgacccccggcatgtacggacgcgtggcgctcattcaaaccatgcgtgaggtatcccaggaactgatggacctgctggggaccgcatcggccttgcccaccgacaccccgggttcacccgacgacggcgccatcgagttcatcttccggcacgccgtgcccgccggcatctacggcggcaccatggaggtgttccgcaacatgatcgcccagcacgagctggggctcggacggcctagctacgggcgctgaccggcagctcggccagcagctcgacgcgggtctcgtcgaaactcagaaaacccttgatgggcaggctttccggcggcggatccggatagcaccagccgacgtcgtcgaccacccggtcgccgtcgaccagcgaccagtacgtcgcgaaacccttgtagttgcagtaactcgtcgtctccgagcggcgcagcagatcggtgcgcacgtgcgcgggatcgacgtacagcctgggcggcagcgcggtctcgaagacgatcgtcgtgtggtcggtgtccaccagcgtggtgccgccgacgcgcacccgcagccgccggcgggtgccccggcagtccacacggtgatacggattgggcgggtagtgcacgagcttgcgtccctcctcccaccaggtgtccacggcgtcccaggggacgtggacgaaaccgggcgcctccggctccggctccccgggcaggccggcgacctcgtcggccgggaagacgtagctcagcggccgcccccgccggtgcaccatcagcgcccgttcggtgtcgatcaccgaacgcccgtccttgaccgcctgcacccgccggggatgcggttcgacgtagacgacctcggcggggatcggcggcgagaaccgccccgccggatcgctgctgagcggaccccgcccggccaccagagacatgggtcgtcctcccatcgcacgcaaaccccactcgaggccacgctagcgtgacactcgacacgcggcgccacgatggcgtgacgcccgaacggcagaaggcgggaactcacccatggcgggaccggtggaaggcgtcacagtcgtcgaactcggggtctgggtggccgggccggccgccggcggcatcctggccgactggggcgccgacgtgatcaagatcgagccgccgaccggcgacccggcccgcatgttcggccgcatgctgggctgcgacctggggctgaacccgccgttcgagatggacaaccggtccaagcgcagcgtcgtgctggacctgagcagcgaaccggaccgccgggcggcgttcgaattgctttccggcgcagacgttttcctgaccaacgtgcggcccggggcgctgcagcggctggggctggacttcgcgtcggtgtcggcggccaacccccggctggtgtacgggctgatcaccgggtacggggcgagcgggccggacgccgaccgcgccgccttcgacgtggccgcgttctggtcccgcgccggggtggcccatctgctcacccggcccggcgacacgcccccgttccagcgcggcggcatgggcgaccattcggccgggatgacgatggccgcggcggtgtgcgcggcgctgctggcgcgcgagcgcaccggggccggccaactggtgaccacctcgctgtaccggcagggcgcctacaccgtcagcttcgacctgaacacctacctgatgagcggccagcccatcgcgatcgggcaacgcgagtcgatgggcaacccgtgcatgaacaactacgccgcctccgacggacggcggttctggatcgtcgggctcgagccggagcggcactggccggcgttgtgccgcgccgtgggccgccccgagtggcgcgacgatccccgcttcgccgacgcccgcgcccgcgccgccaactcggtggcgctgatcgcggcgctggacgagatcttcgcgacccgcccgctcgacgagtgggcgcagatcttcgccaacgaaccggatttcttctggtcgccggtcaactcgctggaagacgtggtggccgacgagcagttccacgccgcgggcgggatcgtttacgtgcccgacggcgccgacgaccaagccgcggtgccgatggtggccaccccggcggatttccacggcacgccgtgggcaccgcgttctgcggcaccggaactcgggcagcacaccgcggaggtcctcgccgagctcaaggcgcgccgcggctcctgaccggccgccgggagctttacaaatttgcgcggaagtgtcacgctgtgcggtgagtcgcatcgcccggaccggcaagcggctccagcccgtgcaaagcccacgacaagcgctcgaggcccggcaacggattcgttgcgggcggtggtgaggaatggatcgatggtcgctccgacgttcgacatcagcaagagcagcgccgcccgggtcacccgcgcgaacgacgagggcctgcggtatcggctcgacgtcgtcgccgccagcaccgtcgacgtcgtgcagtcggccggcggctggctctacgaccgggcgatggccggctgggaggtgaccgtgctgctcccgcacggctgcaacacccgctcgctgcggatcctgggggtgcgcgccgccgacctcgactccgggctcgccgggctgggccagggcgccgccggcctggccgtcagcgccgacgcgttcaccgccgacgcccgggtgcgcgacacggtgctcgaatcgctgcacaaccggctcaccgcggtcgcgctgtggggcgacggctggccgctgggcgtgagccgcgcgaccacccggacccagcacctgctcagcggagccgcgcgcaggttcaagggctatgcgcttgccgcagaagggatttcggacggcggcatcgcccccgccgaatcgctgctgtgcgacgtgtgctcggccgccgactcagagctggtccggctcgactagcccatgaagaagtactaccgacacacgctgctctacctgcacgagacgatctcgctgggatccgggcgaagcgaccgcttcaccgaggtcttcaccgacacgtatcggccgatgatggaccagctcggcgcccggctgttcgcgatctgggaatccaccccgtacaacggtcactggccgcaggtgacgatcatctgggaggtcgacggattcgccgactacgccaggatcggcgccgcccaggcgcgcggcggcagccacgaggccgcggccggaaaatggtcggcgtttctggccgacatcggcgcctcgggggaggggcgcatcatgtacccgggccccagcaacaagacgctcgcccagctgcgcgaggccaatttcactgcgcccctggtgattcaggagatcatgcagaccaagccgggccgccaggacgactacatccgggagctggagcgactctacgtgccgtggtcggagcgcaccggaaagcgctggctgggttcgttcaccaccaccttccgctacaacgaggtcatccactactgggcgctggacggcggctgggactgcttcgccaaccactacccgtcgtggaaggagagcccgcccgccgagatcgtcacctggatgagcgtggccccggccctgcgcgacggctgggaggattccatcctgcaggccctacccccctcgccgctgcagtgatggcccaaggagcgccggtggacttcgcctacgatcccttcgacgccgaggtgatggcaaacccgttgccgtactaccggattctgcgcgaccaccacccggtgtactacatgccgcagtgggacaccttcgcgctgtcccggttcgacgacatctggagagtgctcgaggtcaacaacggcaccttcgtcgcctcggagggcacgctgccgccggcatcggtgctggcccagcacaacgacggcccggtcgacgacccgccgctgcacccgctgccgtttcacgccatgttcgacgccgacctctacggcgagatccggcgcacccattcgcgcccgttccggccgcgggcggtcaccgacctcgagggccggatccggaccctggccaacgaacgcctggacgagctgctggcgcgcggctccttcgacctgacccaggagtacggcggggtggtggtggccaccatcgtctgcgaattgctgggcatcccaaccgatctcgcgccacaggtgctcgccgcggtcaatgccggcagcctggccgagccgggcgtcggcgtggacaccgggcaggcgcgccccaactacttcgagttcctgctgcccgcggtgcagcgccgccgcgccgacccgtccgggccgccgctggaggtggtggacggcctgctcggctaccaactgcccgacggcagcgcgctcgacgacctcgaggtggcgacccagatgctgtgcatcttcatcggcggcaccgagacggtgcccaagatcgtcgcccacgggctctgggagctcagccggcatcccgaccagctggccgccgtgcgcgccgacccgcagcacaacattccggtggcccgcgaggagatgatccgctactgcgcgcccgcacagtggttcgcgcgaacggtgcgcaagcccttcgacattcacgggcagacccccaacccgggccagcgggtgatcaccctgctcgcctcggccaaccgcgacgaacgcgaataccccgaccccgatgacttcgtctgggaccggcccatccgccgctccctggccttcggccgcggccagcacttctgcatcggctaccacctggccagactggaagtggctgtgctgctgcaagaatggctgcgccgggtgcccgactacgcgatccgggccgacgccgccacccggttgccgtccagcttccaatggggctggaacaagatcccggtggaggtctgaggtgtggtgctaccggatcgtcgcgccgtatcggttcgaaccgaccacgatcgacgacaagacccccgagtgcctcgccgacgggcaagtgctgctgcggttttcggccgccggcgtgtgcggcagcgacctgcccgccttccgcggcgcccggggccggctgcccggtgacgacggccgcagcggccccgagaaggacggctttcccatccacgagatcgccggcgaggtgatcgccagccggcatccggcgcaccgtcccggagaccgcgtcgtcggctgggcatccggattcgacggcctgatggaacgcgtcgtcagcgacggcgacgggctggcgccctatgacccggcgctgagcccggcgcaggcggtcgagctgcagccgctggcctgcgtgctctacgcctgcgagcagctcggcgagctggccggcaagcacgtcgcgatcatcggccagggatcgatcggcctgctgttctcctacgtcgccaaggcggccggcgcgcggcgggtcaccggagtggacccgatcgaccgccgcgacgtggcaagggcgttcggcgtcgacgacccggtgcgcgccaccagcgaccgctgggtcagccagctcgaccccgccgaccgcgccgacgtcgtcatcgagaccgtcggccaccaggtcgccaccctggcgcacgccatcgacgccgccgcccccggcggcaccgtgttctacttcggtgtggccgacgacgacacctacccgatcagcatgcggaccatgctgcgcaacaacctcaccctgaaatccggtgtgacactggaccggcggcgaatgctggagctggccggcaagttcgccgccgagcatccctggctgctgggcgcctacctgacccacacgttcggcgtcgacgaggtgcaggacgccttcgagctggcctgccggccggtcgccgaccggatcaagatcgcgatcgccgggtgagtggccgaccgtgaccgcgccgagcaacctgcggctggccctgaaccggcggtccccgatattcggcggctgggtcaccggcccgacactgctggggccggaggaattcgcccgcgccggttacgattacgtcggcttcgacgcccagcacggctatctggacgacgccgacatcgccggcgtgctgcgccgcatcgaacacctgccgatcggcaccgtggtgcgcctgcccaacgccgacgccgcaccgatcgggcgggtggccgacgccggggccgacgccgtcatcatcgcgatgatcgagtcgcccgaccaggccgcggccgcggtggccgccacccgctacccgccggcgggcgtgcgcagcttcggcccgctgcgcgccagcctgggccatgatccggcggcccacgagtcgcgggtgagcgtgttcgcgatgatcgagaccgcggcggcgctgtccggcatcacccagatctgcgccgtcgacgggctgaccggaatctacgtcggccccgccgatctggccatctcgctgggcgccggcgtgatcggcgcgacccggcagccggaagtgctcgacgcgatcgtgcacatccacaaggcggccaccaaggccggcctggtcaccggcatccacgccggggacggcagcacgggacatgccatggcgcagttgggattcgacatgatcacgctggccgccgaggcacaggcactgcgccgcggcgccgccgaacacctgcgtgaggcgacgcaatgaccggcggatcggcccagccgccgcgggtggcgctggtgaccggcgcggccggcggtcagggccgggccatcgccgaacggctgcgcggcaacgggtatgcggtggccgcgtgtgatcggcgcatcgacgaactggccgccacggtggctgcatcgggcgacgaccggctgatcgcggtcgagctcgacgtcacctccgagcaacaatggcgctcggccgtcgaacgcgtggtggaccgcttcggtgcgctgagcgcgctggtgaactgcgccggcgtgctgcaccgcaccccgctgccgcaggagaccgccgacgccttcgaaaacgcctggcgggtcaactgtttcggtgccttcctaggcatgcgcgcggcgctggaacggctccgcgggacacccggcgcgtcgatcgtcaacatctgcagcaccggtgcgatccacccgttcccgcagcactgcgcctacggctcgtcgaaatgggcgctgcgcggcctgacccaaaccgccgccgccgaactcgccccggccggtatccgggtcaacgcggtgttccccggcccgatcgccacaccgatgctcgaccaggccacccagacccggctggccgcggccgcgtccttcgggcggatcgggcagccccgtgaggtcgccgacgcggtggcgttcctggtgtccgccgaggcgtcgttcatcaccggcgccgaactcatcgtcgatggcgggcaatgcctgcagatccgatgagcgagctgtcgatcggcatcatcggcgccggtccgggcggcctggcgctgggaatcctgctgtcgcaggccgggtttggtgacttcaccatcttcgaccgggaagacggcgtgggcggcacctggcggatcaacacctacccgggcctggcctgcgacgtcaaatcccacctgtactcgtactcgttcgacctgaacgcgcactggtcgcggctgtggtcgggacagcccgagatcctggactacttccagcgctgcgcggacaaatacgggctggggccacatctgcggctgggcaccgaaatccgctccgcccactgggatgccgacacgcaacggtggcggctgaccaccgcgtccggccaccggcaccacttcgacgtggtggtctcggccgtcggcctgttcacccgcccgctgcttcccgagctggtcgaggaggagccgttcaccgggacggtgatgcactcggcgcgctgggaccactcgattccgttgcacggcaaacggatcgccgtgctgggcaccgggtccaccgcctcccagctgattccggaattggccaaggtggccgagcgggtgtattcggtgcagcggtcgccgacctggatcctgcccaagcccgaccggccctacacgcagtgggagcgttgggcgttcgcgcacctgccgttggcgaagaagctctaccggaccaggttgtggctgcgcagcgaatccaacatctcggtgatcgagcacggcagcgagaagaccgggcaattcaccaacatcgcgctgggactgctggaggcgagcgtccccgacgaggaactgcgccgcaagctcacgcccgatcatccgatgggctgcaaacggctggtgttctcctcggactacctgcccgcgctgacccggcccaacgtcgaggtgctgaccagccccgcgcgctccctgcgccggcggtcgctggtcaccgaggacggcaccgagcgcgaggtcgacctggtggtctgcgccaccggctacgccgccgccgactatctcggcgaactcgacgtgaccggcgagcgcggggtcacgctgcgcgaggtgtggcgcgacggcgcctacgcctacctcggcatggccgtaccgggattcccgaacttcttcatgctgtacggacccaacaccaacgtcggctccaacagcgtcatcttcgtcctggaggcccaggcccgctacatcgtgcgggccctgaagtatctgcgccgccaccgccgccgctacatcgcggtgcggcccgccgcgctggccgacttcgtcgccaagatcgaccgatggatggtcggcaccgtctggaccacccagtgcagcaactactttcgcgcccccaacggccgcgtcgtcacccagtggccgcgcagcgcacgcgccttctggtcgatgacgcgccggttcaggccggccgactaccggttccaggcgccggcgatgcgcgtcccggccccggcctccgaggcggacgcgcggtgacggcgctggacggcgccgagcgcctcgacccggcgctgcgcgcggtcgccaccacccggaccgacttctcgcccgccgcaatcgaactcacccgggcgccgttcaacgagcgccgccggctggccgccgcgcagaccgacaccgccggcgtgcggatcgtcgacgacgacgcgaacggcgtcggcgtgcgcatctatcgcggcgggcccgaaccggcgcccgccgtgatctactgccacgccggcggattcgcgctgggcaacctggacaccgaccaccgccagtgcgtggagctggcccggcgcggccgctgcacggtggtgtcggtcgactaccggctggcccccgagcacccctacccggccgcgctgcaggacgcgggcacggtgttgcggtgggtgcacgccgaagccgccgccctcggcgtggacccggcccggctcgccgtcgcgggcagcagtgccggcgccgccctggccgcctgcctggcgcaccccgacgggtcgttgccggccgtggtgttccagctgctgcaccagccggtgctcgacgaccgggccaccgggtcgaaggcgcggttccggaccagcccggccttcgacggcgaggccgccgagctgatgtggcgctactacctgggcccgaccgtcgggtccgcggccgccgtacccgcgcggcggcccgaattagccgggctgccaccggctttgatcacctgcgccgagatcgacccgttccgcgacgaggccatcgactacgcccggcggctactggacgccggggtctgcaccgagctgcacgtgttcgctcgtgcctgccacggcttcgactcgctgctgccggactggccgggctcgcagcgattgttcgcgctgcagggcgaggtgctgtcggcggcgttgcaccgcgattaggcgtcgaaccggatcagctggcgcaccgcggtgccgtcggccagatgatccatcgcctcgttgatgtcttccagccggatcgtggacgacaccagcgattccaccggcagccggcccgcgcgccacagctcgacgaaccgggggatgtcccggctcggcaccgccgaaccgaggtagctgccgatcagcgaccggccctcggccacaaaacccaacggcgacaacgtgatccgcgcgtccggcggcggcaggccgacggtgatggtgcgcccgccgggggccgtcaggtcgatcgcagtctgcagcgcggcgggatggccgacggcttcgatcaccaccgccgccttcacccgcgcctcgacggcctgctgcggcgtgtacgcctggtgcgcgcccaaccgccgggccgcggccagcttctccggcagctggtcgacggcgaccaccggaacgccgtcgtaggtgagcgcggtcagaagcgccgccatcccgacgccgcccagcccgacgacggcgaccgtctggcccggcgcggggcggcccacgttgaacaccgcgccgccgccggtcagcaccgcgcagccgagcagcgcggcaacctcggccggcacgtcgggcggcacctcgaccgcgctggcccgattgaccaccgcgtgcgtggcgaaccccgagaccccgaggtggtgatacaccggccggccggcccggctgagccgaatatcgccgcccagcagcgtgccggccccgttggccgcgctgcccggttcacacggcgtcaggccctcggtcgcgcacgccgcgcaccggccgcagcgcggcaggaacaccagcaccacccgggcgcccacggccaggtcggcgaccccgggaccgacccgctcgacgatcccggccgcctcgtgaccgagcagcatcggcaccgggcgcacccggttgccgtcgaccaccgacaggtcggaatggcagatgccggccgcctcgatgcggaccaagacctcgtcgcgccccgggggcgccaactccacgtcggtgatggtgatcggtcgcgagcgcgcatagggccggggcgccccgatgcgctgcagcaccgccccccgaattccggacatgctggaatacaaccatggcgtcggctcccgtagttccccccgccccggaggggttgaccagcaacgacttcccggtgctgtggccggtgggcacccggtgggccgacaacgacatgttcggccacctcaacaacgcggtctactaccaactgttcgacaccgccatcaacgcctggatcaacaccagcaccgggctggacccgctcaccacgcccgcgctgggcatcgtcgccgagtcgggctgccggtacctctccgaactgcacttccccgagggcctgcaggtggggctggccgtcacccggctgggccgcagcagcgtcacctaccggctgggcgtgttccggtccgcggcgccgggcagcgccgagcccatcaccgcgctggggcattgggtgcacgtctacgtcgaccgggacacccgcaagccggtgcccattcccgacccgatccggaccctgctggcgggcgccgccgtcggggacgccgcaccgaaatagcgcccggcgctgggactttcgcgtgccccgttatgcttcgcgcatgcccgttttgagcaagaccgtcgaggtcaacaccgacgccgccgcgatcatggccatcgtcgccgatttcgagcggtacccggagtggagtgacggggtcacgggctgctgggtgctggcccgctacgacgacggccgccccagccagttgcggctggacgccgcctaccagggcttcgagggcgtctacatccaggccgtctactacccggggccgaaccagatccagaccgtcatgcagcagggggagctgttcaagaagcaggagcagctgttcagcgtggtggagatgggcgcctcgagcctgctgacggtggacatcgacgtcgagccgtcgatgccggttcccgcgccgatggtgaagtcgatgctgaacaacgtgctcgaccacctggccgacaacctcaagcagcgcgccgagcagctggccgcgaactaaccccggttgctcggcgtgccggtgcggtcgcgcatctcggtcagccgcgccgccgcgtcggtgaactgccagaccgtgtgctcgatcaccgcggcggtgtcgcggcggcgcagcgcggcgatcagttgccggtggttgtcgacggcggcccgcccccactgcgggtcggcggcgtacaccagcaccggcatgtagcgggcggcgttgagcaggaaccaggccagcttgatccggccgctggcctggttgaagacccggtggaagccgaactcgaggccggcgatggtctcggcgtcgccggacccgacggccgcggcgagcgcgtcgttgatgcgatccagctcgtcgatctcggtgtcggtgatgtggtcggtggccgcggcggccagctccttggcgatggtcgcctgcagccagaagatgtcctcgatgtcttggcgggtgagcggcagcaccacgtgaccgcggtgcggttcgagctgcaccatgccctcgccgcgcagcttcagcagggcctcgcgcaccggcgtgacgctgacgccgagctcggccgcggtctcgtcgagccggatgaaggtgcccggccgcagcgcgccggacatgatcgcggcccgcaggtgccccgcgacctcgtcggacaactgggcccggcgcagcggccgccgccggctcctcggctgcatggacatcggtgcgttcacggggcttgccagggctttcagtggcttagcgggacggggtttacgttttgaccggtgtcgacgggggcttgtcagtagaccgtcaacgccataatgtgacccacacaacactaagttttatcaaacctggcgcaagcggtgcgcgagtgaagggaagggaagtgttgagtttgaccgcccaattggcacaccatccgactcaggcgaacgagcagccgtacctgtcccgccggcagaactgggtgaaccagctggaacggcacgcgctgatgcagccgaacgcgacggcgctgcggttcctcggcaagggtctgacgtggggggagttgcacggccgggtgcgggcgctggccgacgcgctgagccggcgggggtcggcttcggcgaccgggtgatggtcctgatgctcaaccgccccgagttcatggagtcggtgctggcgatcaacatgctcggggccatcgcggtgccgctgaacttccggctcaccgcggccgaaatcgccttcctggtgcaggattgccaggcgcgggtggtcatcaccgaggccgtgctcgccccggtggccaccggggtgcgcgacatcgagtcgctgctcgacaccgtcgtggtggccggcggctcctccgacgacaccgtgctgggctatgaagacctgatcgacgagaccggggcggcgcaccaacccgtcgacatcccgaacgacgcggcggcgctgatcatgtacacctcgggcaccaccggccggccgaagggcgccgtgctcacccacaccaatctgaccggccagacaatgaccgggctgtacaccaacggcgccgacatcaacaacgacgtcgggttcatcggggtgccgttctttcacatcgccggcattggcaacatgctgaccgggctgctgctcggcatccccaccgtgatctatccgctcggcgcgttcgagcccgggcaactgctcgacgtgctggccgcggagaaggtcaccgggatcttcctggtacccgcgcaatggcaggcggtgtgcgccgaacagagggcacggccgcgcgacctgaagctgcgggtgatctcctggggggccgcaccggcgccggacgccctgctgcgcgagatgtcggcgatgttccccggcacccagattctggccgcgttcggccagaccgagatgtcgccggtcacctgcatgctgctcggcgaggacgccatccgtaagcgcggctcggtcggcaaggtcatccccaccgtggcggcccgggtggtcgacgaaaacatgaacgacgtgcccgtcggcgaggtcggcgaaatcgtctatcgcgcaccgactttgatgagcggctactggaacaacccggaggccaccgcggaagcgttcgcgggcggctggtttcactccggcgacctggtgcgcatggacgaggacggctacgtctgggtggtcgaccgcaagaaggacatgatcatctccggcggcgagaacatctactgcgccgaggtggagaacgtgctggccagccaccccgacatcgtcgaggtcgccgtcatcggccgggcgcacgagaagtggggcgaggtgcccatcgcggtcgccgctgtcgcgaacgacaatttggcgctcgaagatctcgacgagttcctgaccgaacggttggcgcgctacaagcacccgaaggcgctcgagatcgtcgacgcgctgccgcgcaaccctgccggcaaggtgctcaagactgagctgcggatccgctacggaggcggatgaatcggctaaatccattccggggcaagaggttctgggaccagaaaggaaagttgacggacgctgtaacgtttgcccgttgttgacgaagggttaattgtgcggatgcggttcacacgtgattggccatcgggtacattcctgtggtctccgttactacttgccagtagggagccgatggtcacacacgttgagtcggggcgaggtgggggcacccccagccgcgtagcggtgagggagacaggcgtgctagacgatgtgccgcgccaccaggcgcgcggagacggccggagggggcagcggtgacttcaacgtcgacaagtcgacggggtccctacttggtgggctatctgcgcgaccagttggagaccccgctgacccttgtcggtggcttcttccggatgtgcgtgctcaccgggaaagcgttgttccgctggccgttccagtggcgcgagttcgtcctgcagtgctggttcatcatgcgggtggcgttcctgcccaccatcatggtgtcgatcccgttgaccgtgctgctgatcttcaccctcaacgtgctgctcgcccagttcggggcggccgacctgtccggcgccggcgcggccatcggcgccgtcacccagctcggcccgctgaccaccgtgctggtggtcgccggcgccgggtcgacggcgatctgcgcggacctgggggcgcgcaccatccgtgaagagatcgacgcgatggaggtgctcggcatcgacccgatccaccggctggtggtgccccgggtgatcgccgcgaccctggtcgccaccctgctcaacggcctggtgatcaccgtcggcctggtcgggggctacctgttcggggtctacctgcagaacgtgtcgggtggtgcgtacctggccaccctgaccaccatcaccggcctgcccgaggtggtcatcgcgacggtcaaggccgccgtcttcggcctgatcgcggggctggtcgggtgcttccgcgggctgaccgtgcgcggcggctccaaggggctcggcaccgccgtcaacgagaccgtggtgctgtgcgtggtcgccctgtacgcggtcaacgtggtgctgaccacgatcggtgtgcgattcgggacggggcactgacatgtcaaccgccgccgtctttcgctcgcgcttcccgcgggcggccgagaacctcaaccgctacggcctggccgccgcccgcggcctcgacgaacgtcggccagatggcctggttcggtgggggtggccctcgcgcacatcccgcacgcgctgagccactaccgcaaggagaccctgcggctgatcgcccagatcggcatgggcaccggtgccatggccgtcatcggcggcaccgtcgccatcgtcggcttcgtcaccctctcgggtagctcgctggtcgccatccagggtttcgcctcgctgggcaacatcggtgtggaggcgttcaccggcttcttcgccgccctgatcaacgtgcgcatcgccgcccccgtcgtcaccggcatcgcgatggccgccacggtcggcgccggcgccaccgcggagctgggcgccatgcgcatcagcgaggagatcgacgccctggaagtgatgggcatcaagtcgatttcgttcctggcgaccacccggatcatggccgggctggtggtgatcatcccgctctacgcgctggcgatgatcatgtcgttcctgtccccgcagatcaccacgaccgtgctctacggccaatccaacggcacctacgagcactacttccgcacgttcctgcggcccgacgacgtgttctggtcgttcctggaagccatcatcatcaccgcggtggtgatgatcacccactgcttctacggctacaacgccggcggcgggccggtcggcgtcggtgaggccgtcggtcgatcgatgcggttctccctggtctcggtgcaggtcgtcgtgctggccgccgcgttggcgctctacggcgtcaaccccaacttcgcgctcacggtgtaaccgccatggcccgacccgtccagaccaacgccccgcggaccccgccgtacaagctggccgggctggcgatcctggtcgtcggcgccctggccctggcgctgatctacggccagttccgcggcaacttcacccccaagaccagcctgacgatgctggcgtcgcgggccgggctggtgatggatcccgggtcgaaggtgacctacaacggcgtcgagatcggccgggtgggcacgatctcggagacggtgcgcgacggaaagccggcggcgaaattcaccctcgaggtgtatccgcggtatctcaagctgatcccgtcgaacgtgaacgccgacatcaaggcgacgacggtgttcggcggcaagtacgtgtcgctgacgacgccggccaacccgtcaccgcagaagatcaccccgcacaccatcatcgacgcccgctcggtcaccaccgagatcaatacgttgtttcagacgatcacctcgatcgcggagaaggtggatccggtcaagctgaatctgacgttgagcgcggccgcgcagtcgttgtcgggtctgggcgagaagttcggccagtcagtggtcaacgcgaatgctttgctcgatgacgtgaacccgcggatgccgcaggcgcgcaaggacattcaggggttggcggcgttgggcgacacctatgcggacgcctcgccggacctgttcgattttctgaacaatgcggtgatcacctcgcgcacgatcaacgcccagcagaaggatctggaccaggcgctgttgtcggcggccgggttcggcaacaccggcgccgacctcttcaacaagggcgggccgtatctggcgcgcggcgcccacgacctggtgcccaccgcccaactgctggacacctacagccccgagatctactgcctgatgcgcaacgaacacgacgcgctgcccgccaccggcgcggccgagggcggtttcaacggctactcactcaacatgaacaccgaggcgctctccgggctgggcctcatcgcgaacccggtgtccgcggtgcccgtcatcgcctcaatggtgggcgggatcgtcggcgtggtcggcggcgcgcccaacccctacatctatcccgagaacctgccccgggtgaacgcccgcggcgggccgggaggcgcgcccggatgctggcagccgatcacccacgacctgtggccggcacccgagctcgtgatcgactccggcaacagcctcgcgccgtacaaccacctggacaccggatcgccgtacgcgatcgagtacgtctggggccgccaggtaggggataacacgatcaacccatgaaaatcaccggaaccctcgtcagactcagcatcttctcggtggtgctgctgatcttcaccgtgatgatcatcgtggtgttcggtcagatgcgcttcgaccgcaccaacgggtactcggcggagttcagcaacatcagcgggctgcgcgccggccagttcgtccgcgcctcgggggtcgaggtcggcaaggtcagttcggtgcagctggtcgacggcggcaagcgggcccgggtggaattcaacgtcgaccgctcggtgccgctgtaccagtcgacgacggcgcagatccgctacctcgacctgatcggcaaccggtacctggagctcaagcgcggtcagggcgaaggcgcggacaaggtgctgccgcccggcgggttcatcccgctgtcgcggacccagcccgcgctcgacctcgacgcgctgatcggtggtttcaagccgctgttccgggcgctggacccgcagaaggtcaacaccatcgccaccgcgctggtcaccgtgttccagggccagggcggcaccatcaacgacatcctcgaccagaccgcgcagctgaccagccagctcggcgagcgcgaccaggcgatcggcgaggtgatcaagaacctgaacaccgtgctggacaccaccgtccggcaccgccagcagttcgaccagacgatcaacaacctggaggtgttgatcaccgggctcaaggaccacggcgaccagctggccggcgggaccgcgcatatcagcaacgccgccggcaccgtcgccgacctgctcgccgaggaccgctcgctgctgcacaagacgctgaactacctcgacgccgtgcagcagccgctgatcgaccagcaggaccagctgcaggactacctcaagaaggtgccgaccgcgttgaacatgattgggcgcgccatcggatcctacggggacttcgtgaacttctacgcctgcgacatcacgctcaagatcaacggcctgcaggccggtggcccggtccgcacggtccggctgttccagcagccgacgggtaggtgcacaccgcaatgagaacactcgaaccccccaaccgggtccgcatcggcctgatgggcatcgtggtgacggtgctggtgatcggcgtcggccagagtttcaccagcgtcccgatgctgttcgccaagcccagctactacggccagttcaccgactccggcggcatcaacaccggcgacaaggtgcgcatcgccggcatggacgtcggcaaggtggagggcctcaagatcgacggcgaccacatcgtggtgaagttctccatcggcaccaacacgatcggcaccgagagccggctggcgatcaagaccgacaccatcctcggcaagaagatcctcgacgtcgaggcccgcggcagccagcagttgcgacccgggtcgacgctgccgctgggccagagcaccacgccgtaccagatttacgacgcgttcttcgacgtcaccaaggccgcccagggctgggacatcgagaccgtcaagcagtcgctgcacgtgctgtcgcagaccatcgaccagacctacccgcacctgagctcggcgctcgacggggtggccaagttctccgacaccatcggcaagcgcgacgaacaggtcaagcatctgctggcccaggccaaccaggtggccagcgtgctgggtgatcgcagcgaccagatcgaccggttgctggtcaacaccaagacgctgctggccgccttcaacgaacgcgggcaggccatcaacgccctgctgggcaacatcgccgcgttctccgaacaggtcaagggcctgatcaacgacaaccccaacctcaaccacgtgctggagcagctgcgcacggtcagcgacatcctggtgcagcgcaaggacgacctggccaacgggttgaccgaggtcggcaagttcctgccgtcgctgaacgaggccatcgcgtcgggcccgttcttcaaggtggtcctgcacaaccttgccctgtaccagatctcgcagccgtgggtggatgccgcgttcaagaagcgcggcatcgacccggaggacttctggcgcagcgccgggttgccggcctaccggttccccgaccccaacggcacccggttccccaacggcgcgccgccgccggcgccgccggtgctcgagggcaccccggaccacccgggcccggccgtgccgccggggtcgccctgctcgtacacgccggcggccgacgggctgccccgccccgacaacccgctgccctgcgcgggtgcggtgacgggcccgttcggcgggccgggcttcccggcgccggtcgacgtgatgacgtcgccgcccaaccccgccggcctgccgcccacgccgggcatcccgatcgcgggccggcccggcgacgcaccgccggacgttccgggcacgccggtgccgctgccgacgcaggcgccgccgggcgcgcggaccgagaacctcgcaccggccggaccggtgccgccgccgtcgacgttcgcgccgggggctgccgccgggtccgccggcaccccccgggccgggcaaccagttgccggcgccgttcatcaaccccggcgggaccggaggcagcggcgcagcggggggaggtagccagaattgagcaccatctttgacatccgcaacatccggctgccgaagctgtcccggacgtcggtgatcctcgggtcgttggtgatcgtgctggcgctggtcgtcggctacgtcggttggcggctgtacgagaagctgaccaacaacaccgtggtggcctacttcccggccgccaacgccctctacccgggtgacaaggtccagatcatgggcctgcgggtgggcgcgatcgacaagatcgagccgtccggcgacaagatgaaggtcaccttccactaccagaacaagtaccgggtgccggccaacgcgtcggcggtgatcctcaacccgaccctggtggcgtcgcgggccattcagctggagccgccgtacaagggcggacccgtgctggccgacaacgcggtgatccccgaggagcgcacccaggtgccggtggagtgggaccagctgcgcaacagcatcaccaacatcatctcgaagctgggtcccacggccgagcagcccaagggcccgttcggtgaggtcatcgagtcgttcgcggacgggctggccggcaagggcaagcagttcaacacgacgctgaccaacctgtcgcgggcattgaccgcgctgaacgaggggcgcggcgacttcttcgcggtggtgcgcagcctggcgctgttcgtcaacgcgctgcaccaggacgaccagcagttcgtcgcgctcaaccagaacctggccgacttcaccacccggctggcgcattccgacggcgacctggccaacgcgatcgagcagttcgacagcctgctgaccaccgtgcgcccgtggctggacaagaaccgcggggtgctgacctacgacgtcaagaacctggagacggcgaccaacgcgctgctgcaaccggacccgctgaacgggctggagaccgcgctgcacgtgctgccgacggccgcggccaacatcaaccagatctatcacccgtcgcacgggtcggtggtcgccattccgtcgatcaccaacttcgccaacccgatgcagttcatctgcagcgcgatccaggccggcagccggttgggctaccaggagtcggcggaactgtgcgcgcagtacctggcgccgatcctcgacgcgatcaagttcaactacccgccgttcgggttgaacctgttctccaccgccgagacgctgcccaaggaagtcgcctactccgagccgcggctgcagccgcccaacggttacaaggacaccaccgtgccgggtatctgggtgccggacaccccgacgtcgcaccgcaacacccagccgggctggatcgtcgccccgggcatgcagggccagcaggtcgggccgatcaccgcgggcctgatgacgcccgactcgctggaagagctcatgggaggacccaacatcgcccccgtccagtcgaatctgcagaccccgccgggtccgccgaacgcctacgacgagaatccgatcctgccgcccatgggtctgaacgccccggtgccgatcccgccgccaccgcccgggccgggcgtggccccgggcccggtggcgccgacgccggcgccggtgtcggcccccgcacccaacgcgggcggtccggcggccccggctgacttcggaggtggccagtgaggcgcgcgacgagcgccatgggcgcgaggagcaagccgaaccgtcggcccctgaggggcgcgacgagcgccatgggcgcgcttcgggtgatccggcgccggtcctggcaggggctgacgctgctggtggccgcgatggtgctgacgtcctgtggctggaaaggcatttcgaacgtctccatcccgggcggtcccggcagcgggcccaactcctacaacatctacgtgcaggtgcccgacaccctggccatcaacggcaacagcaaggtgatggtcgccgacgtgttcgtcggctcgatcaaggccatccagctgaagaactggatcgccacgctgacgctgggcatcaataagaacgtcaagctgcccaagaacgccaccgccaagatcggccagacctcgctgctgggttctcagcacgtcgaactcgccgcgccgcccaacccgtcgcccgagctgctcaaggacggcgacaccattccgctgaagaactcgtcgtcctacccgaccaccgagcagacgctggccagcctgtcgctgatcctgcgcggcggcggcatccccaacctggaggtgctgcagaacgaggtctacaacatcttcaacgggcgcggcgaggcgatccgggcgctgctgggcaagctggacaccttcaccaaccagctcaaccagcagcgcgacgacatcacccacgccatcgactccaccaaccggctgctcacctacgtgggtggccgcgcggacgtggtggaccggctgctcaccgacgtgccgccgctgatcaagcatttcgccgacaccaagcagctgctgatcaacgccgtcgactcggtgggacggctgagccaggccgccgaccagtacctgtcggaggcgcgcgggccgctgcacaccgacctgcaggcgctgcagtgcccgctcaaggagctcggcaaggcctcgccgtacctgatcggcgcgctgaagctgatcctgacccagccgttcgacatcgacaccgtgccgaagatcttccgcggcgactacatcaacatctcgctgacgctggacctgacctacagcgccgtcgacaacgcgttcctcaccgggaccgggttgtcgggagccctgcgggcgctggagcagtcctacggccgtgaccccgagacgatgatcccggacgtgcgctacacgccgaacccgaacgacgcgccgggtggcccgctggtggaaaggggggaccggaattgctgactcccttcgtccgacgccaactggtcgccttcgggatcctgaccgtcatctcgctgctcgtgctcggcatctactacctgcagatcccgagcctggtggggatcggccggtacacgctcaaggccgagctgccggcgtcgggcggcctgtacccgacggccaacgtcacctatcgcggcatcaccatcggcaaggtcaccgacgtcgagcccaccgagcacggcgccgaggcgaccatgagcatcgacagccactacaagatcccgatcgacgcggtggccaacgtgcactcggtgtcggcggtcggtgagcagtacctggacctggtgtcgagcggaaaccccggcaagtacctgtcgtccgggcagaccatcaccaagggcacggtgccggccgagatcgggccggccctggacaccgcgaaccgcgggctggcggtgctgcccaaggagaagatcggccagttgctcgacgagacggcgcagtccgtcggcgggttgggccccaacctgcagcggctggtcgacgccacccaggccatcgtcggcgacttcaagaaccagatcactgacgtcaacgacatcatcgagcactccgggccgggtgatcgacagccaggtcaaatccggtgacgccatcgagcgctgggcgcgcaacctgaaccggctgggcgcccagtccgcgcaggaggactcgcacctgaaaagcctgctgcgccaggcggcgccgacggccgaccaggtcaacgacgtcttcaacgacgtgcgggaatcgctgccgcagacgctggccaacctcgaggtggtcatcgacctgctcaagcgctaccacaccggtgtcgagcaggtgctggtgttcctgccgcagggcgcatcgatcgcccagacggtggccgcaccgttccccaatatggccgcgctggacctggcgttgtcgatcaaccagccgccgccgtgcctgaccgggttcatcccggcctcggagtggcgctccccggcggacaccagcctccagccgctgcccacgggcacctactgcaagatcccgatggacaccccggccaacagcgtgcgcgggtcgcgcaacatcccgtgcaccgacatcccgggcaaacgcgccgccaccccgcgggaatgccgcgaccccaagccctacgtgccggccggcaccaacccctggtacggcgaccccaaccagatcctgacctgccccgcgccggccgcgcgctgcgaccagccggtcaagcccggcatggtgatcccggcgccgtcggtggacaacgggttgaacccggcgccctcggaccgggtggccggcacacccccgccggtcagcgacccgttgtcgcggccggggtcgggtacggtgcagtgcaacggccagcagcccaacccgtgtgtctacaagcccagcgggccgcccaccgcggtctacagtccccaaagcggtgaactggtggggccggacggggtgaaatactccgtcgagaactcgaccagaacaggagacgacggatggaaggagatgctggcgccagccggctgaaccccatcgacacggacgacgattcgttgagcccccaggacaaggacgaggattcgacggcacccgcaagcaccgacgagcagaccggttcgcagggtgctcccggggtggcgggggaatccgcacccgatgccgccgacgacgccgccgttgcggccgttccgcgcggcccctcccggctggggcgcgggtggctggccgccatcgccgcggtgctggtgctgtgcgccgccggcatcggcgcgggcggctacctggcgctgcgctaccaccacgaaagccaggtgatcgcccgcaacaacgccgccgcgctgaaggcggcggtggactgcgtcgaggccacccaggcgccggacaccaacgccatgaccgccagcgagcagaagatcatcgactgcggcacggacgcttaccgctcgcaggcgctgctgtacaccagcatgctggtgcaggcgtaccagtccgcgaacattcacgtccaggtgtccgacgtgcgggccgcggtcgagcgcaacaaccccgacggttcgatcgacatcctggtcgcgctgcgggtcaaggtggccagcgaccagtcgcagaacgaatccggctaccggctgcgggtgaaaatggccctcgccgaagggcagtacaagatctccaagctcgaccaggtgacgaagtgacggtgctggtcgaacagaccgcgaccacgggcacgccggaaccagtgcgagaagccttggcgccctggcactctcgcgtcggcgccttcgccatcgacgtggcaccgggcgccgccgtcatcgccaccatggcgctggtgtccttcacggtgccggcccgcggcgtgtggtggtgggtgggcgtctgcatgctgggcgtcgtcacgctgctggcactggtcaaccggctgctgctgccggtgatcaccgggtggagcctgggccgcgcgctggccggcatcgcggtgacccgccgcacggacgcggccccggggccgtggcggctgctgctgcgcgacctggcgcacctgctcgacaccgcgtcgatcgtgggatggctttggccgctgtgggattcacgccgccgcacgttcgccgacatgctggccggcaccgaagtgcggcgcttggcgccggagcaggtgccgccgcacatcagccgctgggccgcggccgcggtgctgggcgcggcggcggtgtgcctgggcggtgccgcgatgagttacggcgtggtgtactccgcggatcgggccgccgatcagacccgcgcgcagatcgccacccaggggccgaaaatcgtggcccagatgctgacgtatgacccgaagtcgctgcacgacgacttcgcccgggcccagtcgctggccactgacaggtatcggcgccagctccagacccagcaggacgtggtgcagaagggcaacccggtgatcaacgaatactgggtgaccaatagctcgatcgagtccgcgagccgcgaccgtgcgaccatgttgctgttcatgcaaggccgccgtggcgccgcacccgaggtgcgctacatcagcgccaccgtgcgggtgagcttcgccaaggttggcgaaaacacttggcgggtcgacgatctcaccgtcctgaccaagccgaaaccgccgggcggggcgaaatgagtccgcgccgcaagttcgcgcccggcgagcggccactgctcgtcgcgcgcccggtccggccgccgcgaggatggctgctgccgctcgccggcacggccgccgcgctgctcatggtcacggcggtcacgctctgcgcgctgatgctggtctcgcacgaatcccgggagcgggcggcgtcgaaggaccgcgaggtgctcagctacgtcagcggcttcatgacccaattcacctccatcgatccctttcacgccaacgattacgtgaatcggatcctggcccaggcgaccggcgacttcgccaagcaatacgagaagaacgccaacgagatcctgctccaggtcgcccgcgccgaaccggccaccggcaccgtcctggacgccggactggaacggtggaacgacgacggcagcgccaatgtcatggtggccacggcaatcaccaccaagtcgccggatgagaaacaggtgttggagaacaccaaccgttgggcggcaaccgccacgcaggaagggaaccagtggaagatcagcagcctccagcaggtgatctgaccgccgaggagaacccggcggccgccgaccagaatgaggcgacggttgcggcagcgggcgacgatcgggaaaacggtgacgcggcaacggaatccgaggcggccgagacctcggacgcccaaccggccgacggcgccgaggacacccagtccgccgagaccgtcgcgaccgccggtgccgcgccggccgccggtcgccgcaccaagcggctggcggggaaggcctgggccgtcgccgccatggtcgccgcgctgctcttcgtcggctcggccgggttcgccggcgcgatggtgcagccctacctggccgaccgcgccgtcgccgcgacgaaactgaaggtggcgcggaccgcggccaacgcgatcaccacgctgtggacctacacgccggaaaacatggacaccctggccgatcgcgcatccgcctacctcagcggcgatttcgaagcgcagtaccgcaaattcgtcgacgccatcgtcgcaccgaacaaacaggccaagatcaccaaccacaccgacgtcaccggcgcggccgtcgaatcgctcgacgacaccaacgcggtggtcatcgtctacaccaacaccacatccaccagtccgctgaccaagaacgtgccgtcgctgaaatacctgtcctaccggttgttcatgaagcgcgccaagagccgctggctggtcaccaggatgacgaccatcacctcgctggacctgaccccgaaggtctgacccggcgcaccgaaacaggctgcagcccatggccgttacctccccggtatcgaagcggtggacggtggcggcgctgctgttgctgaccttcgcgaccggactggccgacgcgatcagcatcctggtgctcggtcacgtcttcgtcgccaacatgaccggcaacgtgatcttcctggggttctggctggcgccgcggaccagcatcgacctgaccgcggtcgtggtggcgctgcccaccttcgcctgcaccaccatcctcagcggccggctggcacggcatttcggcgagcgggtccgggcgtggatcagcacggtgctggcgaccgagatcgtgttactggtgggactgtcggtgctggcggggtcgggaatcctgggctaccaacaggattcgaagctcctgatgatcgccatcctcgccgtgacgttcggtctgcagcactccagtgcgcggcagttcgggatccaggagttgtccaccacggtgttgacgtcgacgatcgtcagcctcggcctggacagtcgcctggccggcggtaccggcgaacggcagcggctgcggatcggcgtcgtcgccacgatgtgcgccggcgcgttcctgggcgcgacgatgtcccggtatgtggtcgcgccggtgttcgtggtcgccgcggcggtgatcgccgccagcctgctgatcttccggttcggcccgcccgcggccaaacccgctgcagcggaagctaattgaaggccagccagctgggcagcgcccgctcatgcgagtcgcagagcacctggcgggtgtcgcacgatccccgcggcgagccggcgccggcccacatcccgccggtgtcgcggcgcagcacgatcgccgacgagccaccgccgtcgagcagcacggcgttgtcgctgcccaggccgcggaacaggtcctgcatgttgtccggggtgtagctgccgccctcgaagatgtacatctcgtccttctgccgggcgtagccgatcgcggtgcgcgccgcgctcggcccgccgtcgtgcagctgcccggtgttgccgggtgccagcaggccgatgccggagaccgcgacgaacttctcgttcttgttcagcaggtcggcgacgacgggagtggcggcgtcgtagtcgcttttggtcttgggccacaccacatatggcgccccgccggacggaaggatcatcgtggtcagcgcgctccagctctccccgccgccggacaggccctgcttgccgggataggcgacggtgccggtgaccgcctggttggcacggccgcggccgttggtgttgtccacgaaggcgcccagcggcgagctgcagccggtctggcgccaggagccgcccttctgcgggcgcacgtcgaagaagttggcgttgatcgcgatcgtcggctggcccatccgctgccacgcctgcagcggggcgtagagctcggaggcctgccacaggccctcggcggtgcgggcgccggggttgttctcgcagcgggcctggtcgccctggtgggtgtcgaccagcaggtgcggcgaaagccgtcccgccgcgttcttgatgatcatcaggtgcccgccgttgttcatctcataccagctgccgccggcgttgagcatcggcgccggatggccggggccgaagttgtagaccaggtaggagccgcgggtgctgctgatcgcgttggccagcaggtcgcggccgtcagcggcccgggccagcggctgcccggaggtgacggccagggtgaggcaggcggacagggcggtgcagcacgccgccagccggcggaagctggcgcgtcgggtcagcacgatagccctttcggccatgaagtgaatgcaacgcacacatcatccgccccacaagtcacgctgtcaacataagtaacgggtcggtgacgttccgggcacgtccgaattacgtttgcgcgcttgggctttcaggttcgtcggggctctccggctcggtcggggtctccggctcggcggggctgtccggctgctgagtggacttgccgcggcgggcctggtgttgggcctggtggtcctgggcgatcgcgaattcgaccgcgcccggaatccggtgaaagcccttgcggtcgtagacatgtgtgacgatgccgcctagcagtagcccgatgaccaggccggccgacgtcatggtgagcgcctggctcaggccggcgtcgccgcggccgccgaagtacagcagcgagcgggtgcccaggaagacctggtgcatgggctcgaattcggccagccagcggaacaacggcggcgtcgcctccagcggcaccgtggcgccggcggagggcaacccgaagatcacgaacaccagcatgctgaccaacatgccggccgtccccagtaccgacagcagcgaactggacgtgatacccactgcggcgatggcgaatacgccgtaggcccacagttcccagctcaggtcgatgggcatgccgagcccgtcggcgatcgccagatacaccgccgacgtgagcagcccgagcagcaacatcatcgcccacttcaacagcaacgtctggaatctggagatgcggacctgctcggcgaagcggtacacggggccgaattcggccggcacgtaacccaatagggcgtcgaccagggtgctcaccacgatgctgccggtgaagccggccagcaacagcagcagcgcgtaatagaaggccgacaacccgttgccggtgccgttgggcagcgggttgtaaacgaccgactggatctcgatcggcgagctgaggccggcctgggtcgccccgggcagcggcgcgccaccggtctgcgccgtcacctcggccataacccgttgcgcggctatcccgttcgccgtccccatcgccgagttgagggtctgcccggcgatgctggcgcccagcgtgccggcccgcggattggtggagacggtgatcgacggtttgtcggggcgggcgggcgataccgcgctggtggcgaagtcgcgcagcttcgaggagaagctgggcggtatcagcagcgagccgtacacccgtccggtgtccagttgatgtttggcctcgtcgcgcgagagcacccggatgtcgaacttgttccggtccaacccggtggccagccggtcgacgatttgcgcgccgccggggcccgcgtcctcattgaccaccgcgatggggaaatgacgcagattggtcgtcgggttcaagatgccgcccagatacagcgcgcacaacgcggacatcagcgccaacgtgatgaccaggggagccgcccagaaccgaacggtgcggaccgccttgatgttccggttggggttgggcgccgcgtgctgcgggtgcgatctggccatgccgactcctgtctgtcgtgcccactctatgggctcgcgtcgccggccctctatgacctcagccgcccagccgggcgtgcatctcccagagcagcagttccgacggctcgagtccggtgacgcggcggccgtcggtgtcggtgaaccgcaccgcgtcgcccgggtgcagttccccgacaccctcgacgtcggcccggccccgggcgaggaaaacgtgcaggtagggcgccgccggaaggtcaacggcggcggccgccggcagccgggcgccgtgcagtgcggcattgcggttgtgcaggccgatcgccgcgtcgtggccccggatgcccgaggcgatcgtcaccatgccgccgcccagcgcggtgtcgtcgatctcgtgctgctggtagcttgggtcgatcccggcctcgtcggggatcacccacatctgcacgaaatggaccgggacgctgggggagtcgttgcgctccgagtgcagaatgccgcggcccgccgacatgcgttgcgccagacccggatagaccaccccacgattgccggtcgagtcctgatgcgccagcgcaccggccagcacccacgtcacgatctccatgtcccgatgcgggtgggtgtcgaatcccgttcccggggagacgatgtcgtcgttgttgaccagcagcagcccgaagtgggtgttgtccgggtcgtagtggtcgccgaacgagaacgagtgccgcgatgtcagccacggtgtggtggtgacggcccgggtcgccgcccgccgaatctcgaagccggctgacatgtccccagactagtcgccgcccggctcagcgaaccggggcggtcagcagccgccgggcctgttccagcgcgtcgtcgagttcgggcagagtcaaaccggccgagtgaccgaggtgtatctcgatctggtattccggctggccgtcgtggccgaagatcggaagcaccacgaattccgttgtgggcaactctgtttcgaggacatcggtgatggagcgcagggtcaccatggtcatcagcgtggtgagccgccgggcgacctgggccgtcggctccagcgatgccagcgcctcggccagccgattgtgcagggagcggtgcgtgtcatcgaaccgccacgcgccgtagccgcgggcccggatgtcggcgagcacccgttggtgctgggcgatctcggtgcgcgtgagccggggcgtcacgcgacgcagccaggcctggacggcatcgtcgtcgcgccaggccatcgccaccagaccgaagggcgggtcgatggggaagcgctgtccgacggcgtgttcgccgtcggtgccgtggccgacgctgtcgacggtggtcaggtgccgggcgccgatcttcgacatggagcagcccgcgccgagccgctcgcgcagcaagcgcagcgcgtcgcgcccgcggtccagcagcgggaactgctcgcgcagcccgtgcaccagcccgaacaggccgctgcccagcacgtagcggcgatcgtcgcgccgcgtcacccaggcccgccgttccagctcggccagcaccagcgcgcaggtcgaactgctgatcgcgcagcccttggccagctcggccgacgtccggccgccgggtgaatcggccacggccgcaagcacatccattacccgcgcggtcggcggcgatttcacgcccgacctgcgcggggtctcaccgattgactcggccaccgtcgccttcctactatccgtccaaaataccgcagcagacgtcctaatattaggagaagagcgtgtacaaggtgggagtgtggggcccgggttcgatgggcgtgatcgccctgcgcggggtgatcgaccacccgcagctggagctggtcgacctggtggtgcacagcgacgccaaggccggccgggatgccggagagctgtgcggcgtcgcgccggtcggcgtggtggccacccaggacccggcggcgatgctcgccggcgacgccgacgtcgtggtgtacgccgccggcgccaacctgcggccgctggaggccgtcgaggacatggtgtcgctcctgcgggccggaaagaacgtggtgtcgtgctcggtggtgccgctggtctttcccgacgccgtcgacagcgccttcagcgagccgctgcgggcggccgcgctcgaggggcaggtgtccttcttcaccaccggcatcgactccggattcgccaatgacgttctgccactggtacttaccggcgtgtcgagggtgatcgaatcggtgcgggtgaccgagatgttcaactacgcgacctatccggacgcctccgccgtctatgagatcctcgggttcgggcagccgccggactacccagcattcgcggcccagccgggcatcttcaccttcggctggggtcccgtgctgcaccagctggccgccggactgggcgtcgagatcgaccacatcgaggagagcaacgagcgcattccggcgcccgaatccttcgacacgccaaccggtcacatcgcggcggggaccatcgccgcgatgcgctcgacgctgaccggctacgtcggcgagaagccgacgttcgtgctcgaccacgtgacccgcatgcgtgacgacctggcgccggattggccccagccgcggattgccatcacgcccaaggacttgggctacgggctggcgtcgggccgcggtctgtaccgggtggagatcgagggttcgcccagcatgcgctgcgaattcgagatggccgaggatcacgaccacgatctgggagcccggattgccgggtcgtcgcggatggtcaacgccatcccggcggtgtgcgcggcgccgcccggcctgctgtcggcgctggacctgccgctgatcaccggggccgggctggtgcgcccggtgctggggccaccgccggacagccggctgttctagcccggaaacgtcgcggcggcgagccgcagtatctcggcgcggtcggcgggcaggatgaacccggcgccgatcgccgcgtccagcgcgacggtgaagcgctccagatattcggtccgcccaccgggatacagccgctcgagggtggcggcgtcgaacggttcgccggagccgaagatcgccgacatgacgctctcctgaccgccgagccccgaggttcgggcgatcgggacgtccacccacggggtgcggaggccgccgcgggccagcccgttgccgtccagaaccggttgcggcgcagggccttcccgcacctgcaacggctcggctcccggcgccggctggccggcggtgacccaggtgttcagggcggccagcgctgcctgcaccacgtagtggtgctgcgggccgaagttgatgtagtgcggcaactgctggcccatcagcatgttggtcggcgcgtagccggaaacgatgtcctcgagtggcgccgagccgctgtcgatgaaagccacctgaatcgtgtagttgtcggcgtgcgcggccccggcgatctcccagacccgcagcctggggttgtcgggctggcgggcgaagtagtagccctcgcgcggaccgccgaacacgtcggtctcggtgatcaacgtcagcaccgggacgcgcagctccggccggaatgtcaccgcttgcggctcagtcgattcggtgaagatcgaggtcccgtcgagcggggcggcaggcccgaaccgggaatgaaccaggaagccgtcgaagacgccggccaggggatcgacggcgttgatgtaggtggtgaggaacatcgccgactgggactcgcccagcgcgatcacgtgtcgggccggcaggccgcgcagcatcgccgtgtgcccgccggttgtcagcagcccgccgatctgggtgaagatgtcgtagctgaacgcgtcgcccgggtggtgcagcgccgcatatcgttgcgggtcctggcttttcagcgacatgtccgcgccgagcaggctctcgccgccctcgacgcccacccgctgggccgacaccgcgacgtacgcgtaaccggcgcggaggatctcgcggtgtgccatcatccagaccgcggcggcatcgatgccgccgctcacgttgagccactccaccagcaccgtcccgttgaaccgggccgggtcggcaggcgtcagcaccacgacccgggtggtgaaatcggcggcgccgcaacggattacctcccagcacccgtcggcgcccagctcgcccgccgggccgtaacgggacgccgtcgcggacacgaagaactcctcggcgacgtatccgaccgtcgcaaggtcataggcgctcagcaacagccgcgggttgccgggtaccggcgtgaccccgacggtggaactcgtcatgcgcgcacaccttcctgccggggacccagcgcggcgggcagcccgaacttggcgaacaggctgtcgtcgaggaaggccaccacatgcgaaacccggtccccgcgcacatccagcacgtgcagctggaagggcagatggacgtcgccggcccgcatgtacatggccgccgccggttggccgttggcgatcagcggcagcaggcgcatgtcgccggcgccctcggccgggcattgctgatggatcagggtgacgatggtccgcgcgccctgataccacccggtgtacggcggcatttcccagatcgcctccgcggtgaacaactcgaccaggcggtcgatgtcgtagctttcgaacgcggcgatgtagcgcgccaacaggtcttgggtctcggccgaatcgggctgcgccagttggtcatcggcgctgggcccgacggcgtccagctgggcgcgggcgcgttgcagcaggctgttgacggcggccgtggtggtgccgatcgcctcggcgacctcggcggcgcgccagcccagcacgtcgcgcagcagcaacaccgcccgttgccgcggcgaaaggtattgcagcgcggccacgaacgccaaccgcaccgattcgcgcgagccgacgatcaccgacgggtcggccgggtcgtcggtcagcgccggcagcggttccagccagggcacctcgcgacgctcgaccagctcggcggtggggtccgcgctgggggcgcccagtcccaccgggagcggccggcgctgccggccttccaacgcgctcaggcaggtgttggtggcgatgcgatgcagccaggtccgcaccgaggacttgccctcgaagcggtcgtaggccttccaggcccgcagcagcgtctcctgcaccagatcctcggcatcgtgcagggatcccgtcatccgatagcagtgggccagcagttcacgccggtacggttcggcgtgcgcggtgaaatcggcgcccaccaccgagtcaccttcaggggtttgcgcgagcaggctcacccgcatgagcgtacgcagtgtctgcaagcgcggcgcggacccgcagccattacgctgccggtaatgatgagggacccgcagtgaaccggaccgaacgtagtttcgacggcgtcggcggtgtgcgcatcgtctatgacgtctggacgccggaggtcgcgccgcgcgcggtgctggtgctgtcccacggcttcggcgagcatgcccgccgctacgaccacgtcgcccggcgcttcggtgcggccggcctggtcacctacgcgctggaccatcgcgggcacggccgttccggcggcaagcgggtgctggtgcgcgacatccacgaatacaccaccgacttcgacaccctggtcggcatcgccacccgggagcatcacggcctcaagtgcatcgtggtcgggcacagcatgggcggcgggatcgtgttcgcctacggcgtcgagcgccccgacaactacgacctgatggtgctgtccggtcccgcggtggcggcccaggaccaggtgtcgccgctgctggcgctggccgccaaggtgctcggcgtgatcgtgcccgggctgcccgcgcaggaactcgacgccgacgccgtctcccgggaccccgaggtggtggccgcctaccgcaacgatcccctggtgtaccacggcaaggtcccggccggcgtgggccgcgcgttgttgcaggtgggtgagacgatgccgcagcgggccccggcgctgacggcgccgctgctggtcgtgcacggctcggacgaccggttgatcccggtcgccggcagccggcgcttggtcgaatgcgtgggctcggccgacgtcgagttgaaggtctacccggggctctaccacgaggtgttcaacgagcccgagcgcgagcaggtgctcgacgatgtggtcggctggatcaccgctcggctgtgaggccgcccgtgtcggacccctcccgtaagttggcgcgtatgacttccgctggcgatgaggaggagcggcgcgggtgatttccgccggcgacgatgcagagcgcagcgatgaggaggagcggcgcaagtgagtgacgacaagatgctggcgcgcatcgccgcgctgctgcggcaggccgaaggcaccgacaacagccacgaggccgacgcgttcatgtcggccgcgcagcggctcgcgacggccgcatccatcgacctcgcggtggcccgctcgcattcggcccaacgttcggcggcccaggccccgacccagcgcaccatcaccatcggcgcggcgggcagcaaggggttgcgcacctacgtgcagctgttcgtgctgatcgcggcggccaacgacgtgcgctgcgatgtggcctccaattcgacgttcgtctacgcctacgggttcgccgaggacatcgacgccagtcacgccctgtatgccagcctggtcgtgcagatggtccgcgcctccgacgcctacctcgcctcgggagcgcaccgcccgaccccgaccatcaccgcccggctcaacttccagctggccttcggggcgcgtgtcggccagcggctggccgaggcccgcgatcaggcgcgccaggaagccaccaaggaccgtcgtcgcgcgccgggcactgctattgccttgcgggacaaggaaatcgagctggtggacttctaccgcagcgcgtcgaaggcgcgcggaacctggcaggccagtcgcgcgtcggccggatattcctcggcggcgcggcgggcgggcgatcgggccggaaggcgggcgcggctgggcagcagccccgagctgcccggggcgcggagcgcgctaagcgggtgagccccggggactccccgccgcgggattctcagcgctccagggtctatgcggccgaggagttcgtccggacgctgttcgaccgcgccgccgagcacgggtcacccgcggtggagttcttcggcacccggctgacgctgccgccggagggccgattcggctcggtgccctccgtgcaacgctatgtggaccaggtgctggccctgcccgccgtgcggcaacggtggcccgatgtgccgccgctgcgggtgcggccgcggcgggccgccaccgccgcgcactacgaaaaccgcgacggcgcaggcgttatcgcggtgcccgaccgcgacaccgccgagtgggccctgcgcgagctggtggtgctgcacgaagtggcgcatcatttgtgccgggccgggccgccgcacggcccggagttcgtcgcgacgatctgcgagttgacggagctggtgatgggacccgaagtcgggcatgtgctgcgcgtcgtctacgccaaagagggtgtgcgatgaaagatccggacgagcgggcgcgcacaatcgaggcccagatgaccgacgacgagcggttctcgctgctggtcgcggtgatgggcgccggcgacatgtggccggtgcgcgacgagcgcatcccggcggacgtgccgatgagcgcgggttacgtgccgggggtgccgcgcctcggcgttccgccgctgctgatgagcgacgccggactgggtgtcaccaaccccggctaccgtccgggcgacaccgccaccgcgcttccggccggcatggcgctggccgccaccttcgatccggcgctggcccgcgccgcgggcgaactgatcggccgggaagcccgcagccgcggattcaacgtccagctggccggggcgatgaacctggcccgcgacccgcgcaacggccgcaacttcgaatacctttccgaggacccgcttttgaccgccgccatggtcgcggagtcggtcgcgggcatccagcaacagggcgtcatctcgaccgtcaagcactactcgctgaactgcaacgaaacgaatcgccactttctggacgcggtcatcgaccccgacgcgcaccgcgaatccgacctgctggccttcgagttggccatcgaacgggcccatcccggggccgtgatgaccgcatacaacaaggtcaacggcgtctacgccgcggcgaacagtgtgttgctcaacgacgtcctcaaggacgcctgggcgtatcgcggctgggtgatgtcggattggggcgccactccgggctgggagtgcgccctgggcggtctggatcaggaatgcggcgcccagatcgacgcgctgctgtggcaggccgaatccttcggtgcgccgctgcgcgacgcctacgccgacggccggttgcccaaggatcggctctcggacatggtccggcgtatcctgcgctccatcttcgccgtcggcgtcgaccggtcggaccgggaaccggcgccagatctcaacgcccacaacgacattgccctgcgcatcgcgcggcagggcatcgtgctgctgaccaaccgcgggttgttgccgttgcgccccgactcgccggcgcgcatcgccgtcatcggcgggtacgcgcaactgggcgtgccggccggtttcggttccagcaccgtcgttccggcgggcgggtatgccgccgtggtgccgatcggcggcacagggctggaggccgggctgcgcaacctgtacctgctgccgtcgagtccgctgcaggaactgcgaagacttctgcccgagaacacgattgacttcgatcccggaatcagcccggccgaggcggtggcggcggcacaacgcgccgatatcgcgatcgtgttcgcggtccgcgccgaaggggagggcttcgacctcgccgatctgtcgctgccgtcgggccaggacgagctgatcggcgcggtggcggccgccaaccccaacacggtggtggtgctgcagaccggcaacccggtcaccatggcgtggctgggagcggtgaatgccgttgtgcaggcgtggtatccgggtcaggccggcgccacggccatcgccgaggtgctcaccggccgggtgaatcccggcggtcggctgccgatcaccttcccggtcgacctgcaccagacgccgcgcccgcagctgcccggcgccgggctaccgtggggaacgccgagcaccatcgactacgtcgagggcgccgacgtcggctaccggtggttcgcggccaagggccacgtcccgatgttcgccttcggacatggattgtcctacaccagatttgaacaccgcgacctggtcgtgcggggcggcgacaccatcaccgccggcttcaccgtggtcaacaccggcgatcgcgccggggcggatgtaccgcagctgtacctgacggcgatgcccggaaagccgtgcctacggctgctgggattcgagcgggtcgagctgggcccgggcgagagccggcacgtgaccatcgacgccgatccgcgactgctggcccactacgacggcagcatccgaagctggcggatcgccgcgggcagtcatacggtggcgctggggatttcggcgaccaccctgcgctcgacggccacggtcgagctgaccgctcgtgcgttcgggcgatgaggcgcccgaacgcacgagcgggtcaacggactacttgaccggggtcagcgcgtcgccacaggtgcagcggtactcctcaccggcacccgagcagtggcagggaacctcgatgcggacgcgacagccgcagccctcgtggccgcaggtcagcagggttccggactcgtaagttgccatgtgactcacccatttcttcctgttgtgactcgtgcggcgcgggtcgaccgcacctacactatataccccccacgggtatatagtaaacggccggatcgaccggcccggcgaaccgtcgcgggtgcggctagcgttggacgcatgaccgagaaaccaacgcccaaagacgtcgacgcattcttggacagcacggtggtcggcggcgacccgtcggtgatcgacgcgctcgaggccagcagcgccgccggactaccgccgatcgcggtgtcggtgcagcaggggaagttcctcagcctgctggccaccgccatgggtgcgcgacgcatcctcgagctcggcacgctgggcgggttcagcaccatctggctggcccgcggtgccggcccgcagggccgggtggtgacgttggaatacgagcccaagcacgccgaggtcgcccgcgccaacctgcagcgggccggcctggccgatcgggtggaggtgatcgtcggcgccgcgctggacaccctgccgtcggtgaccggtccgttcgatctggtgttcatcgacgccgacaaggagaactatcccgcgtacctggactgggcggtgcggctggcccgcccgggcgcggtcatcgtggcggacaacgtgattcgtcagggccagatcctcaagccggaggccgacgcccaagcgcgggcggtgcgccaaacgctgcaggcgatgggcgagcacccgcggctggacaccgcggtgatccagacggtcggcgccaagcactgggacggcttcgcgtttgcggtggtgcgctaggcctcagcgcggggtgaggtcggcgacggcctggcgcgcggaggtgagttcgccgatgcgcgaggcggtttcgccggcgtagagcgcggcgctgtccagcagcgagtccggaacgccggccaccggtgccagcggggtgaacagcggacggcgcggcgattgcaggcgcagcaatgcgcccgcgtcgaaatagcccagcgccgacagcgggcggctcgccgcattgagtgcggcgggcagcgccctggccttgccgtcggcgccgcaccaccggcgggtggcggcgttgggcaccacccgatggcgcagcggccagctcagcccgaacaggttggtttcgatcgtgttgtccgcctgcaggactcgctgctgatagccgcggctcgcatcggactcgtgcgtcagcaggaatcgggtgccggcgatgacgccgtcggcgccggcgtccagggcggcgcggctgtcggcggcggtggcgatgcccccggccaggaacaccgggcggccgccggccgcggcgagcgcgtgcggcaggaagtccagggccgccgtggtccccaccagatggccgccggcctcgcggccctgggcgatcaaaccgtcggcgccccaggcgattgcggcgcgggcctgcgccacggtgccgaccatcacgaacacgaaggcgccggccagccgtaggtgcgcgacgagcccacggttttcgccgaacgccagcacgacgacgtccacccgggcctcgacgcagaccgcgacgtggcggcgacgggtaaagggcagcaacaggtttaccgcgaccgcgcgcccgggcgcctgctcacgcacccgctggatcgacgcttcgagccggccgggggtggtgatgcccagcgtgcccaggccacccgccgcggcgaccgcggccgccagcggcgcaccggccagcccgccgcccatcccggcctgcccgaccggaacatcgagccgcaaccggtcggcgatgtccatgccccgccacgttacgccgcaggcgccgaaccggtttcgcgagcgcgggttggggcgctgggccggcgccggttttcgttgctggcggccgtcgagcgggcgtaatcttgatcacagatggatgggtgcggtccgctcaaaaggcttgccgcataacagaaaggtcacaaaatgagtacagtccattcatcaatcgatcaccaccccgatttgttggctctgcgggcccgctacgaacgcgtcgccgagtcgatgagtgcgcacttcaccttcggtcttgcgctgctggccggcctgtacgtggcggcctcaccgtggatcgtcgggttcagcgcgacggcatcgctggccacgtccgacctgatcgccgggatcgcggcggcgttcctggcctacgggttcgcgacgacgctggaccgtgcgcacggcatgacctggacgctgccggtgctgggcgcgtgggtcatcgtgtcgacctggatcctgccgggcgtcgtgctgaccgccggcatgacctggtcgaatgtggtggcgggtgcgttgttgacgttcctgggtctcaacgccacctacttcggcatgcgcacccgcgcgtcggccggctgatccactttcggtcgcgagcgtgcgtggtcgcccacggcacgctcgcgccgaaggccgaaagcgcaaggcggccaggctagccgcagacggcgccgatcgccgcggaaccgacgagcttgacgtacttggccagcaccccggtcttgtagcggggcggcggcggggtgaaacctgttcgccgagagtcgaattcggccggatcgacgagtacgtccagaacccggttggcgacgtccaggcggatgcggtcgccgtcgcgcagaaaggcgatcggccctgcgtccaccgcctcgggcgcgatgtggccgacacacagtcccgtcgtcccgccggagaagcggccgtcggtgagtaacagcacgtccttacccagcccggcgcccttgatcgcgccggtgatggcgagcatctcgcgcatcccgggcccgcccttggggccctcgtaccggatcaccaccgcgtcgcccttggtgatggtgccgtcctccagcgcgtccagcgcggcccgctcgccgtcgaaaacccttgcggtgccttcgaacacgtcggaatcgaagccggcggacttgaccaccgcgccctcgggcgccagcgacccgcgcaggatggtgatgccgccggtcgggtgcaacggatcgctgagtgcccgcagcaccttgccgtccgggtcgggcggggcgatcgcggccaggttctgcgccaccgtcgcaccggtcaccgtcaggcagtcgccgttcagcagcccggcgtccagcagcgccttcatcatcaccggcacgccgccgatgtggtcgacgtcggtcatcacgtgccggccgaacggcttgacgtcggccaggtgcggcaccttcgacccgatccggctgaagtcgtcgagcgacagcgccacgtcggcctcgtgggcgatggccagcaggtgcagcaccgcgttggtggagccgccgaacgccatcaccaccgcgatcgcgttctcgaacgcctccttggtgaggatgtcgcgggcggtgatgccgcggcgcagcagctcgacgacggcctggccgctgcgccgggcgaagccgtcgcggcggcggtcggtggccggcggggccgcgctgcccggcagcgacatccccagcgcctcggcggcgctggccatggtgttggccgtgtacatgccgccgcaggcgccctcgccgggacagatggcccgctcgatggcgtcgacgtcctcgcgcggcatcagcccgcgcgcgcacgcgccgacggcctcgaacgcgtcgatgatcgtcacctcgcgctcgctgccgtcggacagcttggccaccccgggcaggatcgagccggcgtagaggaacaccgaggccaggtccaggcgggccgcggccatcagcatgccgggcagcgacttgtcgcagccggccagcagcaccgagccgtccaggcgctcggcctgcatcaccgtctcgacgctgtcggcgatcacctcgcggctcaccagcgagaagtgcatgccctcgtggcccatcgagatgccgtcggacaccgagatggtgccgaactccagcgggtagccgcccgcggcgaagacgccttccttgaccgccttggccagccggtccagcgacaggttgcacggcgtgatctcgttccaggacgacgccaccccgatctgcggcttggcgaagtcctcgtcgcccatgcctaccgcccgcagcatcccccgggcggcggccttctccaggccgtcggtgacgtcacgactgcgcggcttgatgtcgggctgcttgatgtcggcggcgcgcgccgaatcggtggtgggcatcgttcaagtatgcgctggccagtcgcgataccagctcccggggttataccggggcggggtataagctggggccgggtgtgatgccgccgcggggcagccagatcggcaggggtgaaacgacgatgaccaacgaacacgggtactcgcagcagaaggacaactacgccaagcggctgcggcgcatcgagggccaggtgcgcggcatcgcccggatgatcgaggaggacaagtactgcatcgacgtcctcactcagatcagcgccgtcaacagcgcgctgcgctcggtcgccctgaatttgctcgacgagcacctgggccactgcgtcacccgtgcggtggccggcggcggcgacgacgcggacgagaagctcgccgaggcgtccgccgccatcgcgcgcctggttcgctcctgatcgcccgggcgtgttgcccggccaagatggatgaaccggcgaccggtatgcgtacggtaggggagcgcgatctggtttgcggcattgcttagccgactgcgcacacccaagcgatgactgtgatgactgccgaaaccgccaacgcagccgcgcggacgtggaccccacggatcgcggctcagctcgccattctcgccgccgcggccttcacctatgtcaccgccgagatcctgccggtcggcgcgctgcccgcaatcgcccgcaatctgcaggtcagcctggtcctggtgggcaccctgctgtcctggtatgcgctggtggcggccctgaccacgatcccgctggtgcgctggaccgcgcacctgccgcgccgccgggtgctggtggcgagcctgacctgcctgaccgcctcccagctgatctcggcgctggcgcccaacttcgcggtgctggccgccgggcgggtgctgtgcgcgatcacccacggcctgttgtggtcggtgatcgcgccgatcgccacccggctggtgccgcccagccacgccgggcgcgccaccatgtcgatctacgtcggcaccagcctggcgctggtggtgggcagcccgctgaccgcggcgctgagcctgatgtggggctggcggctggccgtcgtgtgcgtcaccgtcgcggccgccgtcgtcaccgtcgcggcccggctgatgctgccggagatggtgctcaccgagcatcagctggcgcatgtcgggccccgctcgcggcaccaccgcaacggccggctgatcaccgtgagcctgctggccatggtggcggtgaccggccatttcgtgtcctacaccttcatcgtcgagatcatccgcaacgtggtcggggtgcgcgggccgaccctggcctgggtgctggccgcctacgggctggccgggctgctgtcggtgccgctggtcgcgcggccgctggaccaccggcccaagagtgcggtgatcctgtgcatgacgggtttgacggccgccttcgcggtgctgaccgcgctggcgttcggcggcccgaccggggcgacgaccgcgctgatcgggactgccgccatcgtgctgtggggagcgatggccaccgcggtgtcgccgatgatgcagtcggccgcgatgcgcaacggggccgacgacccggacggcgcctcggggctgtacgtgacggccttccaggtgggcatcatggccgggtcgctgctgggcgggctgctctatgagcgcagcgtcatcctgatgctgagcgcttccggggtgctgatggcggtggcgctggtcggcatcgccgccaaccggcggatgctggacgttgccccgacaagctcacgcgattcataaccgccctgctcgacgcggtaatcacggccctttccggggcgggcgcggccgtcggcgacggtagctggcaagcctgctatgcgacactgtggtcgagaacatgagtggaggtatgcctatgtcgggctggacgaggggaacgctcttcgccgctctgaacgccgccgtggtgtcggtcgtcggcttggcgctggtgctcagcgccggtcccgcgctggccgacccggacccggctcccgccgatccgggcgcggtggcagccccgcccggcccgccggctccgccggatccgttggcgcggccgcccccgcccgacccgttggcaccaccgccgccgaccgccccgccggcgccgtggctgccccccgccgcgcaaccggccgccgccccggccgccggacaggaccccaccccgttcaccggcacgccgccgttcggcccgcccacgttcgtgcccaagaccggctcgacggtgggcgtggcgcagccgatcatcatcaacttcccgggccgggtcgacgacgccggcgccgcgatcagcgccgtgcacgtctcgtcggtgccgccggtgccgggcaagttctactggatgaccccgacccagctgcgctggcgcccgctgagtttctggcccgcccacaccgcggtcaccgtggacgccggcgggacggtgaccaacttccagaccggcgacacgctggtggccaccgccgacgacgccacccatcagctgaccgtcacccgcaacgggaccgtggagaagacgttcccgatgtcgatgggcatgacggccggcaaccaccagacccccaacggcacctactacgtgcaggacaagaaggcgtcggtggtgatggactcgtcgacctacggcgtcccggtgaactcgacctacggctacaaggtgaccgtggaggacgcggtccggttcgacaacgtcggcgactacgtgcacagcgcgccgtggtcggtggacgaccagggcaagcgcgacgtcagccacggctgcatcaacatcagccccgccaacgccaagtggttcttcgacaacttcggtccgggtgacccgatcatcgtgaagaactccagcggcggcgactacaagaagaacgacggctccgccgactggatgaactagctcgggacggcccggcgggctagctccggattgccccagcaggcgctggggctttcgcggcgaccatgattatgtatagcatcatacatatccggcccgaggagcgacgatgcgcagtccgcgcgaaaagatggtggtctcggccgcgctgctgatcagggagcgcggggcgcacgccaccgcgatctccgacgtgctcgagcacagcggcgcgccgcgcggatcggcctaccactactttcccggtggccgcacccaattgctttgtgaggcagtcgatttcgctggcgagtacgtcgccgccgtgatcgccggggccgagagcggctcccggctgctggacaccttgatcgacacctatcgggaacagctgcgcgacagcgactttcgcgcgggctgcccggtggtggcggtcgccgtggaagcgggcgaacaatccgacgccgagcggccggtgatcgagcgcgccgccgcggccttcgaccgctggaccgacctgatcgcgcagcgcttcgtcgccgacggcatacgacggcgccgcgccgccgagctggcggtgctggccaccagcgcgctggagggcgcgatcgtgctggcccgggcgcgccgcgacccggcacccctggacgtcgtgcaccgccaactgcgcgacctgctggccgcagaacttgcgggcgaaaccgccgcaggaaggaaatcccgacatgaccggtgaatggcaaccgagcgcctgcatcctctgcgaatgcaactgcggcatcgtcgtccaagtggaagaccgccggctggcccgcatccgcggcgacaaggcgcaccccgcctcgcagggctacacctgcaacaaggcgctgcggctggaccactaccagaacagccgcgcccggttgacctcgccgctgcgccgccgccccgacggcagctacgaggagatcgactgggacaccgcgatcgtcgagatcgccgaggggttcaagcgcattcgcgacagctacggcggcgacaagatcttctactacggcggcggcgggcagggcaaccacctgggcggggcctacagcggcgccttcctgaaggcgctgggctcgcgctaccggtcgaatgcgttggcgcaggagaaaaccggggagtcctggatcgacggccagctgtacggcggtcacacccgcggcgagttcgagcacgccgaggtcgcggtgttcgtcgggaagaatccgtggatgtcgcaaagctttccacgcgcccgggtggtgctcaacgagatcgcgaaggatccggcgcggtcgatgatcgtcatcgatcccgtcgtcaccgacacggccaagatggccgacttccacctgcgggtgcgtcccggcaccgacgcgtggtgcctggccgcgctggccgcggtcctcgtccaggaaaacctgtgcgacgaggcatttctcgccgagcacgtgcgcggcgccgacggcgtccggcgggcgttgcgtgacgtggcggtgtgcgagtgcgcggcgcactgcggggtggacgaggagctgctgcgcaccgcggcgcggcgcatcggcaccgcggacagcgtggcggtgttcgaggatctcggcgtgcagcaggcgcccaacagcacgctgtgctcctacctgaataagctgctgtggatcctgaccgggaacttcgcgaaacgcggtggccagcatctgcattcgtcgttcgcgccgctgttcggccagttctccgggcgcacgccggtgaccggcgcgcccatcatctccggcctggtgccgtcgaacgtggtgcccgaggagatcctgaccgatcacccggaccggttccgggccatgatcgtggagagcagcaatcccgcgcactcgctggccaattcggcggcgtgccgggaggccttcgcgtcgctggaactgatggtggtcatcgacgtggcgatgaccgagacggcccggctggcgcattatgtgctgccggccgcctcccagttcgagaagcccgaggccaccttcttcaacctggagttcccgcgcaacacctttcagctgcgccgcccgctgctgacgccgctgccgggcacgctgccggaacccgagatctgggcccggctggtgcgggcgctcggcgtggtgacggaggcggatctgcggccgctgcacgacgccgcgcggcgcggccggcacgcctacaccgaagcgttcttgaccgctgtgtccaccaatccgactgtggcgcagctacttccgtttgtgctgtacgaaacgctggggcccaccctgccggacggactgcgtggcgccgccgcgctgtggggcctggcccaaaagaccgcgctgacctatcgggaggcggtgcgccgcgccggtcacgccgacggcaacgcgctgttcgacgccatcctggacaacccgtcgggggtgacgttcaccgtgcacgactacgcggacgacttcaccctgatcggccatcccgaccacaagattgcgctcgaaatcccggcgatgctgcaggaattggcgaagctgtcgagcggcccgccgcggctgaccaccgaagagttcccgatcgtgctgtcggtgggggagcggcgcgcctataccgccaacgacatcttccgcgacccgtcctggcgcaaacgcgatgccgagggcgcgctgcgggtcagcgtcgaagacgcccaggccctcgggctggccgacgggtgccgcgcccggatcagcaccgcggcgggcagcgccgaggccaccgtcgagatcagcgagaccatgctggccggtcatgccgcgttgcccaacggttttgggctggactacatcggcgacgacgggcgcaccgtcgttcccggggtggcgccgaacgcgcagccgcacgtggcgggccacctcggcgcgctcgttggcctccaggtgggcgcgggcacgctcgagtacctcccacagcgccttggcgatgccatagggccgggtgccgtcgagcacctcttcgacctggcgcgcggtgcgcccgtaggggtcgcgcttcagcgcgccggcgatgcgcttccaggtggcgatgtcaccgctctgcagagccgaacggatggcggcggtcggccagaattccaccggctggtcgaggtccggcagcggggcggacgggccgccgccgcggttgcgctggtcccccggggccggccggtgcggcggcgaagccgggcgtcggtcgggtgccaacgtcacctcgcctcctccagcatcgcgacggccacggccaggcagcgctgcctgatctgctcccagtccgcgggtgcgtcggcgtccggcccctggtcatccgggtaatcgcacggatcgggatcggcgagccggcggaccaactgggtggcgatccattgccgcctggatgattcacaacagtaatacctgtccattccggccagcaccaccgcggcggtctcgggttccaacgcatccaccatgtctgcaaagtcggcgtaatcgcggcgactgttacggcacatgagcaggtagcccttcagccgcagtgtctcggcgcccgtcgggaccagcaaccggtcgccggtgggcagctgcacattggtggtctccaccgggctgcgccgccgaaaccgcggccggtcggtcccgctgtccgggtccgtctgcagcgcgtccagcgccaccgacagccgtccccgccacagcgtcaccgggtgcacgggccggtcggccccggcgatggccttggcgatgccgttgcgcccattgcgcgcggccggcttcttggcccccgccgaaccgttggtgtgaccgttgctgccggtcttttcgcccgggcccgccgcgacgccgaccttctcctcgcgcagcgccacctggtgcgggatctgcccgggtcccaggccccgggccgggtccgcgccggccgccgtggtgcggccgcagccggtgaacgccagcggatcggtgacgcagatggcgtccggcgccaggtgcttgagcttggccgcggacttgagcaccatccgcaggtcggcgctgggcgcggtgagcgccgagatgtcgtcggggatcaccacgacgtcgcccaggtcgacctccggcagcggccggtcgaagtccaccgacggcaggacccgcgacagccacggcggcagccaccagttccactgggcgaacatcgccatcaacgccggcaccatcaccaggcgcaccacggtggcgtccaccgcgatggccaccgcgcaggccaccccgatctcggccaccagcggcatgcccgcgaacgcgaagccgacgaacaccgcgctcatgatcagcgccgcgctggtgatggtgcgggcgctggtgctgacgccgtaggccaccgcgtcgcgggtgttgccggagtgcaggaagcgctcccggatgcgggtcagcaggaagatctcgtagtccatcgacagcccgaaggtcatcgcgagcaccagcgggggaacggtgctgtcgatcgagctgatctgggcgaacccgagatcgcgcagccacccccactggaacaccatcaccaggctgccgtaggcggcggcgaccgacagcaacgtcatcagcacgcccttgagcgccaggaacaccgagtggatggagaccagcagcatcacgaacgcgatcagcgcgacgaagccgagcaccagcggttcggtcgccgagacccggtcgtcgaagtccttgatcagcgcggtcgggccgccgacgtcgacccgcgcggtgcccgcctcgggcaccttgggcagctcggcgcgcatccagcccacggtttcgcgcgccttcatgtcctcggggtccaccgacagcacggccgacagcaacgcgctgccgttgtcctcggcgaattgcggcggcgacaccgagacgatgttgggcgcctgggccatccgctggcggaccgccccgacggtgtggctgtgttccggggacgcggccccgccgtcggggaagttgatcagcacccggatcgggcccagcgcacccgggcccagcgcctgggccgccgcgcccaccccggcccggatctcgtgcgacgagtcgaactggcgcagcaggctgttgccgagcaccatcgacgcggccggcgcggccatcaccagcagcaccagcgatgccgccagcgccgacatccacggccgccgcatcacccagccgatccaccggttccagaacttcgactgggtgctttccgggcgccgcgaccagtgcagcagggccgaccgcttggcggcggcccgcccgaacgtggccagcgccgccggggtcaacgtggtcgacgtcagcatcgcgaccgcgacggccaggatcgcgccggtggccatcgatttcagcgccggggtgttgatcacgtagatcccggtcagcgaggcgatgacggtcatcccggacaacaccacggccagcccggaggtggccatcgcggcgtcgacggcctcgcggggctgacggccgctgcgcagttcctcgcggaagcgcatcaggatgaacagcgagtagtcgacggccagcgcgatcccgaacatcgacaccgtcgaggtgacgaacaccgacatggtggtgtacgcggacagcagatagaccagccccatggtcaccaccaccgtgcagatgcccagggccagcgggatggccgccgcggccagcgacccgaacacggcgagcagcacgatgaggatgaccggcaggttccacttttcggcggcggcgatgtcgtgcttggtgttggccgccgcggccgcgctcagcgcgccctgccctatgacgtagagccgaacccgcccgttggcggtctggccgggctggtcgcccttgatgcccaccttggtgcgcagctgcttggccacgtcgctggtgttgcgggaatccagccgcaccgacagcacgtacggccggtccggctgcgggggccgctgggtggggttggggatctcggtggtgcccgggacttcggcggcgatccggcgcagctgcgcgacggcgtcgttcatgtcctggtagctggcgtcggcgcggggggcggcgaccaacgccagggacgacccgccctggtcgtggtagagatcctcgagctggtcgtgcaccgccagcgactgcgaaccggcgacgtcgaaaccgccgccggtgaggttgccggactgggtcagggccaaatagaccgcgggaaccaacgccaacaaccagcctgcgaagaccaaccagcggtacttacgcaggctgcggctcaggcgcatcattaactgctggatttcgtcgctccccggttctcgcgtaacgtgctcgcgacgataccgcagcacgctgtggattatcttggcttatctggttcctgagctgcggcgacagccttgttgccaagacgctgcgaagacgttgtgaaccggtgatcgggcgggatttcggtcacatccgcagttccggctggcagcggtgatctgggcgatggcacgatgtcggttggcccggcgggccccggggaatgcggggaagccggcgatcagatccggcgatcagcggggccgttcatcgcagccgtttgcggggcgccgatcttcggcggccgccgcaaaccgtaaggagttagccatgacgtcagcctccgctggacggcgccgcagaattttcgccgggctgatcgccgccgccctgcccggcgccgccgtcgcggtgctggccgggccgcccgcgaccggcgccaacgacccgtgcgcggccagcgaggtggcccgcacgatcggctcggtgtccaagtcgatgggcgactacctggacgcgcatcccgagaccaaccaggccatgaccagcatgctgcagcagcaggccgggccgcagtcggtgaacgggctgaagtcctacttcgatgccaaccccaaggtcgccggcgacatgacgtcgatcgcgcagccgctgaccagcctgtcgctgcagtgcaagctgccgatctcgatcccgcaggcgctgggcatggtgcagcaggcgcagggcgccgccggcgggctgccggcgctgccgggcaacccggcgggcgcctccccgttgggcggcgcggcaggtccggcgggcaccccgcccgccgtcccgcagccagccggcccgctgtcggggccgccgcgcggcaacaccgtcgggtgacggccgtcgaccgtgggccttacgtcgggcttccggtcgtttttgctgcgtaggccacacgctcggcgagcggccacgcgcggcgctagacgtctttgtccggattcggatcggccggattccggtccggcggcagcggcccctgcagggcggtgtcggtcgggtccggcgggccgcccggtgtaggcagcacgggcagcgggccggtgatcggctcgtcgtcggagtcggcgatgttctcggtgcggaatacgaagaagaacaccacccaaccgaccgcggcgatgagcagccagctgatcagccggtagatcagcatggccgagatcgcgctgggcagcgacatcccgctggacaccagccccggcaccagcaccgcctcgaccaccagcagcccgcccggcatcaacggtatggtgccgaccgcgcgggcggccgcgtaggccacggtcagcccggccaccgaggcgtggtccccggcggcgtaggcggcgaagcccaggcaggccacgtcggcgatccagttgaacatcgaccagccgaacgccaccgagagatcgcgccggcccaggctcaccgattccagctgcatcagcgtctcgcgccacttgtccaaaccggtctcggccggccggccgcgcaccgagttgacccacgccagcacccggctgccgatgccctcgatcagctccggccgggacgcgacggcctgcgccagcagcagcagcgcgacgaagccgcccagggtgaacagcagcgagaacgggttgttcttggcgcccagcaggaaggcgccgcccaggcccagcaaagccaacccgaccgcctgcagcacaccggacatcaccagctgccaggacgccaccacggtcgaggcgccccacagccgttgctgacggaacaggaaggtggccgacaacaccggccccccgggcagcgtggtgctcagcgagttggcggcgtagaaggcggcctccgagcgcagctgcttgacgtgcacccccgccgatttgagcagcgtgcgctggatctgagcaaagctgtgcatcgacgcggccgcggccaccaccgaggccagcaaccaccaccagttcgcctcgtacatgctcatccacgccttggccagctggtcccagcccagcgagacctcgacggcaagcacgatggccaccacgccgaggatcacccagcgcacccaccagtacctgccgcgcggggtctgctcgcgcgggaggtcgagattgtgggcgggtgcgtcgtgcggcacgtgacttagggtaacggtgcaggtggcgcggggatcgctgcacgtcgccgagtgtgtcagggacgttttggggtcgtgaccggatcgtgccggcggcgacggccccgggcgacgcgcagacgcccgcggtcaggtttgacgcggcgtcgctgcggataggctggcgaaatgtcagcaaacgtcgacgacgcgtcggttgaacccatagtccgcaagaccgccgcctgggcgtggcgtttgctcgtcatcctggccgccgcgctggcgctgttctgggtgctggccaagctggaggtgatcgtcgtcccggtgctggtggcgctgctgttgagcgcgctgctggtgccggtggtggactggctggaccggcacggcctgccccgtggtggcgcggtggcactggtgttgttgggcggcttcgcgatcctgggcggcatcctggccttcgtcgtgctgcagttcatcgacgggctgcccggcctgaccgagcaggtgacccagagcatcgagtcgacgcgccgctggctgatcaacgggccggcgcatctgcgcagcgagcagatcgacagcgcgggcaacgccgccatcgaggcgctgcacaacaaccaggccaagctgaccagcggtgcgctgtccaccgcggccaccgtcaccgagctggtcaccgcggcggtgctggtgctgttcacgctgatcttcttcctttacggcgggcgcaacatctggcggtacgtggtgcagatcgttccggcgcacgcccgcgaccgggtgcacgaggccggcagcgccggatacgggtcgctgatcggctacgtgcgggccacctttctggtggcgctgaccgacgcggcgggggtcggcgccggactggcgatcatgggtatcccgctggcgctgccgctggcgtcgctggttttcctgggtgccttcatcccgctggtcggtgcggtcgtcgccggcttcctggccgtggtggtggcactgctggccaagggcatcgtgtacgcgctcatcacgttgggcctgctggtggcggtgaaccagatcgaggcgcatctgctgcagccgctggtgatgggccgtgcggtgtcgattcacccgctcgcggtggtgctggccatctccaccggcggcgtgctcgccgggatcgtcggcgccctgctggccgtcccgacggtcgcgttcctcaacaacgcctttcaggtgctgctggcgcccaacccgtccgcggaagccgtcaagcaggaagaagagtccgacgagcagaacaccatcctgcaggcagagccggacaaacccgaaaacggttccggctgaggggtttccaggcctttacagccggccctcgcggcgcagcaggtcctgggccgacagcccgccgccggcgcggcggcgctgccgcgccgggtcgccattctcgccctgaccgcgcgcgttcgcctggtcgccggccgcatcggactcgctgccgcccgagccttccgcccgcatcttcggcagggcggtggtgggttcggcggcgtccgcgtcgctgtcgccgtcgtcgggccggttgccgggcacagggatggcgcgggtctgatccccggacggcggcgccgcctgggcgggcgggcgctgcggggtggccggacgtggttccggcggccgctggcggccgggcgctcccggcgcggcgaagcgggtcgtctgggcctcggtcggctggttgggccgggccgggatgcgggtggtgctcgcggccggttcctgcgcgggccgaggctccgcgggagcggggcgcgccgcccgcgacggctccggcgccgcggggtgggtggggtcgtgcggcgggcgcggcgccgcggcgaccaggctggccgccaccggcggacgggcgggccggccgttgagggtgggccgcttgcgctcgtcgggcaggtcgatctcgcccagcccgatcttgttctgcagccggcgggcccagcgcggggcccaccagcagtcgtcgccgagcagcttcatccccgagggcaccaggaaccatccgcaccnccgtcgcgtccagcagcagcgccgccatcagaccgaaggccaggtacttcatcagcaccagatcggagaacacgaacgaactggcgaccacggccagcaccatggcggcggccgtgatcagccgcccggtggtcgcggtgccgatccggatggcctcggccgtcgacatgccgcgctcgcgcgcctcgaccatccgcgagaccaggaacacctcgtagtcggtggccaggccgaaaccgacggcgacgaccagcgcgatcaccaccaccatcagcggcgtcggggtgaagttcagcacccccgacaggtgaccgtcgacgaagatccacgtcaggatgcccatggtcgagcccagcgtgagcgcgctcatcaacaccgccttgatcggcagcaccaccgacccgaacgccaggaacatcagcagcagcgtggcgcccagcagcagcaccagcatcaacggagccttgtcgaacaggctgtgaatgctgtcctgctcgagtgccggcgtgccgccgacatacaggttcaggcctttcggcgggttcaccgcccgcagttcggcgatcttcttggcggcatcattgcggttggccaggccgttctggatcacccgcaccgagccgtccttgggcaccgtggtgccgttcgggccggggacgcaggggttcccggcgatggtcgggcagggccgctcctgccaggtcttgtcggtgaagccgccgatccccgagatccggttgcggatgtcggccacctgctggtcggtgaccttgctgtggttgtcgctctggatcaccacggtcagctgctcggtgcggtagccggggaattgcttgtcgaagtgttcctgggccaggcgcaccggattgttggggggcaggtacttctcgctcatgccgccgaacgacaggttgcccagcgggatgaccagcaggatcatgcccacggcgatcgggatggcgaaggccagcggcttgcgcatcacccagttgaccagcttgccccagaagccggcctcgacctcttcgcgggttttggtcttctgcagccggtcggccagccagttgaggtaggcccgcgaatacttccagttccgcaggaacggcacccggaacgccgtccgcacccccagcgcgtcgacgtggcggcccagaatgcccaggcaggccggcaggaacgtgatcgacagcagcgcggccaggcccaccgcggcgaagatggcgtaggtcagtgagtgcacgaagccctgcggcaacaccagcaggctggcgctcgacgcgatgatcagcacggccgagaacgtcactgtgcgcccggccgtcatcacggttcttcgcaccgcggcctcggtgtcgtagccctcggcgatctcctcccggaaccggctcaccacgaaaagcccgtagtcgatcgcgatgcccaggccgatcagcgacaccaccggctgggcgaagtagtgcaccggcccgaacacggcgaccagccgcaggatgcccagcgagccggcgatgctcagaccgcccacgatggccggtaggccggcggcgaccgcgccgccgaacaccaggaacagcaccaccgccaccatcggcaccgcgaggacctccatgcggcgctggtcggtggcgatggtcccggtcagcgcgttggcgatcggctccagcccagcgagctgcacggcgccgccgttgagcttctgcatatccggggcgatggccttgtagttgttcaggatggtgtcgtcgtcgtcgcccttgagcgggatggacacgaaggtgtgcttcttgtcctcgctgaccatgcccttgatcaccgggttggtgctgtccggcgccgccagccagccggcccacccgacgacctggtcggggtggtcggctttgaacttgttcagctcggcgacgaccttgtcccgccagcccgcgtcgtcgacggttttcccgtcgggcgtcgtgaaggtggccaccacgtggctggtgcggtcgcggccgtaggtctggtcgccgagcaccgacgccttgacggactggctggcgtcgtcgtagaagccgctctgggtgacgtgcttgcccaggctgatgccgaaaacgccgccgagcaggcacagagctaccgtgaccccgatcacgatgtaccgataccggtacacagttcgaccccaccaggcgaacacgcaagctccttactggatcgacttagtctgcagcgacccacgcatcggttttccagtgtcacacacgcgcggtcaacagcgcggacagcggccggaacggctgcaaccacgcaccctggtcaggcagcgaatctaggccgatccgcggcaacggctcccggaagacaccggagatgtcctccagatcaacgaagtccaaggtatccgacgctagcgcccaactcgcatgttcgcgaaatccgatcaccgcgacgctgaccccgctgcgggcgatctcctccagcggttgacggaacgcctgaccgtcggccgacgccaccaccagcgcggccagcccctcggtgcgccgcagctcgatgtgggccagcatgtcgcggtcgacgtcgctgtcctcgtcgatcttgggcttggcgaacaccgcgaacccgacgttgcgcagggcgtccacccagggccggacgacctcggcgctgcccggcgcgatgttggtgaagacggtggcctccggttccaccacgacgcccgggcgttcggcgctgacctcggcggtgcgggccagcagccagcgccccagggcgtcgaaccgcgggcgctccaacgcggtggggcgccggcccaggatcgagcccagccccatgtcgaggttgggggcgtcccacaccagaagcacccgtccgcccgggggcgggaagccgcccagcgcgtcaccggacagcaccgccggcggcgcgacgggttcggcgcccgcggcggtcgcttcagtcaggctcatacctcatcgcctactcatctcgtcgaagctgttcaccgtctaagccaaatgaattcggtgaccgcactgcccgcgtcctgagccttcgtctcgtacttggtggtcgggcgggcgaccgagatcggcagcgggctgtccgggttggccgggcgcagccggggctcgcccgcgccgacgtcggcgatgtgctcggcgtagccggcgtggtccgtcgcgacgtgcaggacaccaccagggagtagccggtcggcgatcaggccaaccgtgcccggctgcaggaaccttcgtttgtggtgccgcgccttgggccacggatcggggaagaacacccgcaccccggtcagcgacgccggcgcgatgagccgctgcagcacgtcgagggcgttgccgcggatcagccggatgtttgtcacgttgtcgcggtcgatcgcgcacagcagctgcgccaggccgcgccggtagacctccaccgcgatcacatccacgccgggctcctccttcgccatcgcgagcgtggaagtgccgttgccacaaccgatttcgagtaccaccggggccttgcggccgaaccaggcgtcggtgtccagcggcggcccggggcggtcgggatcctcggccgggcccaccgacaggcccagttcgggccagcggcggtcccaggtctggcgctgggcgtcggacagggtggatcgccgggtgcggaacgccgtggccgggaaataacgctgctcggagcggtccggttgcccgatcggtgagtcggcaggcatcgtcaccccgtgctgcgcatgcatttgtccatggtggcccataaaccccggatgtagccgcccctggtccggattgatacccaacagttgccttgagctggtaactcatagacggtggctcgcatcttgacgacgtgagtgccaccattcggtggggccgcccgaccccggcgctgcacccggtagcggccgatcgatcgggcgatcgggtcattttcgaccggacaggcgggatatgaggggacaaggacaccagattttcgtcgacgaactggcacggtttgccgccgccgaggccgacccgcgggtgacggcgatcgcgcagcgcgccgccgcgccgctgcgggtggtggttcgcggccgccggggggtcggccgccgcacgctggcccgcgccctggaccgggccggacgcgcgaccggtatcgcggtgaccaccgacgcggccgacgtcgtggtgcacgtgaccgccgaggtggccaagcccgaagacacccaggccatctcgaccgcgcgcgccgccggtcacccggtgctggccgtgctgagcaaggccgatctggtgggctcgctgtccggccggggcggcgacgggccgatcgcggcggcgcgggcccggtgcgccgatctgtccgcgctgatcggcgttcccatccggccggcgatcggcctgctcgcggtggccgcgctggacgacctgggcgacgacctgtgggcggcgctgcgcacgctggccgccgaccccgcggcctgcctcgacggctcgatcaccggattcctgggcgccggggtcgacgtgccggccgcggcgcgcgagcggctgctggacaccctcgacctgttcggcaccgcgctggcgatcgccgcgatccgccgcggcgccgggccggcacagctgcgcaccctgctgcgccggatcagcggcgttgacgcggtgctggccgagatcggcgcgctgggcgccgaggtgcgctaccggcgggtgctgggcgccgtcgcggaactggaggcgctggccgtcggcggggccgcgctcggcgagcggatcagcggcttcttgtcccgggacgacaccgtggtcgcccgaatggcggcggctctcgacatggccggggacatggccggggaagtggccggggagacggcgccgggcgatccgtccggtcatctggcgcgagccgtgcgctggcagcgctacagccgggcgtcgggcagcgacctgcaccgcgcgtgcggcgccgacatcgcccggggatcgctgcggctgtggtcgcaggcctgcgccacgctgcccggcgaacggcccgtcgaacgggaggacccggcgtgagcggcgacaatccggccgccgcggtcgacgcgctggtggcagccgtcagcccggggctggatccgccggcggtgcaccgcagcgacgcggtgctggtgaccgggccgtggatggccggggtcaccgcggtggccgccgcgctgcaggagcggctgccgcagcacaagttcgtcgagtcgacggatctcggacccggcgaggtgccgaccgcggtggtgttcgtggtgtcggcggccgcgcacctgacaccctcggactgcgcgctgctggacgccgcgaccgaacacaccgacgcggtggtgggggtggtatccaagatcgacgtgcaccgcggctggcgtgaggtgctcgccgccaatcgcgacaccctggccgcgcacgcgccgcgctacgcccgggtgccctgggtgggtgcggcggcgctgcccgacgtcggcgaacccgacgtcgacgacctggccaagaccgtcgcggcgcaactcgacgacgccgatctggcccggcgaaacaggttgcgggcgtgggaatcccgcttgcggacggtggcgcggcggttcgaccgcgaggtcgaggcccccggccggcgggcccgggtcgaggcgctgcgcgaagagcgcagcaccgcgctgcagcagcggcgccaggccaaaaccgagcgcagcatcacgctgcgcggtcagatccagcaggcccgggtggcgctgtcgcactccgcgcgcaaccggtgcgcgtcggtgcgcaccgagctgcaggagcacgcggcgggcctgtcccggggcaagttgtccggcttcgaggcgcacacccgcgaccggctggccgaggtggtcgccgaggtcaacgacggcaccgacacgcaactggcggacaccgcgcaggcggtgggggtggcggtggacctgccggccctcgagcagctgccggcggtggaggtctcgccgccgccgctgaaatcacgccgacaggaaacctggctgatgatcctgttcggcgtcgggttcgggctcggggtggcgctgacgctgagccggctgatgagcgggctggcgtcccggctcagcccggcactggcggtggcggccgccgtggtgtgcgtgctgatctcggtggcgctcaccttcctggtgatcaacatccgcggcctgctgcgggaccgggcgctgctggaccgctgggcgggtgacgcgacggcgtcgctgcgctcggtggtcgaggagctggtggccacccgggtgctggtggccgagtcggtgctgagcaaggcgctgctggcccaggacgaggccgagaacgcggcggtgtcggcgtcggtcagcgccatcgacaccgagctgcgcgagcacgccctggccgccgcccgggcagcggccgcgcgggatcgggagatgccggcggtcacggccgcgctcgaagccgtgcgtgcagaactcggcgaaccgggtatacaaccgggcggaagtcccgccgaagatgccggcggtgcgaaaaccgaaaaacccgcttcgaggagcgaagatggcgaccggccgtgagcttctgaatcgttgttgtgagaaggcttatacctgcccgagacttccccgacaagttcctcacgataacctgtagttaacgccaccaagtccttaattttgtgggcgaaggcataccgagcatcagcccgatacgcaacgaagcaggagagttcgatgacctcagcgaccattcccggtttggacacagcacccacgaaccatcagggcctgctgtcatgggtgcaggaggtcgctgagctgacccagcccgaccgggtggtgttcgctgacggctccgacgaggagttcaaccggctggccgccgagctggtcgaggcgggcacgctgaagaagctgaacgagaagaagcatcccaactcctacctggcgctgtccgacccgtccgacgtggcgcgggtggagtcgcggacctacatctgcaccgaagaggaaagcggcgccgggccgaccaacaactggatggaccccacggaaatgcggtccatcatgaccgacctgtaccgcggctgcatgcgcggccgcaccatgtgggtggtgccgttctgcatgggcccgctgggcgtcgaggatccgaagctgggtgtggagatcaccgactccgagtacgtcgtcatctcgatgaaggtgatgacccggatgggcaaggccgcgctggagaagatgggcgacgacgggttcttcgtcaaggcgctgcactcggtgggggcgccgctggagccgggccagaaggacgtgccgtggccgtgcaacgacaccaaatacatcacccacttcccggagacccgcgagatctggagttacggctcgggctacggcggcaacgccctgctgggcaagaagtgctactcgctgcgcatcgcctcggcgatggcccacgacgagggctggctggccgagcacatgctgatcctcaagctcatctccccggagaacaaggcgtactacttcgcggcggcgttcccgtcggcgtgcggcaagaccaacctcgcgatgctgcagcccaccatcccgggctggcgcgccgagacgctcggtgacgacatcgcctggatgcggttcggcaaggacggccggctgtacgcggtcaaccccgagttcggtttcttcggcgtcgcgccgggcaccaactggaagtccaaccccaacgccatgcggaccatcgaggccggcaacaccgtcttcaccaacgtggcgctcaccgacgacaacgacgtgtggtgggagggcctggagggccagcccgagcacctgatcgactggaagggcaacgactggtacgcaggcaagacggaaacgcctgcggcgcacccgaattcgcgttactgcacgccgatgtcgcagtgcccgatcctggcgccggagtgggacgacccgcagggtgtgccgatctcgggcatcctgttcggcgcccgccgcaagaccacggtgccgctggtgacccaggcccgcgactggcagcacggcgtgttcatgggcgccaccatgggcagcgagcagaccgccgccgccgagggcaaggtcggcaccgtccgccgcgacccgatggccatgctgccgttcctgggctaccacgtcggcgactacttccagcactggatcgacctgggcaagaactccgacgagtccaagttgccgaaggtgttcttcgtcaactggttccgccgcggcgacgacggcggcttcctgtggcccggcttcggcgagaacagccgggtgctcaagtggatcgtcgaccgcatcgagcacaaggcgggtggccaggacaccccgatcggcatcgtgcccaaggccgaggacctcgacctggacggcctggacgtcagcgtcgacgacgtcgccaaggcactggcggtcaaccccgacgagtggcgcgaggagctgccgcagatcgaggagtggttcgagttcgtcggcgagaagctgccgaccggcgtccgcgacgagttcgaggcgctcaagcagcggctgtccgaagccggctgacccggctcagcccgattcagccggcggttcggcgggccttcttctcgacgtacatcagctcgtcagcgcgggccagcagttcgtccacgctggcggtgtcgaagaccggtgcgcgcaccaggccgacgctggccgagagccggtagggccggtcaccggtcgcgttgaaagccgcgaacgcctcggcgagccgctcccgcagcggggcgctgtcctggtcgctttcggtgaccatcacgcagaactcgtcgccaccgatgcgggccaggatgtcggactcgcgccggatgctgcgcaacacctcggcgacgtccttgatcagcatgtcgcccgcgtcgtggccctgctcgtcgttgacctgcttgagcccgtcgacgtcgagaaaggccagcacgcaggcgtggcccagccggtgcgagccgctgagcttctgcccggccagcaggtagaagccgcgacggttgttcagcccggtcagttcgtcggtcacggacagccggcggatctcctcgttggcccgctccagcgcggcggtgcggtcgcgcacccgctgctccatctccgagtagatcgcgacgttctacatggccatcgaagtcgagtcggccagcgcctgcagcaggcgcacctcatgctcggacggctgatgcggctcggcccagtagttgccgatcgcgccgatcgggtccagcttgcggatcggcaccatcaccaggctcttgacgaaggtggggcggtacagggtgtgcgggatgcgcgggtcgcggtagatgtcggggatcaccgccgcgtcgcggttgagcatggcccatccgctgatgcacgacgtcatcgggaagcggctgcccttccacagcggcgcgatcgcgtcttcgtcggcgtagtagcaccggtcgttgtcgcgcagcacgaaggtggcgccgtcgcagccggtgagctcgcgcgctgaggagcggacgatgcgctggatgtccggcaggctgcgcgccagggacagttcctgaaccgcgtgcaccaaacgctccatcccgtcgacgtagtcgtagacggcgaagcggctcgatccagatgcgggaggttgcgagacctgctcggcggtcatccccacctccggtgcgaaagcggcgtacccgccaaggctagcttttgacgtcgacgacagtgtaagtatcggcgccgtcttcggctcgccgaccggcttgccgaccacttgacacccgtcaagtttgccggcggtacagtctgcgcatgcagatccgcgagtatctcggcgccggcaagcccgccgtcatcctctacccgtccggcacggtcgtcacgttcgacgacctggaagcgcgcgcgaatcggctggcccaccggttccgcaaggcgggtctgcgcgagggcgacacggtcgccatcctgatggagaacaacgagcacattcacgcggtgatgtgggcggcccgccgcagcggcctgtactacgtgccgatcaacacccatctgaccgccgccgaggccgcctacatcgtcgacaacagctcggccagggcgatcgtcggttcggcggcgttgcgcgacacctgcgcgcggatcggcgagcacctgcccggcggtctgccggatctgctgctgatggccgacggcgacctcgacggctgggagcactacccggaatgcgttgccggcgaacccgatacgcccatcgacgacgagctcgagggcgacctgctgcagtactcgtcgggaaccacgggacggcccaagggcatcaaacgcgaactgccgcatgtccatccggccgaagccccaggcatgatgtcggcgctggtcggcttctggatgacgcccgagtcgatctacctcagcccggctccgctgtaccacaccgcgccgtcggtgtggtcgatgagcgcgcaggccggcggcatcaccacggtggtgatggagaaattcgacgccgagggctgcctggacgccatccagcggcaccgggtcacgcacggccagttcgtcccggcgatgttcacccgcatgctgaaactgcctgaagccgttcgtcattcgcacgacctgagcagcctgcagcgggtgatgcacgcggcggcgccctgcccggtggagatcaagaagcagatgatcgactggtggggcccgatcatcgacgagtattacgcctcctcggaggccatcggctcgacgctgatcagcgcggaggagtggctggcccatcccggttcggtgggcaaaccgatggcctgcgagatccacatcctcgacgagaacggcaacgagctgccaccggggcaggcgggcgagatctatttcagcggagggtattccttcgaatacctcaacgatgaggccaagaccgccgcttcccgcgacaagcacggctgggtcaccgtcggcgacgtcggctacgtcgacgaggagggctacctgtacctgaccgaccggcgccaccacatgatcatctccggcggggtgaacatctatccgcaagaagcggagaaccttctggtcacccaccccaaggtgctggacgccgcggtgttcggggtgcccgacgacgagatgggccagcgggtgatggcggccgtgcagaccgtcgatcccggcgacgccaccgacgaattcggcgccgagctgctgtcctggctgcgggatcggttggcgcactacaagtgtccgcgagcgatcgcattcgaggagcagctgccgcgcaccgacactggcaagctcttcaagaacgggctgatcgagaagtattcggtgtgaccgatgctgcgggtggtcgacctctccagcgcgccgcaggacggccccgcctcaccgccgggtgtgatcgtcgccgtcggatcggctgaccagattgcccggtccgaattctggctcgaggcagcgactttcaccctcaccgaagacgcctgcacggaccgtcgcgccgtcaccgtcgattcggtgtccacgtcgctggacgagctgacggcacgctgccggcggtggccgcacgccagcgcgatctgcgacgacgtgttgcgcgcggtggatcccacggcgccggcggcgcgggggctggtgactgagtcgctggcgtattcgacgctgcaggccggcccggagttcgtgcgctggctcgacgagcgcggcccggcccgcatgcccgagatcgccgacccggtgctcgctcggcgcgacggcgacgtgctgcggatcgcgttcaaccggccgcaacggcacaacgcgttctccaccgatgcgcgcgccgcgctgctggaggcgctggcggttgcccagctcgacccgtcggtgaccggaatcgtgttgagcggcaacggcccctccttttgcagcggtggggatctcgccgaattcggcaccttcgccgatccggccagcgcgcacctggcgcgcacccggcacagccccgcgctggtgctcgacgcgctgaccgcccggttcggccgggcgtgccgcgccgaggtgcacggccgggtgctgggcagcggactggagatgtcggcgttctgcgggtgggtcagcgcccgggacgacgcggtgttcgggctgcccgagttggcgctggggctgatccccggcgccggcggcaccgtcagcatcacccggcggatcgggcgttggcgcacggcgtatctcgtgctgtcgggccgcacggtcggcgccgcgaccgcgttgtcctgggggctggtggacgaggtggaagcggcaacggcctcgtcgtaatccgttgtgtcactgtggcttggagtggccacagggcggcggtttttgtcggtcccgttcctacacttacgcgaggacgacgaccccgtttgacgtcggaagcccgaataggtggtggtggtcgtcgacggcaggtgcgagaccacgaaaaccccggcgacgacgtagatgagcacgaagatcacggcggcgacggcgcccacgatggcaccgatgatggcccacttcttggcgttgttggccgcctcctgcgcctcggcgtagcggccctgcgcccacagcccggagaccttggtggagtagacgatcgacacgatccccaacggcaggcagcacagcacggtgcacaggatcgcccagaccagatagttctccggctccggcgcgacctgccagccgggctggggcgggggccaggacccgggctgctggccctgccacggcggttgctggccttggccttccggctgctgccattccggttgctggccttgccattccggcgaacctccgggcggcgcggggggattagtcatggctgctgcctttcccttcggttcagaagtcaggcaaatatactcccaaactttgcgggtcggccccgattgcgccgtcagatcccgccgcgggtcaccagttgccgggcaatcacgttgcgctggatttcgttggtgccctcgccgacgatcatcaggggcgcgtcacgaaaataccgttcgacgtcgtattcctgtgaatagccgtagccgccgtgaatgcgcacggcgttcagcgcgatctccatggcgacctcggaggcgaacagtttcgccatcccggcttccatgtcgcagcgttcgccgctgtcgtaacgttcggcggcatagcgggtgagctggcgggccgcggtgagcttggtcgccatgtcggccagataattcccgaccgactgatgctgccagatcggctgcccgaaactctcccgctgctgggcataggccagcgcatcctcgagcgccgcggtggcgacccccagcgcgcgggcggccacctggatgcggcccgtctccagacccttcatcatctgcgaaaaaccctggcccgcaacaccgcccagcaccgccgtcgcaggcgcccggaaattgccgaaggacagctcgcaggactcgacgcccttgtagcccagcttgggaaggtcccgcgacaccgtcaggccgggcccgtgctcgacgagcaggatcgagatgcccttgtgccgcggcgtcgccttcgggtcggtcttgcacagcagggcgatcagaccggaacggcgggcgttgctgatccaggtcttggccccgttgaccaccaggccgtcggagtcggggtcgggcagcgcggtggtcgacatgttctgcaggtccgagccgccgccgggctcggtcaacgccatggtggcccggatttcgccgctggccatccgcggcaggtaggcccgcttctggtcctcggtgccgaacagcgttagcagcttggccaccacggtgtgcccgcccatcgccccggccaggctcatccagccgcgcgccagctgctcggtgacccgcacgtagcacggcatggacaccggcgaaccaccgtattcctcgggcaccgccagcccgtagatcccgatccgcttcatctgctcgatccacgcctcgggataggcatcggcgtgctccacctcgcgcacggtcggtttgacctcgcggtcgatgaacgcccgcaccgtggcgaccagcatgtcctcttcgtcattcacctgtgcccacctcaccgattcgcgccgaacgtcgacttgctgggcgaaaacccgcgaattggcgcccacaagtcgacgttggggtccgatccggattgaccctcgattccacagcctaccagcatgtggcgttgtgaccagtgacgggtatgcgcgaattcgcgagggtggaccgtacttcgacgacctctcggtggggcaggtgttcgactgggcgccgtcggtgacgctgtcgtccgggttggccgccgcccatcaggcgatcctgggcgaccggctgcgcctggcgctggacgccgatctgtgcgcggcggtgaccggcctgcccgcgccgctggcccacccggggctggtgtgcgacgtggcgatcgggcagtcgacgctggtgacccagcgggtcaaggccaatctgttctatcgcggcctggtgttccaccgcttcccggtcatcggcgattccctctacacgcgcaccgaagtggttgggctgcgcgctaattcacccaagccgggccgggcccccaccgggatggcggcgctgcggatgatcaccatcgaccaggccgaccagttggtgctcgacttctaccggtgcggaatgctgcccgccagcccggaattcacggccgaggctggttcggtgccgcacgacgacctgtccggcatcggcgccgacgtgcccggcccggcgcacgatcccaccgcgcaatgggacggcgcggtcttccgcaccgaggtgcccggcccgcacttcgaccgcgccctggcgggttcggtgctgcacagcaccggcgacgtcgtcagcagcgcacccgaactggcccggctgacgctgaacatcgctgctacacatcatgattcacgcgtcggcggccggcgcctggtgtacggcgggcacaccatcggattggcgctggcgcaggctgcccggctgctgcccaacctggtgacggtgctgggctggcggtcctgcgatcacaccgggccggtgcacgagggcgacaccctctacagcgaactgcacatcgaatccgcccggcccaccgaacatgggggcgtgctcgggctgcgatcgctggtgtacgcggtcagcgacacaccggacgagccggaccgcgccgtgctggactggcggttcgacgcgctgcagttctgagccgcacgcccgcgagcaccgccatgagcacggccgcgagcacggccccgagcacaatgggtgacgtgagcgcggccgcgaccgactggggaggtagcgggctggcctatctgaccggcctgcccaacggccccgccgacttctcccgcgcccccgtactgtcccgggcgcaccaggtggcggcggccatcggggcccggctgggcgtcgacgccgacgcggcggtcctgctgagcgggcgggccgccctgctcgggctgcggcgcgccggtcaggtgtcgcccggcggggccacccggctgctggcggcccgcgacggctactgcgcgctcaccctgtcccgcgccgacgacctggccgccgtcccggcactgctgcaggtcgacgacgtggccggcgacccgtggccggcgctgcggtgctgggccgccggccgggccaccgccgaaatcgtcgagcgggcggcgctgctcgacatccccgcggcggcgctgggcgaggcgcgcccggccgccgaacacatccagccgaccgcaccgggcggcgcgccgcgttcgccgcgcggcctgctggtcgccgacctgtcctcgatgtgggccggcccgctgtgcgggcagctgctggcccgcgccggggccaccgtcgtcaaggtggaaagcccacgccgccccgacggcacccgggccgggaaccgggccttcttcgactggatgaatcacggaaagctctgctacggaatcgatttcgaccgcgacgccgaccaattgcgcgagctgctcaccgtcagcgacatcgtgatcgagggttcccggccggcggcgttgcgacgtcgcgggctcggaccggccgatatcgcgcctcggcccgggcgaatttggctgcaaataaccgcttttgacgacgatcggccgggcttcggcgatgacgccgcggtgggcggcggcctggtgggcaccagcgccgcggggccggtgttctgcggcgacgccatcgccgacccgctgaccgggctgcaggcggccctggcggtggccgaatcgctgggccgcggcggcggcgaactcatccggctgtccatggccggtgtcgccgccggctacgccgcgctgggcaccgagccgccgacgtcggatgcgccggtgtcaccgccggcgccgccgccgccgtcggggccggcctccgcgctgggcgccgacaacgccgccgtgcgtcacctggtcagccaaaggcgttgcctgtcatgctgattcagcgggccaccctgctggacgggacggcggccgacatccgggtgggcgcgcggatcgaggaggtggcgcccgcggatgatggcctggcggccagggcgggggagggggtgctttacgccggcggcggcaccgtgctgcccgggctgcacgaccaccacgtgcacctgcgctcggctgcctcggcgctggattcgttcttcgtcgggccgcccggcgtcagcacccgcgccgagctcacccggctgctggccaacgccacgcccggacccgacgggtggatccgcgccgtgggctatcacgattcggtcgccggcgcgctcgaccggaccgcgctggatgccatcgtgcgcgacgtcccggtccgcatccagcaccgcagcggcgcgctgtggatcctcaattccgaggcgctgggccggatcgggctggccgaacacccggacgggcggctgcgcagcgccgaccgcggctggtcgcaggcgctggcgcaccgggagaccgacctggccgagctcagccgccggatcaccgcgaccggcgtcaccggcgtcaccgacgccacccccgacctggacgacgacgaccgggccgcgctggccgccgcccacgcgcgcggcgaattccggccccggcccagcttcctctcgccgggcaagaagatcctgcacgacgaccgcctcgacctcgacgccctcacggaatgggttgccggacagcacgacacgggccagccggtcgccgtgcactgcgtcaccgccgctcagctggtggtggccatcgccgccctgcgggcggccggcacccacccgcgggaccgcatcgaacatgccgccgtggtgcccgacgacaacctggccgatctggccgaactcggggtgaccgtggtgacccagcccaatttcgtcgccgagcgcggtgatcagtacctggccgaggtgcccgccgacgagcacgaccagttgtggcgcctcgcttcgctgcgcgacgcgcgggtgcccgtcgcgctgtccaccgacatgccgttcggccacggcgacccgtggacggcgatgcgcgccgcggtgcaccgcaccacgcccagcggcgtcgtgctgggcacacgcgaatgtgtctcggcgcgaacggctttgacgatgtttttgggccaggccgaccagccggaccgggtgcgcagcgtgcagcccggcgagccgggcgacctgtgtgtgctcaacgagccgccgcacaccgcgctggccgaactggacgccggcatggtggccgccaccatcatcggcggtgagctcgtctacttcgcgatgtgacctcagccggccggcgtcagcgcggcccgcaggctgttgcactggctgtcgaaaaaccgctgcgacacttgaactttcggcaaaatcaggtcgaagccgtggaaggcgccggggatggtctccacctggcagggcaccccggcggcccgcagccgttcggcgtaggcgaggtcctcgtcgtgaaacaggtcatgggtgcccaccccgatccaggccggcggcagtccgctgaggtcgtcccgccgggcgggcaccgcgacgtgcgggtcggcgtcgccgaggtaggccgcccagccgaacctgttgctgcggttgtcccacagccgatagttcgggctgggcgcggtgtccgagctgcggtcgtcgagcatgggataggtcagcagctggaatgcggggctcacctcggcgcggtcgcgggccagcagcgccagcgccgcggccaggccgccgccggcgctggccccgccgatggcgatgccgtagcggtccaccgacggcagaccggccagccaggtcagcgccgtatagcagtcctccagcggcgccggataccgatgttcgggcgccaggcggtaatccaccgatgcgaccgtgatgcccagccgtcggctgaaccggctgcacagctggtcgtcctgctgggcggtgcccagcacgtagccgccgccgtggatccacagcagcgcgggcgtcgtctccgcggcgccggcgggccggaacaggcggacccccaccccggaaccgagcgtgatcacctcgacgtcgcggaccggcttgcccagccgcccgcgccaggcaagcgccacccgcatcagcggcagcgttcgcgggccgaccagtcgtcgcggcgcgaaccgggcaaatcgttgcaggtcaggatgaacatcgttgttcggcaccggatcagtatcaccgacggccaccagcggggcaccgctatagggcgaggcgatccgcgaaccggcccgcccgacggccgggtgatcgccggccgcaccgcgccgtgagcgtgtcgcgcagcgaaatccgctccgcacagcgaaccgccgaatcggtttcaacagcgtcgataccgcgcacagcgatcccgccgggcaaagccccgcggcgccggcccgcgggtgtgggcaatcgcccgtttcgcggaccgggacgggggtacagttccggccatggcgccgggcatgactccctacctcaagtggctgctgcgggcccgccccgccgactatgcgctggccgtgagcctggccggggcgtcgctgccggtggtcggcaggcacctcgagccgctggccggcctgacggccatgggcatgtggggcgcccggcacgcacccgaggtgatctcggcggccacccgggacatgttcgccccgggtggcggcgacgcgcggcgccgggaccgggagagcacccagcaggtctccctggcggcgttgcgcgggctggtatcggccgccgagctggagagccagtggccggtggcccagcgcaccccgccgatctgggacggcgtgcgccggcaccgccacctgtatcggcgcgccgtccactacggccaccacccggcccaggtgctcgacgtgtggcggcgcaaggacctgcccgcgcagcccgcgccggtgctgatcttcgtgcccggcggcgcctgggtgcacggcaagtccatgggccagggctcggcgctcatgtcgcggctggccgaacagggctgggtgtgcctggcgatcgactaccgggtggccccgcaccaccgctggccgcgtcacatcgtcgacgtcaaaaccgccatcgcctgggcgcgggccaacgtcgacaagttcggcggcgaccgcaatttcgttgcgatagcgggatgttcggccggcggccacctgagcgcgctggccgggctgactcccgacgacccgcagtaccggggcatgctgcccgagggcgccgacacctcggtggacgcggtcgtcgggatctacggtcgctacgactgggaggaccgctcgacgccggagcgggtccggttcgtcgattttctggagcgggtggtggtcaggaagtcgatcgcccgtcatcccgaggtgttccgcgacgcctcgccgatcgcccgggtgcaccgaaatgcgccgccgttcttggtgattcacggcagcaaggacagcgtcatcccggtcgagcaggcccgcagcttcgtcgagcggctcagggcggtatcgcattcgacggtgggctacctggagttgcccggcgcgggccacggatacgacctcatcgacggcgagcgagccggtgcggcggcacacgtgtgctcgctgttcctcgatcaggttcatcgcagcaagacacggatcggggcaaaagaggtcatctgagctgcctgcgctgagtatggtccctctatgggtaaggggcggcggtgaagaggcttagcggctgggactcggtactgctgtacagcgaagcaccgaacgtgcacatgcacaccatcaaggccgccgtcatcgaactggacgccgatcggcgctccctggacgtcgccgcgttccggcaagtcatcgccggccggctgaacaagctcgatccgttctgctaccagctcgtcgaggtcccgttcagcttccaccacccgatgtggcgggagaactgcgagatcgacctcgactaccatatccgcccgtggcgggtgtccccgcccggcggccgacgcgaactggacgaggccatcgggcagatcgccagcacgccgctggaccgcagccgcccgctgtgggagatgtacttcgtggaaggcttggccaacaacaggattgcggtggtcggcaaaatccaccacgccctcgccgacggtgtcgcctcggccaatctgctggcccgcggcatggacctgcaacccgggccggagggcgggccgtatgtctgcgatccgcccccgaccacccgccagctgatggtgtcggcgttcgccgatcacctgcgccacgtcgggcggctgccgcacaccatccggtacaccgcccagggtttgggccgggtgcggcgcagcgcgcgcaagctgtccccggaactgacccggccgttcgaaccgccgccgacgttcatgaaccacaagctcaccccggagcgccggttcgccaccgccaccctggcgctggccgacgtcaaggagaccggcaagcggctcggcgcgacgatcaacgacatggtgctggcgatgtcgacgggggcgttgcgcaccttgctgctgcgctacgacggacaggcccagccgctgctggcgtcggtgcccgtcagcttcgacttctccccggagcggatctccggcaaccgcttcaccggcatgctggtggcactgcccgtcgaccacgatgacccgctggagcgggtcgccgcctgccaccaaaacgccatctccgccaaggaaagtcaccagttgatgggccccgagttggtcagccggtgggcggcctacatgccgcccgcacccacccgggccttcttccagtgggcgtccgcccgcgacgggcacaacaagatcctcaacctgaacatctccaacgtccccgggccgcgggaacgcggccgggtgggcggggcgctggtcaccgagatctactcggtgggtccgctgaccgccggcagcggcctcaacatcaccgtgtggagctacgtcgatcagctcaacatctcggtgctcaccgacggggccacctgcaaggacccgcacgaggtgaccgaagccatggtccaggacttcatcgaaatacgaagggccgcaggtttttccgaagacctcacggtcgtcgaggcggcgatggcaccggcctgaccggtccgctccggccgccgttcagctccggcggtaaccggaatctcggggtacgtcaacgccgttccggccgaccgttaccatcggtccgacggtcgcagttggtgcgccaccgatacccgaaggagctgtgcggcacgtgagcactgggaacgaagaagccggcgaacccgaggtcctggtcgaacaacgggatcggatcctcatcatcacgatcaaccggccgaaggccaagaacgcggtcaacgccgcggtggccaacggactggccgccgccgtcgaccggctggacaacgagcccggtctgtcggtcggcgtcctgaccggggccggcggctccttctgcgcgggtatggatctgaaggccttcgcccgcggcgagctgcccatcgtcgagggccgcggcatgggtttcaccgaacgcccgccggccaagccgctgatcgcggcggtcgagggttacgcgctggccggcggcaccgagctggcgctggccaccgacctgatcgtcgcctccaaggacgcggccttcggcattccggaagtcaagcgcggcctggtcgccgggggcggcgggctgctgcggctgccgcagcgcatcccgtccgcgatcgccatggagctggcgctgaccggtgacaacctcagcgccgagcgggcgcacgcgctcggcatggtcaacgtgctggccgagccgggtgccgcgctggacgaggcgatcgcgctggccgagaagatcgcggcgaacgggccgctggcggtggccgccaccaagcggatcatcgtcgagtcccgcggctggagcccggagaccatgttcgccgagcagaacaagctgctggcccccgtgttctcctccaacgacgccaaggaaggcgccatcgcgttcgccgagaagcggccccccaagtggacgggcacctgatcggtcccgggcggtgatctaagctacagtcggacatgacacttttggccggctttttgtaacgtgctgacaccgcaggaagaccgaggatgagcatttcgctgctgctcgagatggccgcgtcgagcaacgccgagcgcacggcggtggtctcgcaagacgtgcggctgaccacccaagagctcagcgatctcgccgacggcggcgcggcggtggtggccggttcgaacgccaagcacctggtctacgtgggcaccggcggcgtgctgctgccggtgctgatcttcgccgcggcgcgcgccggggtggccttcacgccgatcaactaccggctctccgccgagggcatccgggcgctgatcgagcggctgcccgagccgttggtggtggtcgacgcccgctaccgcgacatggtcggggaggcgccgggcggggtcatggactccgacgacttcctggccgccgcccgcgccgccgagcccgccgcggacgcgtttgccgacccggactccgtcgcgatcgtgctgttcacctcgggcaccacctcgcagcccaaggccgtcgagctctcgcacaacaacctgaccagctacatcaccgggaccgtcgaattcggggcggccgacgaaaccgacgccgcgctgatctgcgtcccgccgtaccacatcgccggggtcagcgccgcgctgtcgaatctgtatgccggccgcaagatggtgtacctgccgaatttcgatgcgcgggaatgggttcggctgatcaacgccgagaacgtgacgaccgcgacggtggtgcccaccatgctcgaccgcatcgtcacggtgctggagaacggcgacccggacaccggggcgccgatcgagctgccgtcgctgcgcaacctggcctacggcggctccaaggtcggcctgccgctggtgcgccgggcgctggagctgctgccccacgtcggcttcgtcaacgcctacggcctcaccgagaccagctcgaccatcgcggtgctgacccccgacgaccaccgcgcggcgctggcggcgaccacccccgaggccgcgcggcggctcggatcggtggggcaggcggtggccggcatcgagctgcagatccgcgacgaagccggaaatgtgttgccgcccggggaaaccggggaactgttcgtgcgcggcgagcaggtctcgggccgctacaccgggatcggctcggtgctcgacgaggacggctggttcccgacgcgcgacatcgccatgctcgacgacgagggctacctgttcatcggcgggcgcagcgacgacaccatcatccgcggcggggagaacatcgcgcccgccgagctggaggaggtcctggtcgagcatccccacgtgcgcgacgtcgcggtggtcggcgtcgaggacccgcagtggggccaggccatcgtcgcggtggtggtgccggcggccggtgtcgaccccgatcccgaggaattgcgcgagttcgtccgcaagagtttgcgcggttcgcgcacgcccgacgaggtagtgtttcgcgacgagctgcccaccaccgccaccggcaaggtgttgcggcgggagatcatcgcgaccctagccggattgcgcgccgcaccggcccagcagtaagcgatcaaggacggaaatcaatgatcaagaacgggaactcgtctcgccagccaggtgtgcgacacccaggtgatcgtcgtcaggagtgcggacagcctcgacgacctgcgctgcggcggggtgccgatggtcccggtgggtgccgagcgctccggtgagttggacccgtcgttcgccgacggcacggtgatgggcaagcgttacgtcgacgagaccggcgccgaggtgctggtgaccaagccgggcgcgggaagcctgagcatcggccagactccgctgcagctcaaagaggtcaagccgctaccggccagcgactgagtcaccgcgagccgggttgcttgcccgggatcttgttgcggacgacgaattcccttgcctttatcaggaattcgagttgctcgccgacctgatgtagcgggccggcgttgcgggtcgagcgggacagcacgatgccgccctccagcgcggcgatcgacatcacggccagcgacgcggcgtcggcgtcgtcgaagccgtcgttgacgaaggcgcgggtgagcgcggtgcaccagcggcccaggatggcgccggcctcggcggacagcttggggccctcgtcctccgagcagccgatcgccgcggccacgaccggacagccggcggtgaagccgccctcggtcagcagccgctcccagtattcgacgaactcgcgcagcagcgcccggccgccgcggccggccgcctggtcgatgagggcggtgatcgagtcacccgaatagcgcagcgcctcggccaggatctggttgcgtccgtcggggaagtggtagtagaccgagccgcgcggtgcgccgctgcgggccagcaccgcatcgatggtcacgccggcggcgccgcgctcgcgcatcacctcggcggcgctggccagcatcttggtccgggtgcccccgcgcttggcggggcctgctgcttggtggtcggcacggtcagtgagtcccgggccggcgtcaggccgcgtgcgaatgccgcagtgccggccagtgcatgtgacgtgggctgaagcggaaggtgcggcgccgcaagtcgggcatctcgcgggtgaattggtagcccgcgacgttgagctcaatgatccacatgattggtatctcccggcctgtgtgcagcccttgattatgctaagaaccatataagacgcccgtaaattaagcaatttctcaggcgcaatgtgacgtataccgcacaaatgcgccggccggcgggccgccccgctcgcttacgccctggtaaacggcccgaaaatatgctctattgcataatcgtggcgagccggtgccgcccccgaaacgccgaacgtgcactcacggcgaaaaaccggcaggaaattcgcgctgagtgcacgttggggggcgcgggcaggcctagccctcgagcgtgtagcccatcggcatcagcacgctcttctgctgcgtgaagtgctcgacaccctcgggcccgttctcccggccgatgccggagttcttgtagccgccgaacgggcaacaccggtcgaacgcgtaccagttgatcgcgtacgtgccggtacggatcttctccgacaccgcgatgccccgctgcacgtcggcggtccacacgctgccggccaggccgtacaccgagtcgttggcgattttgatcgcgtcctcctcggtgtcgtaggggatgatcgacagcaccggcccgaagatctcctcctgggcgatcgtcatcttgttgtcgacgtcggcgaacaccgtcggctgcacgaagaagccgctgtccagaccctcggggcggccgccgccgcacaccagccgcgcgccctcctcgatgcccttggcgatgtagccctcgacccgcgcccgctgcttctcgctgatcagcgaaccgatctgggcggccgggtccgacggcagacccaccggcagcgactgcacgaaagtgctgaccgcatccacgatttcgtcgtagcgcgaccgcggggccaggatgcgggtctgggcgacgcaggcctgcccgctgttcatgatcccggagaacaccagcatcggcagcgccgagggcaggtcgacgtcgtcgaggacgatggccgcggatttcccgcccagctccagggtgcacggcttgagcatgtcggcgccgcgacggccgatctccctgccgaccgccgagctgccggtgaaggagaagatgtcgacgtcggtgttggacgtcagtgcctgcccggtctcgatgccgccgggcaccaccgacagcacgccctcgggcagccccgcctcggcgaaggcctcggccaaagcgtttgcgctcagcggtgtttcggccgccggcttgagcaccaccgtgcagccggccagcagcgccgggcccagcttgttgacggccaggaacagcggcacgttccaggcgacgatcgcgcccaccacgccgatcggctcgcggtgcacgatgctttgcccgtagccgccggtgcgcacctctttccacttgacctggtccaccgccggaccggcgaagaagttcagcgccccgatggagctcatccagtgcatcgtttccacgctggtcggcggctggccggtctcggcggcgagcagcccggtgaacaggtccttgcgctcctccatcaccttgagcgcgttggcgatcacggccgcgcgctccttgggcggggtggtcggccacgggccgttgtcgaaggccgcgcgggccgcggccaccgcggcgtccacgtcggccgccgcggccagcggcaccttgccgacgtactcaccggtggccgggcagtgcacctcgatcacctcggaggtggacggttcggtccacttgccgccgatgaaaagcttgtcgtattcggtcttggcctgagtctggatgtcgctcatgggcgccaccctacccaagccgaggcaaaacgagaacacgtttcactattggggttgcaggaccagcaccagattgctgaccaggaactcgcgcagcaccgggacggaggtcagcgaccacgcccatcgtgggtggtagcggggaaatgcggccagggcggcgccggtgctcgccgcccacgccaggccgtcggccaccgacacctcgaacaacgacgacccgtagttgtttttggccggatggccgtgcttgcgggcgtagcgctcggcggcgcgggccccgccgaggtagtgggtcaggcccatctcgtggccgccgaacgggcccagccacacggtgtaggagagcaccgccagcccgccgggcctggtcacccgcagcatctcggcgccgagttgccagggccgcggcacgtgttcggcgacgttggaggacaggcagatgtccaccgagtcgtcggcgaacggcagcgccatgcccgaggcgcgcacgaacgtgcccgtgtcggcggcgacgacggggccggccgcgtgcatctcgccgggatcgggctcgacgccgaggtagcggacgccggcgtcggtgaaggccgccgcgaagtaccccggcccgccgccgacgtccagcagggtgcggccggccgcggattcgccgtgcccggcccgccacaggtcgtccaccatcgccgcggtgtcggccgccagcgcgccgtagaagcgggccggctccgaccgttcgtagcggaactgcgacagcagccggaccgagcgggccagcgtcgcccggcgggcgaagatgtcggtcacggccacggggcaaccttatgcaggcttatgcgggcgcgacgcgcatggcgcggcccgcggcgcccgtccggctaggctgaaccactgatgtcttccttgcgctccgtgctgctgctgtgctggcgcgataccgggcacccgcagggcggcggcagcgaggcctatctgcagcgcatcggcgcgcagctggccgcggccgggatcgcggtcacgttgcgcaccgcccgctatcccggcgcgccgcgccgcgacgtcgtcgacggcgtccggatcagccgggccggcggccgctactcggtgtacatctgggcgttgctggcgatggcggtcgcccggctggggctggggccgctgcgcacggtgcggcccgacgtggtcgtcgacacccagaacggcctgccgttcctggcccggctgatctacggccgccgggtggtggtgctggtgcaccattgccaccgtgagcagtggccggtggccgggccggtgctaggccggctgggctggttcgtcgagtcgacgctgtcgccgcggctgaaccggcgcaaccagtacgtgacggtgtcgctgccgtcggcccgcgacctggtggccctgggcgtcgacggcacgcggatcgcggtggtgcgcaacggcctggacgaggcgcccgcgccgtcgctgtccgggccccgcgccgccgcgccgcgggtggtcgtgctgtcccggctggtgccgcacaagcagatcgaggacgcgctggaggccgtcgcccggctgcggccgcgggtgccgggcctgcatctggacatcgtcggcgacggctggtggcggcagcggctggtcgagcacgtgcaacggctcggcatcggttcggcggtgacgtttcacggtcacgtcgacgacgtgacgaaacaccatgtgctgcaaggggcttgggtgcacctgctgccgtcgcgcaaggagggctggggtctggcggtggtcgaggcggcccagcaccgggtgccgaccatcggctaccgctcctcgggcggcctgtcggactcgatcgtcgacgaggtgaccgggatattggtggacacccatgccgagctcgtggaccggctcgagcagctgctcgccgacccggtgctgcgcgaccagctcggcgccaaggcgcacacccgcagcggcgaattctcttgggcgcaaagcgccgacgcgatgcgcggcgtgctggaagcggtacacgccggccgcacggtcagcggcctggtcagcgggcgcggctgaccccgcggcgccgccacgcaccgaccaggacaccggccccgctgccgagcagcagcaccagccaggccagatgcgcgatcagcgtcgccgcccggcgatcggcggccacaccggcggtgtgcccgccgatccgatagagcgcgatctcgtcgtcccggtacaccggcgccgccgcgcccagggtgtgcgcggcggcgcccacctcgccggcgctgtcggcctccagcaccagccagcccaccccggcggcggccagcgccgccggatcgggcccggacagcagtagctcctgcacggcccgggcgtgcgcgccttcaccggcgatggtggttcccgagatcaccaggtcgcccgtgctcagcacgtcggcgcgcacccagcggggcagcgggtcgagcaccggcgccgggcccgaccaggagaacagccgcatggtgccggccggcagcaccgcgaccgcgtcgggccgggcattgatcgccgccgcgacggccggccagccgcgcgggtagcgcaccggcgacaccttgccgcccacgccccagaccaggtcgggcagcgccaggatcagcgccaggcagcacaccagcgccggggcggcggccccgaaaagccggcgccgtagcgtcagcaccgcgccggcaccggccagcgcgtagccgggcaccgccagcgccacccacttctgcccgtcgcgcagcaccccgacgcccggcgcggcgtcgaccaccgcgcccagcagccgcagccccggggcggtggccagccccgcggggatcagcaccgcggccgccgccagcaccagcagcggcaccgccgccggacggcgggccaccgccggcagtccgacggccaccacgcccagcagcaccacggccgaggccaccgcgaaaagcgttgtgcgcgaaccgggtacggcgtcagcgttccagatgccgcccaggctggccaggctggtcagcgtgcccaggcccggctcggcgcgtggcgcgaacgcttccacgccgagccggttggccggcgtgtgcgacggcaacgccgcacccgtgaccgcggcgaccagccagggcagcgccgccgccgccgcggcgccgatcgccgccgcggcgcacacccaacgccgccggcccgcaccggccaccggcacgcaggccagcgccaccgccgccgccagcagcagaccggtcggggtcagcccggccagcgcgatgaagaacgccagcccgaaaaacccggccccgcccgtccgcaaccccagcatggccgtcgccacccacggcaggcagccgtagcccaccagcaggctccaatggccttgcaaaagccgttctgccacatagggattccagatcgccagcgtggtggccacgaattcgccgggcattcccgcgtccggcagcacgagcgcgaccagccgggccgcgccccagccggccagccacagccccagcagtagcagcgtcttcaccacgaccccgccgtcgaccaggtgcgaagccagcgccaccgcgaaatcctgcggggcggcgcgcggcgcggccgtcaaccccagcgcggtgtcggacagataggaccgcggcgtcgacaccgcgtcccgcagcagcagatacccgggcctcagcagcggcccgaccaccagcagcgccaggaccaatgcgtacccgggccgggtccagcgcacgcggcgggctattcccggtcgggcggcttggcctcggtcggccccgcctcggtgggctcgtcgggaccggactcggagcgcagatcgggacgttgggtgggcagtttctcggtctcggcttcggcgccggacaccggctcttccagcccgctgcggccgaagaagtcctggtcgccgcggtccaggccggggtcggtcagcgcgctctcgctgcgcaggctgaacgaggccagcagcccaccgcccaccagcgcgatcagcccgaccgcggtgaaggtgatcggcagcacccgcgaccacagcgccagccggtcgcgctcgtcacgggccgcgttgacctgggactcgaccgtgtcctcgttggaggtgaccttgtagtcggccagcgtgagctccggcttgagcggatcgcgggcgaagtagtggtgggcgtgctcggtctgcttgacgatggtgcccgacaccgggtccacccagaacgtgcgctgcgccgcgtagaagcgggtcatggtgatctgctcgttcgggtcgccgccctggatgccccacatcgacgccggggcggtgaacttggagtcggtcgcctggtcggcgtacagcgacgggtaggccaccggggccaccagcttgccgtcggcgttgtagccgacgttctgggtgaacttgtaggtggtcagcccgttgacgtcctcttggctgtcgtagttgacgtcgaacggcttctgcgcgatcgggtcgaaataggggtacgtcttcttctcggtgtggaacgggaaccggtaggacaacccgtcgtggcgcagcgggatcgcggtcggcgggttctcgtcgttgatggtgcgcggcttctgcaccgcgccgccggtgtgggtgtcgtcggagacggccgtggcggtcttgcggttgagcgtgacggtgtcgacgatcgccagcagcagccccgtgtccttctgcttgtcggtgcgccgcaacgagcttccgacctgcagcgtgacgacgtcggcgttggccggcgactcgacgctgatctgctgctgggacaccagcggcacgttctggttgaccaccacgtggtcggtggacagcgacgccgagtccagggcggtcccggtgccgtcactgatcagcgtggcgtcgacgtccagcgggaccttggtgatccggctggtggtgtacgtcgtcagcagcagcgcagcgatcagcagggcagctccgaggccgatgatcccgcatgcggcgaaccgcaacatgactgctcggttcacgtcgctgtgccctcctcatgatcccttgcgtgtctgtgccgcgacccgacccgagcaggtggcccggggcaaactcgtttgaccctaacagcagaaagtaaggcggcggcttaccaacctgatgcccgggtgtacccgttctccgggccgcgcgcacaggcaaactgtggtggtgagcgatgaccggcgggtgggcggggtgcgcagcttcctgccggccgtggagggcatgcgcgcctgcgcggccatgggtgtggtggtcacccacgtcgcgttccagaccgggcactccagcggcgtcgacggcaggctgttcggccgcttcgaccttgcggtggcggtgttcttcgcgctgtcgggttttctgctctggcgcggacacgccgcggcggcacgggatttggcgccgcgcccccgcaccggccattacctgcggtcccgggtggtccggatcatgcccgcctacctggtggcggtcgtggtgatcctgaccctgttgcccgacgccgatcaccccagcccgacggtgtggctggccaacctgaccctgacccagatctatgtgccgctcacgctgaccggtgggctgacccagatgtggagcctgtccgtggaggtcggcttctacctggcgctgccggtgctggcgttgctggcccgccgcctcccggtcaccgcgcgggtgccggcgatcgccgcgctgggggcgctgagctgggcgtggggctgggtgccggtgcaccccggttcgggtctcaacccgctgaactggccgccggccttcttctcctggttcgccgccggcatgctgctggccgagtgggtgcacggcggcatcggccggccggtgcggttggcgcagagccgggcgggccgggtgctgctggccgtcgtcgcggtggtcgcctacctggtcgcggcctcgccgctggccggtcccgaggggctggtgccgggcactcccgcgcagttcgcggtgaagacggcgatgggctcgctggtggccttcgcgctgatcgccccgttggtgctggaccggatggacacgccgcaccgggtgttggggacgaccgtgatggtgacgctggggcgctggtcctacggcctgttcatctggcacctggcggcgctggccatggtgttcccggtgctcggcacgttcccgttcaccggccgcatgcccgcggtgttggtgttgacgctgatcttcggcttcgcgatcgccgcggtcagctacgccctggtcgagtcgccctgccgggaagccttgcgccgctgggagaaacgccaccagcccgccgcgccgcgccagctcatcgacgctgaggccgacgcaatcgcgccgtgatctcgtcgcggaccgatcggcgggaccggctcacccataggggccctggcgctcgaagatgcgccgcgggttgtcgacgagcatggtgtgcagctgctcgtcggtgacgccgcgctgcttgagggcggggatcacgtcgttgtggatgtgcaggtaatgccagttcggcatgacctggggcaccaactcctcgggaagtgcgtcgaaataacagttggcgtcgtgcgagagcaccatcttgtcggcgtggccgcgctcgcacatctgcgcgacgatgttcacccggtcctcgaacggcgagatcgcgtcgatgccgaaccggtccatgcccagatacgagccggcggcgatgagctcttcgaggtagccgacgtcggtgctgtcgccggaatgcccgatcaccacccggctcaggtcgacgccctcctcctcgaagatccgctgctggtcgaggccgcggcgcagcccggcgtgggtgtgcgtggagatcggcaccccggtgcgcttgtgcgcctgcgccaccgcccgcagcacccgctcgacgcccggggtgacgccgggtgcgtcggtggcgcacttgaggatgccggccttgatgccggtgtcggcgatgccctgctcgatgtcgcggacgaacatgtcggtcatgatctccgggccgcccagctccgcgccggggcccaggtagtggaaacagaagggcacatcattgtaggtgtaaagcccagttgccacaacgatattcagctcggtcgccgccgcgacccgggcgatgcgcggaatgtagcggcccaggccgatgacggtgaggtcgacgatggtgtccacgccgcgcgccttgagctcgttgagccggtcgatggcgtcggccacccgctgctcttcgtcgccccacgcttcggggtagttctgcgcgatctcggtggtcatgatgaacacgtgttcgtgcatcagggtgacacccagcgcagcggtgtcgatgggcccgcgagcggtattgagttctgacacgcccctgatgctaggtcgaccggcatctgaccaacagaggtcgttttgttttgccctccccggcaggggcgtcggtgcgctaccgtcaccctcgtctgcgtccagtacccgccgggagcccgcccatgttgctcaatcccaaccatctgcaacgccgctacccggatcgccgctcggcggagatcatggccgcgacggtcgacttcttcgagtcccggggcaaggcccggttgaagtccgacgaccacgaaagagtctggtactccgactttttggagcacatcggccgcgagcgcatcttcgcctcgctgctgaccccgacgcgctacggggcgcccgattgccgctgggacacctaccggatcagcgggttcgccgagatcctcggcttctacgggctgaactactggtacccgttccaggtcaccgccctggggctggggccgatctggatgagcggcaacgacgaggccaagcgcaaggcggccgggttgctcgaggccggcgaggtgttcgcgttcgggttgtccgagcagacgcatggcgcggacgtctaccagaccgacatgaacctcaccccagcaccgggcgggggctggaccgccgccggtcagaagtactacatcggcaacgccaacgtggcccggatggtgtccaccttcggcaaattcgccggcggcgcaacggattccgagtacgtgttcttcgccgccgactcccgccacgagcggtaccggctgatcaagaacgtggtgaattcgcaaaactacgtcggcaacttcgcgctgtgcgattacccggtgaccgaggccgacatcctgcaccgcggccccgaggccttccacgccgcgctgaacaccgtcaacgtctgcaaatacaacctgggttggggcgcggtcgggatgtgcacgcacgccatgtatgaggccgtcacgcacgcgtccaaccgcatcctgtacggcaccgtcgtcaccgacttcagccatgtgcgccgcctgctcatcgacgcctacgcccggctggtggcgatgcggctggtcgccacccgggcctgcgactacatgcgcagcgcctcggccaccgaccgccgctacctgctgtacagcccgctcaccaaggcgaagatcaccggcgagggcgagcgggtcatcaccgcgctgtgggacgtcatcgccgccaagggcgtggagaaggacaccatcttcgaggccatgacccgcgagatcggtctgctgccccggctggagggcaccgtccacatcaacgtcgggctgttgggaaagttcatgcccaactacctgttcgcccccagtggcgagctgccggtgatcggccgccgcgacgacgcggccgacgacgagttcctgtttgcgcaggggccgacgggtgggctgggcaaggtgcggttcggcgattggcgggcaccgttcgacggcttcgcgcacctgcccaacgtcgcgctgctgcgcgcccagatcgacgtgctggccgagatgctggccagcgccaccccggatgcgttgcagcagaaggacatcgacttcgccttcgctgtcgggcagttgttcgccacggtgccctacgcccagctgattctggaggaggcgacgctgtccggcgtcgacgacgcgctgatcgacgagatcttcggcgtgctggtccgcgacttcaacgcctacgccgtcgagttgagcgacaagcccgcgacgacggagcagcaggcccgtttcgcgatgcggatgatccgccgccccgtgcacgacccggcgcgctacgaccagatctggaaggagcaggtgctgccgctcagcggggcctaccagatgcggccctaactgtactgaccacggacgttggtgacggcgtggtgaggtgacatgacgagaacctccgagtgaagtgcgagctgcttaggaaacgcactcacctcggaggtcctcatgtcccaccgtaatgctccattgtctgaaaccggtcggctgcggctggcccgttgcgtcgttgatgagggttggtcgctgcggcgagcagccgaacgcttccaggtctcggtaaccaccgcagagcgctgggccaggcgctaccgcgagctgggcgaggccggaatggccgaccgcagctcacgaccgcatcacagccccaaccgcacgcccacgcgcaccgagcggcgcatcatcaaagtccgggtgatccgccggtggggaccagcgcgcatcgggtatctgctggggatacatccctcgacggtccatcgggtattgacccgctacgcgctggccaaactgcgctggctggaccgatctactggccggattatccggcggatggaaccggctgggtgcggggatctagtgcacgtcgatgtcaagaagctcggcaaaatccctgccggcggcggctggcggatgctgggacgcgcgattggcggccacaactccaacgcggacaagagcagcggggtgttcagcaagcaccgcaacccaatacggggatatcactatctccacaccgccatcgatggatattcccggctggcctacagcgaggtactcgacgatgagatcaaagaaaccgccgccgagttctggacacgcgctaatgcctggttcgccgaatgtgggatcagcgtgcggaaagtgttgaccgacaacgggtcctgctaccgatcgcgcgtttttgcccaggccctgggcgatatcgaacaccgccgcacccgaccctaccgaccacagaccaacggcaaggtcgagagatttcaccgcaccttggcagacgaatgggcctacgcccgcctctaccgcagtgacactgagcgctgcgaagagttcaccacctggctgcacacctacaatcaccaccgcggccacaccgcacttggcggccaaccacccgccagccgcgtacctaacctctcaggtcagtacacctaacgctctcggcgcgcgcacgccccttcgcgagcgcctgcccttcgcgagcgcctacccctcggcgagcgtctgcccctcagcgagcgcctctctcggcgagcgcctgcccctcggcgagcgcctgcccctcggcgagcgtcacgccagcgtgaccgtcgggctctggcgtcacgccagcgtgacgctcggcgcgcgcagggccgggcggcaagacgctcggcgcgcgcagggccgggcggcaagacgctcggcgccgcacccccccttgactgtgagattgctcacagtaggatgaccagtggtcattcagataggaggcggcattgcccacggtcacttgggcgcgcgtcgacccggctcgacgcgcggcgatcatcgaggccgcggagtcggaattcggcgcgcacggattctcccgcggcagcctgaacgtcatcgcccgcaaggccggcgtggccaagggcagcctgttccagtacttcgccgacaagcgcgacctgtatgcgttcatcgccgacatcggcagccagcgggtccgcggctacatcgagcagctgatccgcgagctcgacccggcccggccgttcttcgaattcctcaccgacctgctcgacgggtgggtggcctacttcgccgaccacccgcacgagcgggcgctgcacgccgcggccacgctggaagtcgacactgaggcccggatcagcgtgcagaacgtcatccaccgccactacctggaggtgctgcggccgctggtgcgcgacgcccggctgcgcggcgacctgcgcgccgactcggacaccgacgcgctgttgtcgttgctgctgctgatcttcccgcacctggcgctggccccctacatgcgcggactggatccggtgctcgggctcgacgagcccacccccgagcagcccgcgctggcggtgcgccggctggtcgcggtgctggccgccgcgttctcgcccgcgccggcccactttgccaccccacgatccgaggaggtcacatgaaccgaacccgaagcgcctcgatggcgcaggggggtctcaactgggacagcttgccgctcaagctttttgcgggcggcaacgcgaaattctggaatcctgccgacatcgacttctcccgtgaccgggccgactgggaacggctcaccgacgacgaacgcagctacgccacccggctgtgcgctgagttcatcgccggtgaggaatcggtgacccaggacatccagccgttcatggccgcgatgcgggccgaaggccggctcggcgacgagatgtatttgacccagttcgccttcgaggaggccaagcacgtccaggtgttccggatgtggctggacgccgtcggtgtcaccgacgatctgcaccactttctcgacgacgtccccagctaccggacgatcttctacgaggagctgccggactgcctgaacgcgctgacgatcgatccgtcgccggccgcccaggtgcgggcgtcggtgacctacaaccacatggtcgaaggcatgctggcgctgaccggatacttcggctggcacaagatctgcgtggaacgcggcatcctgcccggcatgcaggaactggtgcggcgcatcggcgacgacgagcgccggcacatggcgtggggcaccttcacctgccgccggcacgtcgccgccgacgacgccaactggggcgtcttcgaaacccggatgaacgaactgatgccgctcgggctgcgcctgatcgaagagggcttcgcgctctacgacccgatgcccttcgacctgtcggtggacgagttcatggcgtacgccagcgacaagggcatgcggcgcttcggcaccatcgccagcgcccggggccgcccgctggccgagatcgacctggactacacgcccgtgcagctcgaggacaccttcgccgacgaggacgcccgcgcgctggccgcggtgtgacggcgagcagacgcaaaagcccccaatgtcacggcgggtcgggggatttcacgtctgctcggcgggtcactcgaccttcgagccgccgccggcgtcgccgctcttcgacgacccgatccagacggtcttggcgttgcagaacgcgcggatgcccaggccggcgagctcgcggccgtagccggaccgcttgacgccgccgaaccccagctccgggtaggacaccgtcatgccgttgatgaagacctggccggcctcgatgtcgtcgatgaaccgctgctgctcggccgcatcgttggtccaggcgttcgaccccaacccgaaggtggtggcgttggcgatctcgatggcctcgtcgatgtcggcggcccggtacatcgacgcgaccggcccgaacacctcctcggtgtacagcgccatgtccttggtgatgtcggtgaccacggtcggcgggtagaaccagcccggcccgtcgagcggcttgccgccgcagcgcagcgtggcgcccgcggccacggcgtcgtcgacctgcttggcgatctcgtcgcggcccgactcggtggccagcgggcccacgtcggtggccgggtcggtggggtcgccgaccttcagcgctttcatctgttcgacgaacttgtcgacgaacgcgtcgtagatgtcggtgtgcacgatgaaccgcttggccgcgatgcaggattggccgttgttctgcacccgggcggtgaccgcggtcttgacggcctcatccagatcggccgagggcatcacgatgaacgggtcgctgccgccgagctcgagcacggtgggcttgatctcgtcgccggcgatggccgccaccgactggccggccggttcgctgccggtcagggtggccgcggccacccgcgggtcacgcaggatgcgctcgaccgcgctggacggcaccagcagggtctggaagcagccctcggggaagccgccgcgggtgatgacgtcggccagatacagcgcgctctgcggcacgttcgacgcgtgcttgaggatgccgacgttgccggccatcagcgccggcgcggcgaaccgcaccgcctgccacagcggaaagttccacggcatcacggccagtaccacaccgagcggctggtagcggatgtacgcccgggccgcgccgaccttgccggcgtcggccggctcgtcggccagcagctgctcggcgttctgcgcgtagtagcgaaaacccttggcgcacttgagcgcttccgccttggccgacttgagggtcttgcccatctccagcgtcatcatggcggccacctcgtcggcctcggcctcgagcaggtcggcggtggcgttggcccactgggcgcgctgggcgaacgtggtggagtggcggtagtcgaggaagcgttcgtaagcgcgggcgatggcggcatcgacttccgcatcgctggccggggtgaaggttttgaccgtctcgccggttgcggggttgatggtggcgatgggcacgctggccctccttcgtctgcgtgcttggtgaaacgtccgacttccagcctgccactatcgtggccaacgggaggtgtcggatgagcaaagccgctgagctgatcgtcaagtgcctggaaaacgagggggtttccgtcgtgttcgggctgccgggcgaggagaacatccgcttcgtgtaggcgctggccgcctcaccgatccgctacgtgctgacccggcacgagcaggccgcctccttcatggccgagatgtacggacgggtcaccggccgggcggcggtggtgtcggccacgctggggcccggcgcgatcaacatgcaactcggggtcgccgacgccaccaccaacagcaccccgctggtcgccatctccgcgcaggtgggtcacgaccgggagttcaaggagtcgcatcaatacgtcgacctggtgtcgatgttcgccccgatcacccggtgggcggccggcatcccgaccgcgcgcgccatccccgagatggtgcgcaaggccttcaaactcgccgaatccgagcgcccggccgcggtgtatctggcggtgcccgaacacatcgatgccgacgagaccgactacgacctggggccgttgccgcgcaacgtggtccggcccgacgccccgtcaccgcgccaggtggaacgcgcagcgcagatcctgcgcaacgccaagcgcccggtggtgctggccgggcacggcgcggcgcgcgccgatgccaccaaggcgctggtgcgcttctccgaggagttcggcatccaggtggccaacaccttccacggcaagggtgtcatgcccgacgaccaccccaacagcatcggcacgctgggcttcatgcggcacgactacgtcaacttcgggttcgaccacgccgacgccgtcatcgccgtcggctacgaattgcaggagttcgacccggtccggatcaacccgcaggccgacaagaagatcatccacatgcaccggttcccggccgaggtggacgcgcactactcggtcgacgtgggcatcatcggcgacatcagcgattcgctgaacgcgctgaccgacgcgctgtccggtcaccgtttcgagcacgccgccgacgtgcccggctccgggctgctgaccgacgaattcgcgcgcgggcaacaggattcgcgttatccgctggccccggcgcgggtggtcgccgacacccgggcggcgctgggccgcagcgacgtggtgctggtcgacaccggcgccaccaaaatgtggatggcccggctgtacccgacctacgagcgcaacacctgcctgatctcaaatggcttgtccaccatgagctttgccctgcccggggcgctcggggtgaagcttgcccagccggagtccagggtgctggccgtggtcggcgacggcgcattcctgatgaactcccaggagatcgagaccgccgtgcgcgaacgcatcccgctggtggtgctgatttgggaggacggcggctacggcctgatcgaatggaagatggacctcgagctcggcgcacactactacgtcaagttcgccaaccccgacgtggtcacctacgcagaaagcttcggcgccaagggatatcgcatctctcatgccgacgaactgttgccgacgctgcgggccgcgctcgacgacgacggcgtctcgctgatcagctgcccggtcgactactcggagaacctgcggctgaccaaccgcctcggtgagctcgacgaaacgctgtgaaaagccgccgcggcagcgacggtcattgacaatgggctgatgctgtttcgtcagctggagtacttcgtcgcgctcgcctccgagcgtcacttcgcgcgggccgcccgcgcgtgctacgtgtcccagcccgcgctctcggaggccatccgcaagctcgagcaggaactcaacgtgcccctggtgcgtcgcgggcagaagttcgaagggttgacgcccgagggcgagcggctggtgctgtgggcgcggcgcatcctggccgaccacgacgccctcaagcaggaggtcgccgcgctgcagaccggcctcaccggcgagctgcgcctcggcgtcatcccggcggcctcgagcatcgtcgccctgctcaccgatcccttctgcgccgcccatccgctggtgcgggtgcagctcgagaccagcctgcggtcggccgagatcgtgcagcgactgcgccggttcgagctggacgccggggtcctctaccccgaccggcaggatgtcgccgacctgctggtcaccccgctctacaccgagcagcaggtgctcatcgccggcgccgagttgctccccgacccgtcggagaccatcagctggtccgacgcgctgacgctgccgatgtgcctgctgaaccagggcatgcgcggccgccggctcatcgacgacgccctggccgcgctggagctcacggtcacgccgcagctcgagaccgactccgtcgccacgctgctggcgcacgttggcaccggccggtgggcaagcatcatcccgcaaacctggatccactcgctgcgcccgcccgccggcgcgcgcatcctgcggctggagaacccgaccgtcaccgccacggtcgcgctggtcaccagcgccaccgagccgggctcggtgctgacccgcgcgttggtgcagaccgcgcggggcgccggcatcaatgacgtgttgcgcaaggccgcgcccggatactccgcgggctagccgccaccggccgtgatcggccgggcctatcacccggtcggaactacgtcttggacaccctcggcgaccgcgcgcgagactgaaagtgcttcggaagcgacgaatccaccggccgcagggccgatttcacctcaggagagaccatgaaccactgccggcgcgtgccgtgccgcgattcggtggtcgccgcgaacaccgaagacggcaccacctcgccccaccgctcgacccatcgcggggccgcgcgatgaaagacttccgggcgccggtcaacggcgtcgacggcgattccgcttccgcgctggttgcggttcccaaatcccaaggcgcccaaacgatccggccggactccgtttcccgactcgtcggcgcgctgctcgacgaccacgccgcggtggtcggtcgcgtccgcagcgtcattcggtcccggcttccggtctaccgctcggttgccgacgaggcactcgaggccgagctcgagtgggtcttgcggtccgccgtcggcgggcgcgaggcgttgcacgagccgcagatcgcgggcctcgccgcgatcggcgaggcgcgggcgcacgacggcgtacccgtcgacgacatgctgcgcgcctggcggatcggcgtcgaggtggtggtggagtgcgcgcgtgaggcggcgcgacggttgggcgtcgacgatgcgcgggtgctggaactcgttcagtcggcactggcatggtccgacatcgccatggcgacctcggccaaggcgcaccggcggaccgaacgcgcgctggccctcgaggccgaggagagtgacgcggagttcgttcggggtgcgctgatgggttcgctcccggccgccgagctgcgcatgcacgccgagctgcgtgggctggaccccggcgccgagtatgtggccgtccgcgcccgcctgggcggcgacggcccccatctccggctcgagcagtcgctgggttttcaggacccggcgcacagtcgacgcggtctgtgcgccctgctggacggcgacctcgccggcttcctgatcgagccgccccgcgacgtcgagggtgtcgtgggtttcggccccccgaggccgctgacgcggttgagcgagtcctaccggatggcggcgcgcgcgctggtgaccgcggaggcctgcgggttgcgcggtgcctacgacatcgccgcgctgggtctgcgcacggccgtggcgatcgacgccgacgtcggcgagctgttgcggaagcgctacctggagccgctgtccgtcggcggttcgagccgtgaactgattgccacggtccggacgtacctggcgtgcgggatgcacgtggagcgcacggcgacaaggttattcgtccatcagaacaccgtgcggtatcggctggcgcggttcgaggagctgaccggcgccagcctgcgcgacaccgaggtggtcaccgaagtgtggtgggttctcgagctggcggcgatgcgcctgtagcggtcccgaggacgggccgcaagccgatacggtggatgccatgcgccgcgtggactacgtcatccaatatgtcgagtcactggagcggtcggtgacgttctaccgggacgtgatcgggctcgaggtgcgcatcgagggcgacgggtatgtcgagttcgagatgcccaacaccaagttctcgcttttcgaacgctccaagcttcccgagctgatcggtcgcgagggcggcaccgcgccgtgcggcgagatcggttttctggtcgatgacgtggacgaggaagcgacgcggttgcgggggctcggcgtcgagatcctcagcggaccggtagaccggccctggcgggaaaggacgctgcacatcgccgatccggacggcaacgtcatcgaattcgcacagaagcttcgatgacgtcccggcccgggaaccgacgcggcttagcgtttgtagcggttcccaaacgggtgccccgatgtccgtgacaatcccggcggccgctccgtagccggcgccctcgcttcgaggggacactgtcgtgacgggaggagccgacgatgccggaccttgcgcggcgcctgcgacggactttgtggccgatcgcgcagaccacggtcgccgccggcctcgcctggtacctcgcccacgacgtgctcgaccaccgggagcccttcttcgcgccgatcgccgccgcggtgtgtttgtggatgaccaatcgggtgcgcgccgaactggccgtcgaaatgatcatcggcgtggcgttggggatcggggcgggcaccgtcgtgctggccgtgttcggcgcgggacccatcggcatgggtgcggccgtgatgctttcgctgaccctggcggtgctgattgcgcgcagcttcagcacccagcgatcgatgttcgtcaaccagagcttgatctcggccatcctgatcatggctttcccgcacaccgggctcggggtggagcggctgtacgacgcgctgatcggcggcggactggcggtggtgttcagcatcctgctatttcccaagaatccgctcgcggtcctgcacgacgcatccggcgaactattgaccgcgctgcacgacattctggcccagatctgttgtcgcagcgccgattctgcgtcaccggatcagggttgggcgctgtccgccgccgaccggctgcagcggtgctcggcgagtctcatcgaagcccgcggcaccgcagggcaattggcgcgcgtctgcccgcgccggtggccgttgcgtggcgcggtcggggccgccgaccgccaggtggtgcacgtcgcgctgttcggcagctcggtgttgcagctgacgcggaccctgatgtcggtgcgcatccgcggcggcccgcacgccgaagcgttccgcgccgcggtcgacgacctacgcgacgccgactccgcgctggccgccggccacccggcaaccgctgccgcacatgccgagtccgcgcgccgtcacagcgcggcgctacccgcgggcagcccggccagcgtggccgtcgtcatcgatgcgtgcatcgacgaactgcaacaggccatcggcccacgtcgttcttgacttcgctcgtgacgcctactgcgcgtaggacttggcccccgtcccggcgaacttgccgccctcgacgatcaggtattccgagcggatggggcggccggcgaaccagtcctcgaggatctcgcgggtcccggcgcagtagcgggcctgcgccgacaggctggagcccgagatatgcggcgtcatcgcgtgattgggcatggtgcgccacgggtgatccggtggcggcggctgcgggaaccacacgtcgccggcgtagccggcgagctggccgctctccagcgccgccacgatcgccttgtggtcggtctcctcggcgcgggcggtgttgacgatgtaggagccgcgccgcatcgacttcagcagcttctcgttgaacatgtgatgggtttgggcgatcagcggcgagtggatcgacaccacgtccaccgagcgggccagcgactcgacgtcggggtgatacgtcacgccgagttgcttctcgtactccggcgagagccggtgcacatcgaagtagtgcaggttcaccccaaagggtttcatccgctcgagcaccgcgcgcccgatccggccggcggcgatcaccccgacgtccatgccctccacgtcgtaggaccgctgcacacagtccgcgatattccagccgccgtcgcggatccactggtgcgacgggacgaagttgcgcaccaacgccaggatctgcatcaccgtgtgctcggcgacgctgatgctgttgctccaggtttcctcggcgacggtgaccccgcgcgcctgcgcctcggcgaggtccacgtggtccgacccgatgccggcggtcagcgccagcttgaggttgcgcgccttggcgaaccgctccttggtgatgtaggcgggccaaaacggttgggagatcacgatatcggcgtcgggcagttcccgctcgaactccgaatcggggccgtccttgtccgacgtcacgaccagctcgtgcccgccgtcttcgaagaacttgcgcaaccccagggcaccggagacgcagccgagcagctcaccgggcgtgaagtcgatcttcgacggcgtcggcagcgacgagccgtcggggtagctgttgatcaccgggatgctgtcgcgggcgtacttcggcggatacccgtcaacgggatcggggtagagcaccatcacacacttagccactggctcctcctccatgggttgcgtctggcagggaccggacgactcaacgaccggcgcagccacgcgcggcgccgtaccgcatatcagcgttcgcgcgatgcggccgggtggcaacggagtcggttccaaagtttcccgccgatttcccacaccgctttagccgacaccacaagcgttccgatccgtatttatgggccctgcaaacctatcgtgccgcagctgcggggttgcgctgcgggtctcggcggcgagcaccaaccggggcgccgccccggggtccgcttgtagcgggcaccaaagccggatgagaaatcgacgcgacggcttggaatcgcctccgatgacatccgagcgtgccgagcgcagagtcgactacagcacgcccggccacggcaaggagctgatgcgcagatgcaagctgaggatcaagtctcgccgcgcgagatggtgcgccgtgggctgctgctcgacggcctgcgtcagcccgtggatctcaatgccgtggattggcatgtccggcaacgccatccgggcgcggcgccgtcggaagtgcaagacgcaaccctggcggtcatccgctcgctggtgagtgacgggctggtccggctgggtgcccaggtgatggtgggcgaacatctgggcggcgtggccaccgagggtgaacgattcgtcgcctgggaccagccgctggagcgatcgatgcacaagatctcccacgtctacctcaagcactacgacgatcccgagaaatggatgtatgccgcgtggatgcaactcaccgacaagggggagcagctcgcgcggtcgttcgaacaggcagacctcgattcgtatcgaaagttccagtagcggaccgctcgtcgacgacggcggcggggccgccgaatttctttgattgcccactgatttcgagctagggaggacactgatgacggagaatttcacgacgacgaatgcgggcgccccggcgcccagcgacgaactgtcgttgacgctgggtcccgatggcccggtactgctgcaggatttctatctcatcgagcagttggccgcgttcaaccgcgagcgggtccccgagcgccagccgcacgccaaggggaccggcgcgttcggccggttcgaggtcaccaatgacctgagcgcactacaccaaaagccgcggtgtttcagccggggcaccaagaccgatcgtgttcgtgcggctgtcggggaacgccggcgagcgcggcagcgccgacaccgtgcgggacacgcgcgggttttcggtgaagttctacaccaccgagggcaacttcgacctcgtcggcctcgacttcccggtcttcgtcatccgggacccgatcaagttcccgcagatggtccgctcggccaaacgccgcgcgaacaacgactgccgtgaccacaacatgcagtgggatttttggacgctctccccggagtcggcgcaccaggtggccatgatcatgagcgatcgcggtattcccaagacgtttcgtcacatgcacggcttcggcctgcacaccttcagcttcctcaacgccgccggcgagatctcgtgggtgaagtttcatttcaagtccaatcagggcatcgaatggttgacccaggaagagggcgatcggctggccggcaccgacccggactactgcatccgggatctgtacgaggcgatcgagcgcggggaccatccgagctggtcggtgaaggtgcagatcatgccgttcgaggaggccaagacgtatcggttcaacccgttcgacgtgaccaaggtgtggccgcatgccgactatccgctcatcgatctgggcaccatgacgctggaccgcaacgtcaccgaccaccacaccgaggtcgagcaggtgaccttcgcgccgcatgcgctggtgcccgggatcgggctgagcccggacaagcttttgctggggcgcagtttcgcctacgccgacgcgcaccgctaccgggtcggggccaatcacaaccaaattccggtcaacgccccgcggtgtccggtgcgcagctattccaaggacggacagatgcgcttcgtcaactccaccgacccggtgtatgcgcccaactcctacggcgggccgaaggccgatcccgaccgggcgtccgtggtgaaatgggccgtcgacggcggaatgatggtgcgcgcgccctacacgctgcgaccagacgacgacgactggggccaggccggcgccctggtgcgcgacgtgatggacgacgccgagcgggaacgactggtgcacaacatcgttcaccatgtcaccgacggcgtgaaagaacccgtgctgtcacgcgtcgtcgaatactggtacaacatcgacgccgacatcggcaagagggtggaagacggcatccgagccgccaacctcggccggtgagccggaagccgccggaccgcacgatatggcggagaaccatacgaccacgaatgcgggtgcgccggcgcccagtgacgaactgtccttgacggtgggccccgacgggccgctcctgctgcaggattcctacctcgtcgagcagatggcggcgttcaatcgggaacgggtgcccgagcgtcagccgcacgccaagggcgccggggcgtacgggcgcttcgaggtgacggccgatgtgagtgagtacaccaaggcggccttcctgcagccgggtgcggtcaccgaggtgttcgcccgtttctcgtcgggcaacagcggcgagcgtggcagtgccgacacggcccgcgacaaccgcgggttttcggtgaagttttacaccaccgaaggcaatttcgacctcgtcggcagcgacgtcccggtcttcgcgatccgggatccgatgaagtttcccaacctgattcgcgccgggggccgccgcgcggacaacgacctgcacgaccacaacatggtgtgggatttctggacgagctgtcccgagacagcgcacctggtgaccctggtgatgggggaccggggcatccccaggacgtttcggcacatgaacggcttcggcctgcacgcgttcagttgggtcaattcggccggcgagatccattgggtgaagtaccacttcaaaaccgaccagggcatccaatggttgccccaggaagagggtcggcggctggccggcacccatcccgactgctgcgtgcgcgacctgtacgaggccatcgcgcgcgggaagtatccgagctggtcgctgcaggtgcagttgatgccgttcgccgacgcgaaaacctaccgcttcaacccctttgacgtgacgaaggtgtggccgcacgccgactacccacccatcgagatcggcacgatgacgttggaccgcaacgtcaccgatcaccacgccgaggtcgagcaggccgccttcgcgccgagcaacctggtgcccggcaccgggctgagccccgacaggctcttgttgggccgcagtttcgcctaccccgatgcgcaccgcgcccgcatcggggtcaaccacgaccagctcccggtcaacgccgcccggtgtgcggtgcgctcgtacgccaaggacggccggatgcggtttgtcaacaccgccgacccggtgtatgcgcccaactccgcgggcgggccgcaggccgatcccgcacgggccggcgaggtgcactgggccgccgacgggcagatgctgcgcgcggcgtacactctgcgccgcgacgatgacgactggggccaggccggcaccctggtgcgccgggtgatggacgattcgcaacgggaacgcctggtacacaacatcgttggtcacgtctcggcgggtgtgaatgaacccgtcctgtcccgtgtcttcgcgtactggcgccacgtcgacgccgacatcggcaggaaggtcgaagaaggcgttcgcgccaatctcaacagctgacaacatcgcgagaccctgattcgtttgcagcgcaacgaatcacgtgccggcgcgcccgggggatccgcgtcggcggcgcgcttgtagcgaccaccaaagcgcggcgggaatttcggccgaattacggagtgaactacatggagttcaacgcggcgcccgaacatgctgctaactgcgggtcggaatccgtatcccggtaggcaacgagggtttccacgcgtgcggtgcggcccgctgaacacccgagttttcgaggaggaaatcatgtcacacgcgcaaccaaatgtcgtcgacggggctcactttgacttcgtcgtcgtcgggggcggcaccgcgggtaacgtcgtcgccggacgcctcgccgagaacccgaacgtcagcgtcctggtcgtcgaggccggtgtcggtaacccctgggagcttgacggggtgaacaccccgggaacggccatggagctgcgccacagcccgtacgactgggattacctggccaagttcgtcgaccgtggcgtctggcagcgcatcgacaagcaggagacccggggcaagatcctcggcggcagctccgcggccaactacttcagctggattcccggctgcaagccgacctacgaccggtgggcggaatacggtggcccggaatggacctggcagccgctgcttccctacctgcgcaagagcgccacctatcacgacgaccacgggacgttctcgcccgacatgaagcggatcggcgccggcggtccgctgcccatctcgcacaacaacatccccgagttgcagcccttccgcgacgtcgtcgcgcaggcgtggaagtcgcggggcctgccggtgacggagaacatctacgacggtgagatgaacggcctcacccacgcggtcagcaccatctatcggggtgtgcgttccggcagctacctgttcgtgaaggaccggcccaacatcacgatcctgcccgaggttcggtccaagcggctgatcatcgactatgccgaccgcacctgcaagggtgtgaccgtcatcgacgcctccggcaccgagcgcagcttctacgccaaccgggaggtcatcctctcccagggtgttttcgagagcccgaagctgttgatgctcagcggtatcggccccggacgcgagctggccaagcacggcatccccgtggtcgtcgattctcgccatgtcggccagcacctgttcgatcacccgggcgtcccgttcgtgctgcggatcaaggagggctacgccatcgacgactacctgcgccccggtgcgaagcacgactccgccgttgccgattaccagaaggaccaccagggtccgctgggctccggtctgctggagatgatcggcttcccccgcgtggacgaatacctggatcgggatccgatttaccgtgaggccaaggccgccaacggcgggctcgaccccttctcgccggagggacagccgcacttcgagctcgacttcgttcccgcgttcggcagtgcgttccagtggcagtaccccaccccgccggagggcgaccacatcaccgtgatggtcgacctggtccgcccggcctacgacggcggcggcgaggtgacactcaacagcaccgacccgttcatgcagcccaacctcaacctgaattacctgtccaacgagctcgacatcatcgccctgcgcgagggcatcaggctggcctacgacattctcaccaagggcgacggcttcaaggacctcgtcatcagccagtacccgtgggatatgccgctgcactccgacgagctgatgaggacgtccatccaggaccgggtgcagacgtcctaccacccgtgcggcaccaaccggctgtccaagaacatcgaccaaggcgtggtggatcccaagctgaaggtccacggcgtcaacaaactccgcgttgtcgacgcctccgtcttcccgatcatcccggactgccgcatccagaacaccgtgtacatggtcggcgagaagggcgcggacgcgatcaaggccgaccacacggacctgtacaagtaggggccgggggcttcggcctggagtgtgtactcatggcgagattccggccgaaatcccgccgtgagtacacactgaaatccctagctacacactcgaattcctggacgcattggtggtgacgccgcggctgtatcacggcaagcgcgccgccacgggtcggcctgttggatgctcatgcctgccctagccgtggtcctgcggtgtcagtttcgacagcgtcagcggcggcacgtagccgccgatcagcgtgcgatgccaccaggcccggtcgcggcgcagctcggccggcgtggtgaagcgatactcgtagagccgtgcccgcacgtaccggggcggcgcatcggggaaggggttgtgccgcaacaaccgtagcgtcgggcgatcgttttccagcagccgctgcaggaacggcgtcagccacggctgggcgtagccgggcgagatcgcggcgaaccacatcagccagtccagccgcagatggtagggcgcccactggcgcggcagccggcgcacgccgcccggcttgcccttgaattcgtattcccgccatacggtctggtcggtgatgtcttcgtcggcggtgccttcgatcaccacctcgcggcggacccggccgatgctgccgaacgcgccgtaggtgttcaccaggtgaaaagagttgaacgacatgttcattcgctggcgtgaggacagcatgttgcgtatcggccagtagctcatcacaagcacggcggcggtgaccgcgaccaccacaacgacgaaccacagcggtgacgccgacggttcaccgtgccccggcagcacgctcttgggcagcagcagcgcgaccgacgaatcgtcgatggcgctgcacgccaacaggatcgtcacccaattcagccaagcgaagttgcccgaggcgaccagccacagctgagtgaccacgatgatggccgcggccacgccggccaccggctgcggcgcgaacagcccgaacggcacgatcagctgcgcgaagtggttgcccgccacctcgatccggtgcaggggcttgggcaggtggtggaagaaccagctcaacgggcccggcatcggctgggtctcgtggtggtagtacagacaggtcagatcgcgccagcacggatcgccgcgcatcttgatcagccccgcgccgaactccacccggaacagcagcaaccgcgccatccacaaggtgagcagcggcggggccacctcggcattgcccaggaagatcatcaggaagccggtttcgagcagcagcgactcccagccgaacgaataccaggtctgcccgacgttgacgatcgagaggtagagcacccacagcgtcagccacatcagcatggccgcccacaacggcaccgcgtcggccgctccggccacgatggccgccgacagcgccgcgccgaaccaggagagcgccgcgaacagtcgatccgaatagtgcaggtgaaagatgctcggcgtgcgccgccacgactgcccggccaaaaaccgcgggatcggcagcatcccgtgttcgccgatgagcgcgcggaactgcgcggcggccgcgacgaacgccagcaggtaaatcaccgcgacgccgcgctcgagcaccagcctgcccacccagtaatcgggtgcggaaaaccagctcatctcgctaactcctcggtcggtggcggctacaccaacccgcgtatccagtcaatcagccgataaacgggtagccaatactccggccgactattcgtgacgggctccgccgcgccggcggggcaccgcgacgaccgaggcggtaagcgccgcaagcgaaatcaacgccagcagttggacgtaccccgcgtggccggcgtacccgtcgaccgagcgccagggctggcgcgacaacgccgccccggccaggatcagcccgccggcgctgcccgccatcccgagccgcgcccagcgccgggcgcccagcgcataccgcagacccagcgcggcgcccagcaccgccaccccggccgccccggcgatcaccgccccggcggccagcgccgggaccgccgcccacaccccgggccgccacggccgcgcgggcgggtcgtgggtcccccgtttccgggtgcgccagcacgccagcagcgccagcaccggcagcagcgccagcccgacggccagtcccgcgcgatacagcgaattggacgcgaagctcagcgtgatgacgccgggatcgcccgcgggcaccagccagccctgctgccagccgttgaccgcgatcggcgtcagccgggccccgctgccggtgcgcgccacccacccggggttgatgctctccgggatgaccaggatccgggaggtgttcgacgggccggccgcaatctcgcggcggtccgggccccagccgcgccacgacgcaacccggaccggctgggcggcctcggcggcggccggggtggacagctcggcgccgtcgacgacgaactgggcgcccgggctgatcaacagctcctgctggcccgcgggcagcgcgatcgggtcgcgctcgcagggcaccgcggcgacgggctggtcatcgagcagggcgccgacggtggtgtggatcgcggtgtgcacgaaccggcccgcgacggcgatgaccggcccgcgttcgcagccgacgctgacctcgcgggcgcggttgcggccggcgtcggcggggccgatcgggttgccgtcggcgcccagcgccgcgacctcggccagcccgggcggcttgagctggtcgaagcccaacgcgttgcggtcgatgacgtcttcccaatccagcaggctgatggtcaccgtgtcggtcacccgcggtttgagcggaatcgtctgcgcctgaccgggtttcaccgcggtcacctgcgggccgtcgcccaggttgacggccaccatggtggggtgggcgggcagcgccgcccggctgggaaccaggcgcaccccggcgacctgagtgggccggggcagggtgagcgtcagggtgggcggcgtcttgtgctgcaccactcgttgcggcgcggtccaggcggtggccgggtcgccgtcggtggccgcatacgccgagccgagaacgtcgacggtatccgaatcgccgtgagccacagtcgtattcggttcggtgatcaggtcggccagcttgggtccctggcgggggcgcacccacaccgtcggggtgaccgacgtcggcgccggcaccgtcagcgtccggctgaaggtgaccggctcttccggggccagctccatcgacggcgcgcagcgcacactgtcgggcgcccgggcgcagccgggccggccgggcagctcgggtcccaactcccaccgcgtgatcggcgactccggcggcggcccgggcacccgcacggtgtgccgcaggtcgaccgggtgcgcgaagccggacgcgtcgtactgggtgacggtcaagtcggtgatgccgaactgcaccccgggcgatccgtcgtcggtgccggcggcggtgatccgcagccacggggtctcgccgtagggcagcgccgcggcgagcggcttgcccggctggtcgaaccgcaaagtggtgctgcccgttgcggtttcgatgagaatgcggcggacctgggcgccgacggcggtggcgctgggggtcagggtgagcgccgcattggtcaccgggtggtcgaaatcgatctgcatccattgcccgacggccgattgcagcgagttggacacccacgccgtcgccgggtccccgtcgatcgcggcggccggggaggtggccggcgcgacgtcgggcatcgcggtggaatccgaggccgagctcgacaccgtgatccgccctcccgtccacgcgccgagcaccggatcggcgccggggaccgggtagtcgggcacccggttgtaggtgtgccgcgcgtcgccgggggcccggatcgccgacgaatgttggtccacccggccgtaatccgtctcgcgggccaccggggtgtcggtgacggtgacgccggccccggcgggcagcggcagcccggcggctcgcgcgtcggcggtcaacagcgccgggcccagcggtggctggcccagcagccgccgcctttcgtcaaggcgcagcagcacttccggcccgccgtcgatgcgggccatccggtcggtgtcgacgaagtagggggtgcccgcgtcgccgcccgcgtcgacccggtagacctcgacggccggatatcgaggccgcaatccgctgtcggcgacgaaaccggccacggtgcccgggcccaccggcgcgccgaactgcgccaccttgtgcaggcccggcgacccgtcgacggcgcggtgcaccaggatggggcgcgccgagcgcgacgtgtcgggggccaggtcgttgcgcaccaccacatacgaaatgccttggcgggcaagcgtatcggccaggcccagcgaggggcggccggcggcgaacaaacgctgcaccgaatccagcgcccggatggtctgcggcggggtcaacgggatcgagtcgcgcaccccccacgggctggcgcccagcacctgcagcggctcgtcgtggctggtgccccatacctgggtggcgaacggggctcccggggcgacgagcacccgcccgggggtggaggagccggtgttgtgctgggtcagccagtcggccgtctgctgccaatacggcgggatcgcggtgaacgtccccggcggggtcagccggcccgtccaggcgagcgatgtgctgaccatcagcgcggtcagcaccaccaccgcggtcgcgacccgcttatcgcgctccgggtgcgcaaaggcgctgagccacaacgacttcggcgcgctgcccggcagcggtatccggcccagcagctgcgcgacgcccagcacgatcgggatcctgatcaccgagcccagcttgtgcacgttgcgcagcggcgccccgccggcgtccaggaacgcctgcaccgcgtgcgccgccggcgagcccagcccgccgctgtaaccggcggccatcaacaccaccccgacgagcagcatggtgaccagccgcccgcgcgccggcatggtggggccggccaggccggccagccccgccgccgcgaccaggcaggtgcccagcaccgccgccgacccggtcaccagcggagcccccgcggtggcggtcggcgccacgtacggggtccagctgtcggtgccgcgcaacatctccaccagcgacgaccattgcgtcgtcacacccgaggattcgatgaagtccaggaacggcgggctgatggcgcgcagcatcaccaggcccaccacccaccacagcgtggccagcaccagcgccaccagccaccacccggtgtagcgccaccacaaccggttcgggcggtggcacgcccaccagatcaccgcgggcaggcagccggccacggtggcgatcgcgttgaccgcacccatcagggcgacggccacccccgcctgcgcggccagcgcgcgcaccgacctcgggccggtggcccgcagcgccaggatggtgggcagcagcacccacggtgccagcatcatcggcagggtttccgacgagatcgaccccagcgtggtcagcacccgtggcgacaacgcgaacgcggcggcggcgatcacccgggagcccgggctgccgatccccagcgcctcggcgacccgcaacaggccccagaagccgaccgtcaacagcagcgcccaccacagccgctgggtgatccagccgggcacgccgagcgcatggccgatcaggaagaaggtgccgtgcggaaacaggtatccgtaggcctggttctgcgcctgcccgaacggcagctcgctgttccacaggttggtcgcgcgggccaggaagcgcagcgggttcgcggtcaggtcgagcttggtgtccggggagatccgcccgggcgactgggcgaacgtcaacgccagcgcgatcgcgccgaccagccacaaccaccggcgcgagaccgtcgacgaggtggggttcgtttccgtgggcgccgcccgcgccgccccgacctcgccgctagctacggtttccgtactccacccggttgagcactgacgactgcggatcgcccccgggaagtggcggcttcgtgtcttgctggaccatcaacgtgacgccgaagatcgcggccgcgccgagcaagaggccaaccacaacgctcgctgcggcgggcgcaacgatccggttcatcgaggactcctgaggttttgcgggagggcggtcgtgactcaacctagcgccaacctagcagaacggcggtcggccgaatcgccggcgccggtcacaagtgcaggcagtgcctgtggaagcagcggtcgccgtattccacctgatagggcccgagcgggtgtaccggggcgttggccggcggcgcggggtggtcggcgtggctggtggcggccaaggtgatgccgacggtgctcgccaccccgatggacagccccaccgcggcgctggccacggccaacgtgaaaccggtcatcgctggttcctccccgcacccgcgtgctgaccaggcgctggtcagcccccgctcagcaacctaccgccgatgccccctgcggacggatgcgaaacgcccgtcgtgaaagcatggcccgatggcattgtcgcgccccctcgccgcgcacgcggccgtgctggccgccgtgtcggagctgatgatcggctgcgctcaccgcgccgcacccccgcccgcgcactcgtcgacgtcgaacacgccggccgctgccccggcgccgcgggtgtgcgtcgacccgccggcagcgccggccaccctgaaccttcgcgacaagctggcccaactgctgatggtgggtgtcaagaacgccgacgacgcgcgcaacgtcgtcaacggctatcacgtcggcggcatcttcatcggcagctggacggacctgacgatcttccggggcccgctgggtgacatcgcggccaaggcggggccgttgccgctggcggtcagcgtcgacgaggagggcggccgggtctcgcggctgaaatccctgatcgggacgtcgccgtcgccgcgcgagctggcgcagacgcagaccgtgcagcaggtgcacgacctggccgccgaccgcggcaagaagatgcgcgacctgggcatcaccgtcgatttcgcgcccgtcgtcgacgtcagcgacgagcccgacgacgccgtgatcggcaaccgttcgttcggcgcggacccggccaaggtcaccgagtacgccggtgcgtatgcgcaggggctgcgcgacgccgggctgttgccggtgctcaagcacttccccggccacgggcacggctcgggcgactcccacaccggtggcgtggtcacgccgccgttggacgacctgcagaacgacgacctggtgccctaccggaccctggtgacgacgccgccggtcggggtgatggtgggccacctgcaggttcccgggctcaccggcgacgtgccggccagcctgagccccgaggcggtgcagttgctgcgcaacggcgtcggctacaaggggccgccgttcaccgggcccgtcttcagcgacgatctgtccagcatggcggccatctccgaccggtacggggtctccgaggcggtgctgcgcagcctgctggccggcgtcgacgtcgccttgtgggtcaccaccgacgaggtgccggcggtgctggaccggctgcagaaggcggttgcctcgggcgaattgccggcccagcgggtggacgagtcgctggtgcgggtggcgaccatgaagggccgcggcccggcctgcgggcactagcggctgtgcggccgaaccacattgcctacccttgactcagaacggaccggctggagaggtaagcgatggcgggtggcaccaagcggttaccgcgtgccgtccgcgagcagcagatgctcgacgccgcggtccagatgttctcggtcaacggctatcacgagacctcgatggacgccatcgccgcccaggcgcagatctccaaaccgatgctgtacctgtactacggctccaaggaggacctgttcggcgcctgcctgaaccgggagctgggccggttcatcgacgcggtgcgcgccgacatcgatttccagcagagccccaacgacatgctgcgcaacaccatcgcgtcgttcatgcgctacatcgacgccaaccgggcgtcctggatcgtgatgtacacccaggccaccagctcgcaggcgttcgcccacatggtccgggagggtcgcgagcagatcatcgaactggtcgccgggctgatgcgggcgggcagccgcaccccgcggaccgaccgcgagcacgagatgatggcggtggccctggtgggcgccggtgaggcggtggccaatcggttgtccaccggcgacatcgacgtcgacgaggcggccgcgctgatgatcgatctcttctggtacgggctcaagggttcacccgaggagcgggaagccgccgcggcccagcccgaggcggaccgctccggcgccggcggctagggctaccgtcgtcgaggtggcccgaatgcccgcaccccgctcggaccgcaacgccctcgacttcttctgcgcggtcatcatcgtcggtgtgctcgccggaatcgccggcgtggcaaccacattggtgctgcgcgtggtccagcacgccacctaccactacagtttcggcgcgctgctggccggggtggccgccagcagcccgatccggcgggtgctgggcccgatggtcggcgcggcgctggccgggctggggtggtggctgctgcggcggcgcaccgacgtgccgccgctggccgaaacgatcgcgcgctccgagcgcgtcccgcggctcgcctggagcatcgacgccgtgctgcaggtgctgctggtcggatccggggcatcgctggggcgggagggcgccccgcgccaattcgcttcagcactcggcgatttcggtatcggatggctcagacgcctgtcgtcgcgcgaccgggagatcctgctggcctgcgcggcgggggccggtctgggcgcggtgtatgcggtgccgctggccggtgcgctgttcgcggtccggatcctgctgcgcacctggcggctgcgggcggtgggcgcggcgttcctgtcctccggggtggcggtggccgtcggctcggccgtcaccggcgaccagcccaacctgcgatggccggtcgaagagtccacctacctgttgaccgcgcacgggctgttgctggcgccggtggcgctcgcggtgggattggtcttcaaccggttgatggccgtcgcccggccggcccgcccgatgcggacctggacgctgatcccggcgctggccggcgccggcctggtgacgggcgtctgctcgcattggtggcccgaattgcccggcaacggccgcagcatcctgacggtcagcctggccagcggcatgaccttggcgtcggccctggcgatcctgctgctcaaacccgttctgaccgcgttgtttttgcgcgccggcggcgcgggcggcctgttgacgccgtcgctggccaccggggcggccgccggggcggcgctggtgctgacgatcaattgggcgaccgcgagccagctgcacgtgcccgcggtgtcgctggccggcgccgccggggtgctggccgtcacccagggctcaccgatctgggcggcgatcttcgtctgggagctggcccggccaccgctgtggctgttcctgcttttcctgctgaccgcgaccgccgcgcacgggctgaaagtgcttgcccagggccgtactacgacgcacgccggctgacctacagcgcccggacggttccggtcaggtgcgggtagcccttggcgatgttgcgtagcgcgatgtcccagccgccgtcgtgttcgtcgatgtagagaccggtggtcgcgggcagcaccaccggcttgccgaaccgcaccgagtagcgcaccgcatcgggaatcgcggcttcgatgttggccaataccgctgcggcgctgaacattccgtgcgcgatcacggtggggaagccgaacagcttggccgcgatcgggttggtgtggatgggattgtggtcacccccgacgacggcgtagcggcggatcagccccggggtgatgcgcagcacggtcggcggcggcggcagcttgggctgcttctgcggcggcggtttgggttggtcggacaggctggtgcgctgctggtgcaggaaggtggtcacctgatgccacgcggtgtcgttccccacgctgacgtcggtcaccagatcgaccagcagacccttgcggtgctcgcgcaggttctccgcgtgcacccgcaccccgacggtgtcggtgaccgcgatcggacggtactgcgtgatgtggttctcggtgtgcaccgaacccattgccgcgaaagggaagtcgaacccggtcaccagcgacatcagcgccggaaaggtcagcgcgaacgggtaggtcaacggcacgtggttgcggtagcgcagcccggtgaccgccgcgtactcggccacgttggtgcggtcgatgggaaggtcctcgacggtgaccgtgcgggtgggcagcgcgctgccgcgggacaccaccggcagcgccccggcggccgcgcgcagcatgttcttcaagccgctcggctggttcatcatgcccccagcatcgcctggccgcagacccggatgacgttgccggtcaccgcgttcgacgccgggctggcgaagtaggcgatggtttcggcgacgtccaccggctgcccgccctgcagcagcgagttcatccggcgccccacctcgcgggtggccagcgggatggcggccgtcatctgggtctcgatgaatcccggcgcgacggcgttgatggtgatgcccttgtcgtagagctccggcgccagcgcctgggtgaggccgatcatgcctgccttggtggtggcgtagttggtctggccgcggttgcccgcgatgccggccatcgacgaaaggccgacgatgcggccgccttcgccgatgctgccgttgcccaccagcccttcggtaaggcgaagtggggcaagcagattcacggccaacacggcgtcccagcgcgcgtcgtccatgttggccagcagcttgtcgcgggtgatcccggcgttgttgaccaggatgtcggcgtgaccgccgtggtgctcgcgcaggtgctcggtgatcttgtcgacggcgtcgggggcggtgacgtcgagccacagcgcggtgccgccgacccggctggccgtctcggccagcgtctcggcggccgattccacgtcgatcgcgaccacgcgggcgccgtcgcgggcgaacacctcggcgatcgtggcgccgattccgcgggccgcaccggtcacgatggcgaccttgccgtccagcggccgttcccagtccgccgggggggtggagtcggcctcgccgacgtagaagacctggccgtcgacgtaggcggacttggccgacaggatgaaccgcatggtcgactccaggcccgtcgcggcgggtttggcggccggcgacaggtacaccagcgccaccgtcgagccgttgcgcagctccttgcccaatgaccgggtgaagccctccagggcgcgctgggcgatccgctcgtgcgggccggcggcggcgtcgggcgtggtgccgaccaccaccacgcgggcgcagtgacccaggttgcgcagcagtggggtgaagaactcgtacagccccttcaggccctccggggtggtgatcccggtggcgtcgaagaccagcccgccgaaccggtcggcccagcgcccgcccaggttgttgccgaccaggtcgtagtccttggccagcgccgcccgcagcggctcgaccacgcggccctcgccgccgatcagcagcgacccggccagcggcgggtcaccgggccggtagcggcgcagcgtctcgggttgcgggacgccgagctgcttggcgagaaacgatccaggaccggaattgacaatctgcgagaacagatcggacgagaccttcggagccaccggagctaccttccgtgttgtttctgcgtcggggtatgcctataggacaaccgtatcgaggacgaacttacttcagagtaagaacagtgggtagtatggcccgagacgggcgacccgcaaaccgaccaaccgcagacacacggagaacacaagtggcccctgcaagttccgaggcaagcaaaccggctgctcagcgcagtgcgcagcggcggccagtggccgtcctgggtggcaaccggattccgttcgcccgctccgacggcgcctatgccgaggcgtccaaccaggacatgctcaccgccgcgctggaggggttggtggaccgcttcgggctggccggtgagcggctgggcgtggtggtcggcggcgcggtgctcaagcacagccgggacttcaacctgacccgcgaatgcgtgctgggttcacagctgtcgtcctacacgccggcgttcgacctgcagcaggcctgcggcaccgggttgcaggccgcgatggcggccgccgagggcatcgccgccggccgctacgacgtggccgccgccggcggggtggacaccacctcggacgcgccgatcggcctgggcgacaacctgcgccgcacgctgctgaagttgcgccgggccaagtcgaacgtgcagcgactcaagctggtgggcacgctgccggcgaccctgggcgtcgagatcccggtcaacagcgagccgcgcaccggcctgtccatgggcgagcaccaggcgatcaccgccaagcagatgggcatcacccgggtcgcccaggacgagctggccgccgccagccaccgcaacatggccgccgcctacgaccgcggcttcttcgacgacctggtcaccccgttcctgggcctgtaccgcgacgacaacctgcggcccgactcgtcgccggagaagctggccaagctgcggccggtgttcggggtgaaggccggcgacgcgacgatgacggcgggtaactcgaccccgctgactgacggcgcctcggtggcgctgctgggcaccgaggagtgggcggccgcgcactcgctgaccccgctggcctacctggtggatgccgagacagccgcggtcgactacgtcaacgggcgcgacggcctgctgatggcccccacctacgcggtgccgcggctgctcgcccgcaacggcctgagcctgcaggacttcgacttctacgagatccacgaggcgttcgcctcggtggtgctggcccatctgcaggcctgggaatccgaggactactgcaaggaacggctgggcctggacgccgcgctgggctccatcgaccgctccaagctcaacgtcaacgggtcctcgctggccgccggtcacccgttcgcggccaccggcgggcggatcctggcgcaggccgccaagcaggtcgcgcagcgtaaggccgagctcaagggcgccgacaaaccggtgcgcgccctgatctcgatctgcgcggccggcggccagggcgtggccgcgatcctcgaggcctgacgggccgggcccatgagttgggtcacatcgcgttagcaagggttagtaaccggaggccgcgggtatccgtgaccccggatagccccgtgttgtggtctgaccccccgacgccgacggcaatacggggcatccctgacacgaccgcctgtcagtttgcgcgacgggcgtccgagaagggccgccgctggagtgaggggatccagcggcggcctttttctgcgcccgatcgtgcgcccatccggcgccgcgcaatcaaaaaccccgctcccatccggaagcggggtttttgattgcgcttgtcagcggcctcggaagggctttagaaggccgcctcgtcgagctccatgatgtcgttgtccagcgtctcgatgacctcgcgggtgctggtcagcatcggcaggaagttcttcgcgaagaacgacgccaccgcgatcttgccctcgtagaaggaccggtcctccccgctggcgccggcgtccagcgccgccacggccaccgccgcctgacgctgcagcaaccagccgatgatcaggtcaccgacgctcatcaggaaccgcaccgaacccaggcccaccttgtacaggctggtcacgtcctcctgggcggccatcaggtagccggtcagcgcggtcgccatgccctgcacgtccgccagcgccttggccagcagttcgcgctcggacttgagccggccgttgccggactcgctgtcgacgaacttctggatctgctcggacacgtgggccagcgccacacccttgtcgcggacgatcttgcggaagaagaagtcctgcgcctggatggccgtggtgccctcgtagagcgagtcgatcttggagtcgcggatgtactgctcaatcgggtagtcctgcaggaagccggagccaccgaaggtctgcaggctctcggtgagcttggcgtaggcctgctcggagccgacgcccttgaccaccggcagcatcaggtcgttgaccttgaccgccagttcggcgtccaccccgtagagcgcctcggcgaccgccgcgtcctggtaggtcgaggtgaacaggtacagcgcgcgcagaccctcggcgtaggccttctgggtcatcagcgaccgccgcacgtccgggtggtgcgtgatggtcacccgcggtgcggtcttgtcggtcatctgggtcatgtcggcgccctggacgcgagacttggcgtactccaacgcgttcaggtaaccggtcgacagggtcgcgatggccttggtgcccaccatcatgcgggcctgctcgatgacctcgaacatctgcgcgatcccgttgtgcacctcgccgaccagccagcccttggccgggacgtcgtgctggccgaagctcagctcgcaggtcgccgacaccttcaggcccatcttgtgctcgacattggtgacgaagacgccgttgcgctcgccgagctcaccggtctcgaagtcgaacaggaacttgggcacgaagaacagcgacaggcccttggtgcccgggccggcgccctcggggcgggccagcaccaggtggaagatgttctcgaacaggtcgtcggagtcggccgaggtgatgaatcgcttcacaccgtcgatgtgccaggagccgtcgtcctgcttgaccgccttggtgcgcccggcgccgacgtcggaacccgcgtccggctcggtgagcaccatggtcgaaccccagccgcgctcggcggccatcacggcccacttcttctgctcgtcggtgcccaggtggtagaggatgttggcgaagcccgcgccgccggcgtacatccagaccgccgggttggcgcccaggatgtgctcgtgcagcgcccacagcagcgccttgggcatggcgaccccgccgagggcctcgtcgatgcctaccttgtcccacccggcctcgatgacggcgtggacggacttcttgaacgattccggcagcgtcacggagtgcgtcttcgggtcgaacaccggcgggttgcggtcgccctcgacgaaggagtcggcgatgggcccctcggccagccggctgatttcgttcaacatctcgcgggccgtgtcggcgtccagatcgctgaactcgccttgccctaaagccttgtcaacgcccagcacttcgaacaggttgaattcctggtcgcggacgttgctcttgtagtggctcactacggtcctcctcgttgagaatgccacttgtggttgggtactaggtctaagttacccaccagtaacaacttcaaaatatcgttcgcgtcagcgggatgcaagccaatgtgagctagatttcattgcctaattaaccaaccggttgggcagacgggtgcccacgccgtgtgcaacccatctacctgcggtgacggtggggaggtgagcaacgagatgtgccctgtgccgggcgtcaccgcggtgcccgaggtggacctgcgggccgattccgacgtgttgcgggacggcctgcgcgaggccgcgcaccgggtcggcttcttctatctgaccggccatggggtaccggcggacctggtggaccgggtgctcgacgccgcgcgccggttcttccggctgccccaggcggacaaggacgccgtcgcgatggtgcgcagcccccatttccgcggctacacccggctgggcggggagcggacccgcggtgcggtcgactggcgcgaacagatcgacatcggtccgcaacgcccgccgatcggcgggctggacaagtcggactaccggtggctgcagggccccaaccagtggcccgcggcgctgccggagctgcccgggctcatcgaggagtgggacgccgcgctgtccggggtggcccgcaccctgctgcggcattgggcggccgcgctgggcagcccggccgacgtgttcgacgcggcgttcgccgatgcgccggccaccctgatcaagatcatccgttacccggggcgcgcggccggcccgcagggggtgggcgcgcatcgcgacgccggtgtgctcacgctgctgctggccgagccgggcagccggggcttgcaggtgtgccgcgccgggccgggcggcgacggctggatcgacgtgccgccgcggcacggtgcgttcatcgtcaacatcggcgagctgctggaggcggcgacgcggggctacctgcgcgccaccgagcaccgggtgaatctggcggggtcgacggcagagcggatctcggtgccctacttcttcaatccgcgcctcgacgcccggatacccgtgctgtcgctgccgcctgaactccgggcgcgcgccgtcgagcgctggaccccgtcggaggatccggccgaccccatcttctccgtctacggccgcaacgcctggaagagccggctgcgctcgcaccccgatgtcgcctcggcgcacgccttttcggcgcaccacggcgcagcggactgatccgcgtagcgccagggtggccgcgacggcgccatccgcgccgggtagggtcacatccgaaaaatcccgtgtccggcctaggggcgaatgaagtccggtgaattcgaacaacaagctgacagcgtcgtcacttcgtgaggccttcggtcatttcccgtccggtgtggtggcgatcgccgccgaggtgaacggaaccctggagggcctggcggccagcaccttcgtcccggtctcgctggaccccccgctggtgtcattctgcgtgcagaacacctcgactacctggcccaagctcaaggaccggcccatgctggggatcagcgtgctcggcgaggagcacgacgaggccgcccgcacgctggccgccaagaccggcgaccggttcgccgggctggagaccgtctcgcggcccaccggcgcggtgttcatcaagggcaccgccctgtggctggaaagcgcggttgaacagctgatcccggccggggatcacaccatcgtggtgttgcgggtcaacgaggtgaccgtggacgccaacgtggtgcccatcgtgtttcatcgcagcgggttccgccgcctcggcgcctgatcttttctgattttccggcccgcccctcggtcaggttggtcaggggcggtggctgagttcttcgcgaaaaccctggatgcggttctcgagttcggcggcgtcgccgtgccgcccctccttgcgcgccagctgggcgcgcaccgacaactgccgaatcgcggtacgaatgttgttgatgctggcggtctctcgcatcggctccatgagatgcctttccggtcgtgggtacacggccgcccgcaggcggcccgacaggatgccagggggttacccggggaccgcgacggcctaacccggccgcgcggccggcatgctcagcgacggaacagcttgttacccagccagaccaccgggtcgtacttgcggtcggcgacgcgctccttcatcgggatcagcgcgttgtcggtgatcttgatgttctccgggcagacctcggtgcagcacttggtgatgttgcagtagcccaggccgtgctcttcctgggcgtccttgcgccggtcccgggtgtccagcgggtgcatctccagctcggcgatccgcatcaggaagcgggggccggcgaacgccttcttgttctcctcgtggtcgcggaccacgtggcacacgttctggcacaggaagcattcgatgcacttgcggaactcttgggagcgctggacgtcctcctgcgccatccggtactcgccgggttgcaggtccttgggcggcgcgaaagacggtatctcgcgggccttctcgtagttgaacgagacgtcggtgaccaggtcccggatcaccgggaacgtccgcagcggcgtgaccgtgacgacctcgtcctcggcgaacgtcgacatccgggtcatgcagagcaaccggggatagccgttgatctccgcggagcacgagccgcacttgcccgccttgcagttccaccggaccgccaggtcgggcgtctgggtctgctgcaggcggtggatgatgtcgaggacgacctcaccctcgttgacctcgacggtgaagtcctgcaacgcaccgttggcgtcgtcgccgcgccacacccgcatcgtcgcgttgtaggtcatttacttctccgtcctgggtgtccgccctggatgcccggcgagctcctcgtcggtgtagtacttctccagctcggcgatgtcgaacagttccagcagatcgggccgcatcggcgtctgctctttcttcgtgatggtgatgtcggggatcaccgcggcttcaacgtcgcctggctcggcgactgcctcgcagaccagcaacagcttgcgccacgacgagtccatcgacgggtggtcgtcgcgggtgtgcccgccccggctctcggtgcgctgcagcgcggccttggcgacgcattcgctgaccagcagcatgttgcgcaggtcgatggccaggttccagcccgggttgtagcggcgctgcccctccacgtgcaggttcttgaaccgttcccgcagcttgtcgagccgggccaaagcctcggagatctcgtcggcattgcggatgatgccgaccaggtcgttcatcgactgctgcagctcgagctgcagggtgtaggggttctcgccggggccgccgcccgccggcgcctcgaagggggacagggcccgcttcgccgccgcctcgacggcgctctcgccgatcgtcggacggctgctcagcgcgcgcacgtagtcggcggcgcccagcccggcccggcggccgaacaccagcaggtccgacagcgagttgccgcccagccggttggagccgtgcatgccgccggagcactcaccggccgcgaacaggccggggacggtggccgccccggtgtcggcgtccacctcgacgccgcccatcacgtagtggcaggtcggtccgacctccatcggctccttggtgatgtcgaccccggccagctccttgaactggtggtacatcgacggcagccggcggttgatctccgccggtgtcagccgcgacgcgatgtcgaggaagacgccgccgtgcgggctgccgcggccggccttgacctcggagttgatggcgcgcgcgacctcgtcgcgcggcagcaggtcgggagtgcggcgggccgagtcgttgtccttgagccactggtcggcttcttgctcggtctcggcgtactggcccttgaacaccggggggatgtagtcgaacatgaaccgcttgccctcggagttcttcagcaccccgccgtcaccgcggacaccctcggtgaccaggatccctttcacactcggcggccacaccatgcccgtcggatggaactgaacgaactccatgttgatcagcgatgcgcccgcccgcagcgccagggcgtgcccgtcgccggtgtactcccaggagttcgaggtgaccttgaacgacttgccgatgccgccggtggccagcaccaccgcgggcgcctcgaacagcacgaactggccgctctcgcgccaatagccgaacgcgccggcgatcgcgtcgccgtccttgagcagctcggtgatcgtgcactcggcgaacaccttgatgcgcgcctcgtagtcgccgagttcggcgtaatcctcctgctgcagcgagacgatcttctgctgcatggtgcggatcagctccaggccggtgcggtcaccgacgtgcgccagccgcgggtaggtgtgcccaccgaagttgcgctggctgatcttgccgtccttgagccgatcgaagagcgcgccataggtttccagctcccagacgcggtccggggcctccttggcgtgcagctcggccatgcgccagttgttgaggaacttgcccccgcgcatggtgtcgccgaagtgggtcttccagttgtccttcgggttggtgttgcccatcgaggccgcgcagccgccctcggccatcacggtgtgcgccttgccgaacaacgacttgcacaccaccgcgacgcgcaggccgcgttcccgcgcctcgatgaccgcgcgcaatcccgcgccgccggcgccgatgacgactacgtcgtaggcatgccgttcgacctcaaccatgaaacctcgctagctaattctgattcttcgtcaaatggcttgtcagccaacaaatctcaggtcggggatggtgccgctggccaccagggcgatgtagaaatcggtgagcatcagggtgcccagcgtgatccaggcgtacagcttgtgccgggtgttgatgtggctgacctgggtccagatccagtaccgcacagggtgcttggagaaatgcttgagccggccaccggtcacgtgccggcaggagtggcaggacagcgtgtagacccacagcatgatgacgttgccgagcaggatcagattgcccagcccgaagccgaatccgcccggaccggtgtcggagtggaacgccacgatcgcgtcgtagctgttgatcaccgagatgaggaaggcgatgtagaagaagtaccggtgagtgttctggatgatcagcgggaacctggtctcgccggtgtagtggacgcggggctcggccaccgcgcaggccgtcggcgactgccacaccgtgcggtagtaggcgccgcggtagtagtaacaggtcagccggaacagcagcaggaacggcagcgacaccgccgcgtacggcaaccaccacacgtccggcaggaactgcggccagatgtcgccggcctcaccgcagcccttgctgacgcacggcgagtagaacggcgtcaggtagtggtacttgccgacgaagaagtagttctgctggaaggcccgcgccgtcgcatagatgaggaacgcggcgaagcccaggtcgatccgcagcggcgacatccaccaccggtcggtgcgcagggtgcgttgctcgatgcgggcgcgtgtgggtgaaaagacaccggacgcaggacggttcgccgtgggtgcgctcatctggttgttcctcttcgaacgggctgtctgtcgaagggtacacagatgcggagccccccttctgcgggggggctggctgggggcgcccgggttgttcaggacctgtggtggccgccgacgccctcgtcgtcgacgtcgcgccagaattcgctgtcgtactgggtgtcggggatgacgaccttctcaccggactgctgcacggtggcgcgggccaggtccaattcggatacgtcggtgtcgagtaggtcgacgtcggacaggatgcggtcggcgtcgatgacgatgcggcgcatcgccgggctgtcgccgtagcgcgcccgcagggagctcacacaccgccgcaggccgccgatgaggtcgtgcagctcggcgaattcggtcgtgcccgtggtgcccggcgtgctagtcaacggatctcgtcgaggagtgtttcggatcacagtacgtccccgatagtagccacgacacgcgccgggcgtcaggcgttcatcggccccgcgaccggcacgccgcgtcggcgggtcgccggatgctgcctgccgggcgcaccaacagacgcgcgagcagacgcagtactgcgcggattacttggtgatcgcgatgcgcttcgcctggtttccggcgtacgcaccggtgacccggaccgtcagcaccccggcgtcgtaggacgccgtgatgtcgtcgtcggtgacgtggccgggcagctggaacgaccggtggaacgagccgtagcggatctcccgcagcgtgcggccgtccttctcctccgcgtgctcgtcgcggtgctcgccgcggatcaccaggcggccacggtccagctcgacctggacgtcctggtcgacgtcaacgccgggcagctcgacacgtacgatcgcgtcgtcgccgtccttgacgatctcggcggcgggcttgaaagcgctggtcgcgggcttgttccagtccgccgcggcggcggggccgaagaagtcgcgcagccaccggtcggtgtcccaggccggtcgtgtccacaatgcgaggttgctcatggtgcttcccttccacttccttgagcttcgttgtgagattcctgtgaccggcgcctcgtcggccggctactcctacaaacatgagtcgaccacgcttaagttccagctggccgttcgccggcagcgaacgatcaatcacagccgttcctgtgagttgtgagatcctcgtcataggaccgtcacattgggcgaaaaaggcgtaatttctcgccgttactctcaaagccatgtctgcagacgggatttcgcgcgacggctgtgcgccgcgtcacatcatcgtagtcggacatggcatggtcggacaccggttcgtggaggcgctgcgcgcccgcgacaccgagggccgttggcgcatcacggttttcgccgaggaggctgacgccgcctacgaccgggtggggctgacttcgtacaccgagagctgggaccgcgcgctgctggcgttgcccggcaacgactaccagggtgacccgcaggtccggctggtgctcaaccagcgggtcaccgaaatagaccgcgcgacaaagtcagtggtgaccgccgacggtcagcggcaccactacgacaccctggtcctggccaccggttcctacgccttcgtgccgcccgtgcccggccacgagctgcctgcctgccacgtctaccgcaccctcgacgacctcgacgccatccgcgccgacgcccagcgtgcggcgcagaccgcccatgctcgcgccggcgtggtcatcggcggcggcctgctcgggctggaggccgctaatgcgctgcgccagttcggcttagcgacccatgtggtcgagatgatgccgcggttgatggcccagcagatcgacgaggccggcggcgcgctgctggcccggatgatcggcgacctgggcatctcggtgcacgtcggcaccggcaccgaggcgatcgaaccggtcgagggccccgacgggtccacgacggtgcgggtgcgcctgagcgacggccaggtgatcgacgccggcctggtcatcttcgcggccggcatccggccgcgcgacgagctggcggtcgccgccggcctcgcccgcgccgagcggggcggggtgctcaccgacttgtcctgccggacaagcgatcccgacatctacgcgatcggcgaggtggccgcgatcgacggccggtgctacggcctggtggggccgggctacacctccgccgaagtggtggccgaccggctgctggacggcagcgcggagttcggcgaggcggacctgtccaccaagctcaaactgctgggcgtcgacgtggccagcttcggcgacgcgatggggacgaccgagaactgcctcgaggtcgcgatcaacgacgcggtcaaccgcacctacgccaaactggtgctctccgatgacgccaagaccctgctcggcggtgtgctggtcggcgacgcctcgtcctacggggtgctgcggcccatggtcgggagcgagctgccgggcgacccgctggcgctgatcgcgccggcctcctccggcggcggaacggcgttgggcgttggggcgcttcccgattcggcgcagatctgctcctgcaacaacgtcaccaagggcgacctgaaatgcgcgatcgccgacggctgcgccgacgtcgctgcgctcaagtcgtgcacctcggccggcacctcgtgcgggtcgtgcgtgccgctgctcaagcagctgctggaagccgagggggtggagcagtccaaggcgctgtgcgagcacttcagccagtcgcgggccgagctgttcgagatcatctcggccaccgagatccgcaccttctccggcctgctggagcgcttcggccgcggaaagggttgcgacatctgcaaacccgtggtcgcctcgatcctggcgtccaccgggtcggagcacatcctggagggtgagcaggcctcgctgcaggattccaacgaccacttcctggccaacatccaaaagaacggcagctactcggtggtgccctgggtgcccggcggcgacatcaagcccgagcacctgatcctgatcggccagatcgcccaggacttcggcctttacaccaagatcaccggcggccagcggatcgacatgttcggcgcccgggtggaccagctgccggcgatctggaagcggctggtcgacggcggcatggagtccggccacgcctacggcaaagcgctgcgcaccgtgaagagctgcgtgggcaccgactggtgccggtacgggcagcaggactcggtgcagctggccatcgacctggagctgcgctaccgcgggttgcgggcgccgcacaagatcaagatgggcgtctcgggctgcgcgcgcgagtgcgcggaggcgcggtccaaggacgtcggcgtcatcgccaccgagaagggctggaacctctacgtcggcggcaacggcggtatgacgcccaagcacgcgcagctgctcgccagtgacctggacaccgagacgctggtccgctacatcgaccggttcgtcatgtactacatccgcacggccgaccggctgcagcgcaccgcgccgtgggtcgagtcgctggacggcggtctggaccacgtccgcgaggtggtgtgcgaggactcgctggggctggccgaggaattcgaggccgcaatggagcggcatgtgcgcaactacaagtgcgaatggaagggcgtgctggacgatccggacaagctgtcgcggttcgtgtcgttcgtcaacgcccccgacgccgtcgattcgacggtggcgttcaccgagcatgccggccgcaaaatccctgtgtccattggcatgccgaagatccgtcaggggtagttccggaggaactgggagataacatgacacttctcaacgacattcaggtgtggacgagcgcatgctcctacgaccacctcatccccggccgcggtgtcggggtgctgctcgacgacggtttcccaggcggcgctgttccggctcgacgacggcacggtgcgcgcggtgggcaacgtcgacccgttctccggggcggccgtgctgtcccgcggcatcgtgggcgaccgcaacggctgcccgacggtgcagtcgcccatcctcaagcaggcgttctccctcgaagacggtatctgcctggacgatccgagcgtttcggtgccggtgtacccggtgcgcatcaccgccgacagctacgttcaggtgggccgcgactaccagccgcgggcggcctgagcggtcaccgggtgatgtcgccgaccaggtagcgctgcatagtcggcccgatcgcgtcgacgatggcgtccaccgacatcgaatgcagcggctccgagcggatgccgtagcgcatgatgcccaggcccaccagctgggaggcgcacaacgaggcccggacggccaccttgtcggcgcccaggattctcagcagcgggccgaagaccgggccgatgaacatgccctgcacgatctcggcggtctttgccatcccggtggacgcgatggcgctggccgcgaacggcccgccgccggcggcgtcccacgtggtgatcagcatccgcaacgtgcgccggcctacctggttgacgcccccggtgacgatccggtcgatgaattccggtgtgccgaagggcaaccgcagcatcttggccacggggtcgagaagcccgtgcgacggctcttcgcggcggggcatggtgtcaggatcgccggtcgtggggcaaagatcaaggaaccggccgcgtggcgggcgcgtgggcgcgctggtgcggacccgttcggcgggacgcgtgccgggcggtggcggcgagcaccggcggcagggcgcggcggaatcggttcgcgatcagccgcgccagccccggatgtgtgctcagcggcgcgctgaccagatcggcgccgcagccgtgcagccgctgttggaacagcccgtcggccagcaggtaggaggcgacgaccacgcgcccgccgttgcggcgggcatgcggccgggcccgggcgaccgcctcgcccagcggcgggtccccggtggcggcgaacccgagggtgacgcgtgatccggtcagcgccgacaaccacgtcgccgcggtgtgcaggtcggcccgcgccttgtcgtcggaggtgcccgccgccgccagcactactgaatcgtttgggcgccaaccacattcgagcagttgatcgccgacgatccgggcgatctggccgctgggccccagcgccggggtgactgtgacgttcgggtgtccgctgagcgcgacgtgggctggcagatcggcgcggacgtgataaccgcgcgacaggaaggccggcaccacgatggcgggccggccggccgcccgggccgcggccaggacctcgctgggggtcggccccaccacgtccacgaacgccacctcgacgcggccgccgacgagcgtactcacttgcgccgcaaggccttcgatcatcgccacaccgcccggccggcgggtgccgtgcgccaccaggatcagtgccatgccgatccgtccggggtgtcgatcgccagccggtagccgcgcttgaccaccgtcgcgatgatgttcttgtcgcccagcgccgttcgcagccgcagcacggccgtgtcgacggcgtgcgggtcgttgctgttgccgggaagcacccgcagcaagtcgttgcgcgcgaccacgtcaccggggcgcgccgccagcgcgcgcagcgtcgccatggccgacccggacagcgacttgaccgcgccgtcgaccagcacacaggtgccgcggatctcgatctggtgcccggccgcccgcaacgtgcacgagcgcagcggcggcaactcctgggcgatgtgacgggccaacgcccccaaccgcattcgctccggcgacgacgtcggcacacccgcgcggatcaacggctgcgcggtcaccggccccacgcacatggcgtgcacgtcgctgcgaagtgcttgcagcagttggtcttcgatgcccagctcgcggctgcgctccagcagcgccgcgccggcgggcgccgaggtgaaggtgaccgcgtcgaactgccgccgcgccacggaggcgacgagttggtcgaattctccgccggccggtgtcggcttccagcggtagacgtggatgggcatcacctgcgcgccggccgagcgaagcccattgatgaactccgggaagggatcccagccgtcggccgcgccgtgcagctgcaccgcgatccgcttgccggccacaccggagtcgagcaggtagcgcaacacctcgcgcgacgattcggatttcggcgaccactcctcgtgcagcccggcggcgcgcaacgcgcccgtcgccttgggcccgcgggccacgatccgggcctgcgacagcgccgacagcagttggggggccaggccccagccgtcggccgcggcgacccagccgcggaagccgatcccggtgtgcgccaccaagatatcgggcggttgggcgatcaccgcctcggtgtggcggtgcagctcctggtcctcgggcagcgcgatgatgttgatggcggcggcgctggtgacttccgcgccgttgcggcgcagcaacgcgcacagctcctcggcccggttcgccgaggtgacggcgatccggtagccggtgagcggcgcggagtccggcggggccagttgcggggccatatgaagtgtgtatgcctaggacgtttccgttgcgttaccgagcaattgctgtggcattgcccctgttgcgagtccgctcacagccgcgcggcctgggtttccggcagcgagaccccgggcgcggcgaccggccgccgcacgtacaccagccaggtcatgatggcggcgacgacgtaggacgccatgaacatccagtacgccgacgtctcggttccggtgctcaggtaggactggtgcagcgccaagttgatcgccaccccgccgaacgccccgaccgccgagcagatgccgatcagcgaccccgacatggcgcgcgcccattggcggcgctcgtcctcgctggtgtcccggccgcggctgcgggcctcgtagaccgacgggatcagcttgaacaccgagccgttgcccatgccggacaggatgaacagcaccatgaagccgacgacgtagccgatcatgctgaccgaatgcgcgcccgcgtgctggtcgtcgacggtgctgacgatcaccagcaggccggccgccagggtcatcgcggccagcacgcccagcgtgacgcggctgccgccgacacggtcggccagccggccgccgtagatccgcgccaccgagcccagcagcgggccgatgaaggccagctgggcggcgtgcagcgcggcatgcttggcgctttccccgttctccaggaagttgacctgcatcacctgcccgaaggcgaacgagaagccgatccaggagccgaaggtggcgatgtagagcagcgagatcacatgggtgtcgcgttcgaacaagatcgagcgcatggtgctcagctgggtgccgtggttgatgtcgtccatgaacatcgcggcggcgatggccaccgcggccaggaacaccagatacaccgcgcacacccagtacggggcctggtgtccggcggtggccagcaccagcaggccgaccagctggatcaccgccacccccaggttggcgacgccggcgttgacggccatggccgcgcccttgagccgctgcggatagaacgcgttgacgttggccagagacgccgcatagttgccgccgcccagcccggtcagggcggcgcacagcacgaaaagccacagcggcagaccgggattggccagcaagacgatggtgccgacggtggggatcagcaatacgaccgccgagaaagtcgtccatttgcggccgccgaaggccgcgatgcccagggtgtaggggatccgggcgcagccaccgaccagggtggccaccgcgcccagcagcagcttgtcgccggcggagaagccgtacacggccgcgggcatgaacagcgccatcaccggccacagggtccagatcgaaaacgccacgtggtcaccggcgatggtgcacagcaggttgcgacgggcgatccttttgttgccggcctcccaggccgctgcgtcttccggattccagtccgtgatgcggtggtcgcggcccatccgatcgtcacctttcctcgaagaagacacgccgttgtcgtccgctcgccgtcgaaacccgttgggcgcgttcgggtatggcgcccatcggacggcgtcgtcgagccaggtggcaccgcgctcacccggggtatcgggaaagctgttgccgagcctggctttcgacgcctgtgtgggcaccccgaacgaagaggcgtgccccgccgtgttttccgatgctcacactttggacgcgagcgggtcaaccggaacgggccgatatcggctgtcagttgattaccagttgtctggtaaatccctgaagggtcgatcggcgcgggtcagcggcgaatgcacagcggcgccaagtgatttcatccagagacggcggccggtgtgagctgggcaatagttcgtgcgcgagcggcgtcaggcgaacggccaactggcggcgccggcgtgggcgccggccagcgcgcggggccgcgcccagtgcagccgcacgtattggccgggccgcacttgggcgattttgtcgacgtcctcgtcagtgaccacgccgaccaccgggtagccgccggtgaccgggtggtcgggccccaggatcaccggtaaaccgttgggcggcacctggattgcgccgcgggtggtgccctcgctgggcagctgccggtccgggtagcggtgttgcagggggcgaccctccagccgcatgccgacgcggtcgctgcggtcggaggccatccagatggtgtgcaccagtgcatcgggattgaccaaccagtcgtcgcgcggccccggcaccacctgcagttccatcagatgcccggtgatggccgccaccggcgcctggtccagttcgggatagtcctgcgtgtgttcgccgatcggcagccggtctccggcccgcagcggcgccgggccgatggccgacatcacgtcgtagctgcgcgaacccagcaccgggtccacgcagatgccgccgcggaccgcgaggtagctgcgcagcccggcgcggggcgtgcccaacgcgatcacctggccgtcgcgcacatgctgaatgctgttgctgccgaactcgattccgtcgaccgtgggatccgcgtcggccccggtcaccgcgatgtcgacgtcgccgccgcggacccgggccgcgaaaccgccaaaggtcacctccacggtggcgcggtcgtcggggttggccaccagccggttggccagcttgtgcgcgcgccggtcggcggctccggaccggctgacgccgaggtgggccaggcccggccggcccaggtcttcgacgacggccagcggcccggtgcgcagtatctccaggaatggcacagctgtctccttagcgaggctagacggcccggaactgaacccacatgccctgcgtcagcagggccgggttgggtcgctgcagatcccacagcaccgcgtcggtgtgcccgataagctgccagccgccgggcgaccggcggggatagatcgcgctgaattcgccggccagcgccaccgagccggcaggcacggcggtgcgcggctcggcgcgccgcggcacccgcagccgcgggtcgccgtccaccaggtaggcgaaacccggtgcgaatccactgaatccgacctgccacggggtgccggtgtgggcgtcgatcagctgcgggatggtcagtccggtgtgttcggcgacctcggccaaatccgggccgtcgtagacgacgtcgatgaccacgtcggcgtggcgctcggcgggcggggtggacgcggcggtgacgttcatcttgcgcagccgctgccggaggaggcgttgccggccggggtcgtcgagcttgaccagcaccgtgcgggccgcaggcacgatgtcgaccacgccgggcagcgccgcggcgcgcagcgcctgcgcccacgccaatacctctgcggtactgccgcattgcaccatcagcgctcgatcgccgtagtccagcacggcgttgccgaccagggctgtcggcaggtggtgggccaggtcgccgctaagatccgtcacgctcattactcgacggtaaccccgggatcgcggcccgtgcgaggggtggccgacggattttcgagcactgccagagctgccttagcaaacgctcaaacagccgcgactagcccaggatcttggtcagctgcgggggcagctggtcggcgatcaccgggtagctcagcggggacgcgaaggcgatcgcacccgcctggtccttggtggtgaagatgtgccggttctgtgcggtggtcagcgacccggccacctcggggtcggccagcagcgccttttggtcgtcggggttctgggtcgtccagatcaccacgtcggcggattccagcaccgatttgatgtggtcacgcgggatgacggcgcgctgatcggtgccgaacggtttgatgctgtcggcgatgaccagccccatctggttgaggaagtcggtgcgccagccggccatggtggccaccacggtgccctgccacagcgccccgtgcatcagcagcgccttcttgccggtccattgcgggttcttcttgccgatatcggtgaacttctggtcgacgccggcgaccaacgacttcattttctcggccgcgaacaccgcctggccgacggcggcggcctgctccttccacggttcgaagaaggcgtccccgtccgattgcgccacggtcggggcgatcgcggacagcttctggtaggtgtcggcgtccagccccgcgttgatggccacgatcagatccggtttgagaccggcgatctggtcgaccgggatgccgttgtccaggttcagcacggtgggctgggccccgccgagtttgtctgcggcccaaggccacaccgcgaacggctggtcaccgaaccagttggtcaccgcgatcggcaccacgcccacggcgagcaggtcgtcctgctcggtgtagccggcgctgacgacgcgcttgggcggttccttgacgacggtctggccgaacaggtgggtgacggtcaccgatcccggcccggcgccccccgggggcggctggtgtgccgagcaccccgccgacagcccggccgcaccggccgtcgcggccacgccggctgcccctgcgagctgcaagaatccccgtcgattccatccctgtcgcatcgcgtgagagtatcgcgttccgcccccacacacccatcgccgcgctggtgaggccgctcagtccagcggcatcccggcgtccatgaaatccagtgcccggtagatggtctcgggcgtggtgggggcgctgtcaaaggccgccatcatggcgccggtcaacgccccggcgaacacccggacctcgaaatcgtctgcggcccggccgatccgatgcgcgatcgcctcggcggcgacggtcacggtgcggtagtactcgtcgtacatggctgccttgagctcggggatggagaacatcagccgctgccgggtgctctcgaactccagctggtcgtcgggcagctgggacagcaccgtcgcataggcccggcggaacgcctgcggcagcgacagctcgcgcggctgcgccttgagggcgtccaggatcagcgggtccaggtcgtcggccagcagcagcgactccttggacccgaagtagcggaagaaggtgctcggcgacacgtcggcggcctcggcgatctgttcgacggtggtcgcggcgtagccgttctgctcgatgaggcgaaacgcctcgcgcctgatggcctggcgggtcttgatcttcttgcgctcccgcaggcccgggggagcctcactggccggcatgggccgattctcccgcatcggcgccggcccgcgcccgcagcacggccacgcgttgcgaagttctgacaaagccgggtgggccgttgcgatttctgcgtagcgccggcgtaactgtgcacaccacgaccggtaacaccgcctctttagcgtcgagtggtcactgcccgcgcccggcgagacgggcgccctgatgagacccgcgcccggcgagagacgggcgccctgatgagacccgcgcccggtgaaacgggcgccctatgagacaggggagacccaccggatgaccacgaccatcaccccggtaccgcagcccgcggcggcgcccgagcggcacaaggggcggcactggatcgacgactggcggcccgaagaccccgaattctgggagacgacgggcaaggcgatcgcccgccgcaacctgatcttctcgatcttcgccgaacacgtcgggttcagcgtgtggatgctgtggagcatcgtggtggtgcacatgacggccggaccgcacgggcacccgtcggcgtccgggtgggcgctgaccgccagccaggcgctgtgcctggtcgccgtgcccagcggggtcggcgccttcctgcggctgccctacacgttcgccgtcccggtgttcggcggccgcaactggacgaccatctcggcagccttgctgctgatcccgtgcctgctgctggcgtgggcggtgagccatcccggcatcccgttcggggtgctggtggcgatcgccgcgaccgccgggttcggcggcggcaacttcgcctcgtcgatggccaacatctccttcttctacccggagaaggacaagggctgggcgctggggctcaacgcggccggcggcaacatcggcgtggcgatggtgcagaaggtcatcccgcccgtcgtgatcgcgggcggcggcgtggcgctgtcccgggccgggctgttctacgtgccgctggcggtcgtggctgcggtgtgcgcgttcctgttcatgaacaacctgaccgagatcaaggccgacgtgaagccggtgtggcagtcgctgcgccacgccgacacctggatcatgtcgctgctctacatcggcaccttcggatccttcatcggctactcggccgccttcccgaccctgctcaaaacggtgttcgggcgcggcgacatcgcgctggcgtgggcgtttctgggcgccgccatcgggtcggtgatccggccgctgggcggcaagctggccgaccgggtcggcggggcgcggatcaccgcggccagctttgtgatgctggccgtcggcgcggcggccgcgctgtggtcggtgaaggcggtgaacctgccggccttcttcgccagcttcatgttcctgttcgttgcgaccggcatcggcaacggttcgacctaccggatgatctcgcggatcttcaagatcaagggcgagctggccgggggcgatcccgacaccatggtgacgatgcgccgccaggccgccggcgcgctgggcgtcatctcggcggtgggcgccttcggcgggttcatcgtgccgctggcctacgcctggtcgaagtcgcagttcggcagcatcgaacccgcgctgcgcttctatgtggtgttcttcctgggcttgctggccgtcacctggtactgctacctgcgcaagcacaacgcgatcacccgggtcggcatctagccccaggacggtttctgccggccgccgtatccctgccagggggagtagtcggcgatcagctcctcctgcggtgggcgctggtcctcggggatgtgctgcaggttgatccggatccggtaccagatcgagctgggcccgcgcatcccgtcgaccaggacgtcggccggctgcagccgggcggcggcctccggatggcggtcgcgccagacgtccagcgccgccatcgcctcgtccctcgtcttggtgcgagccacctcgatcagcggcatcgaggaccggcgccggccgccggatcgtgtcccggcgcccttcggcgcccgctccggcggacccagctcctcggccagcaccagcagccggtcgaggtcgccgacagcgtcgtccatgcccgcccacgggtcgccgatctcggccaaccgggcaggcacggtgtcgatagtgaacgcctcgggccggcagccggccacctcgtcccagcgcaacggcgtcgacacccgggcgtccggggtcgcccgcaccgagtaggccgacgcgacggtgcggtccttggcgttctggttgaagtcgacgaacaccccctcgcgctcctccttccaccagcggctggtcgccgcctcgggcgcgcgccgctccacctcgcgggccacggtctgcgcggccagccgcacctggcggaactcccagcgccgggcgatgcgggcatagatggggaagccgcgcgacccggacgtcttcggccacggggtcaggccgtagtcctcgagcacctcgcgggcgaccagcgcgacgtccacgatccgtcgccaggacaccccgggcatcggatccaggtcgacgcgcagctcgtcggggtggtcgaggtcgtcggccagcaccggatgcgggttcaggtcgacacagcccaggttgatcagccaggccagcccggcggcgtcgtgaatgaccgcttcggcggcggaagtgcctcgcgcataacgtaattcggcgacgtcgacccagtccggccggttcgccggcgcgcgtttctggaacaccgcctcttgcgtgatgcccttgacgaagcgcttcaggatcatcgggcgcccggccacaccgcgcagtgcgccgtcggccacggacaggtaatagcggaccaggtcgagtttggtgtgcgggccggcagcagaaccggtggtttcgccgccgccggcgcgggggaacaccaccttgtccggatgggtgatggtgacccgccgcccggccacctccagcgaaaccggacgggtcatgtggttcatgctaattcgccagaatttctggccgtactgagacggacgtcacatatggtggattccatgcctaacctccttggcctgcccggtcaggccaccaaagcggtagccaaagttcagcagtatgtcgaacgtggctccgctgaactgcactacctgcgccggatcatcgagtcgggcgcattccggctggagccgccgcagaactacgccgcgatggccgccgacatctacaagtggggcgagttcggcatgctgccgtcgctcaacgcccgccggaccccaggccgggcggcggtgatcgacgaggagggcgaactcagctacgccgagctggaccgcgccgcgcacgcggtcgccaacgggctgatcgccaagggcgtcaaggccggcgacggtgtggccatcctggcccgcaaccaccgctggttcctgatcgccaattacggtgcggcccgggtgggtgcccgcatcatcctgctcaacagcgagttctccggcccgcagatcaaagaggtctcggagcgcgagggcgccaaggtcatcatctacgacgacgagtacaccaaggcggtcagcaaagccgaaccgccgctgggcaagctgcgcgcgctgggcaccaatcccgacgcggacgagccgtccggcagcaccgacgagacgctggccgagctgatcgagcacagcagctccgagcccgcccccaaggcggacaggcacgcctcgatcatcatcttgaccagcggcaccaccggcacgcccaagggcgccaaccgcagcacgccgccgacgctggcgccggtcggcggcatcctgtcgcacgtgccgttcaaggccggcgaggtgacgtcgctgccgtcgccgatgttccacgccctggggtacctgcacgcgaccatcgcgatgtttttgggttcgacgctggtgctgcggcgcaagttcaagccgccgctggtgctgcaggacatcgaaaagtaccggccgaccgccatggtggtggtgccggtgatgctgtcgcggatcctggacaccctggagaagatggacaagaagccggacctgtccagcctgcggatcgtgttcgtctcgggctcgcagctgggggccgagctggccgcccgggcgctcaaggacatcggaccggtcatctacaacatgtacggctcgaccgagatcgcgttcgccaccatcgccgggcccaaggacctggaacgcaacgcggcgacggtcggtccggtcgtcaagggcgtgaaggtcaagatcttcgacgacaacggcaaggaactgccccagggcgaggtggtccggatcttcgtcggaaacaccttcccgttcgcgggctacaccgggggcggcaacaagcagatcatcgacggcctgttgtcctccggtgacgtcggctacttcgacgagcacggcctgctctacgtgagcggccgcgacgacgagatgatcgtctccggcggcgagaacgtgttccccgccgaggtcgaggacctgatcagcgggcatcccgacgtggtggaggccaccgcgatcggcgtcgaggacaaggagtggggccaccggttgcgggccttcgtggtgaagaaggagggcgccgacctggacgaggacaccatcaagcactacgtccgcgaccacctggcccgttacaaggtgccccgcgaggtcattttcctcgacgagttgccgcgcaacccgaccggcaagatcctcaaacgcgagctgcgcgagatggaggtctagcggcgctctttgatggcccgggtgatctgggcggtcagcttggggtcgaccagcagctggtcgatcagcgcggtgagcacctcctgcccggtcacccgggcgacccccagccggtcggcggcttcgcgctgccagatgtcgagggcccggtgggtggccgccggcaggtccacggtccggcgggtgcgctgggtgcggcctgcctggttggccggcggggcgctgggcacccgcgggccgccgggctggcggatgctggtgaggcgctcggtgggcgcggcgtctccggaggggccggcggcttgggtgggagcgcgaaacgcgccgccgctgggtccgctgtggctggggttgaagttcactgcggtgtcttcctccgtgagtgccaatcagtaaatcagcgctcgttgcctgtgtgtcaatactgattctgtcaccgacgccagcctaagtcgcgttgccgggccgggcatgtggcgggccggtgcggcgccgacggccggctgcggcggattcgccgaacccgctcgtcaagcaaattgctgacgatagctgtgtgtgggagtaaacgccgttttgggtggcggtggaggggctccgggatgacaacttcgacagcatttcttccgcacatacggcaatggcattaaacgtatatcagtagatactcggtgccgggccagcacttcagtagatacctatctacctgtgtgtatgtgggccacttgcaccacgcggagtcagtaatcgcggataagcgcatcggcgcaaatgcgtataggaacgccgcaaaagagatggtaattcggcactcttgttatccaattcacagcaaaaacaagccaatccatcttgtttgccgagaaatgcgcgagtagcgttctggccatcaacctccgataaatccaaatcgttggaaggacgccctcgatgatctgctcagcatcgtcacacggtgtcgtcgcgggtgtcgcggcggctggggccgtggtcggcgcgctgctgttcggcggcgccccggcggctcaggccgcccccgcgccggcgccttccacaagtttcgccagtgccgggccgcacagcggaccgggccccattcccgacggtcccggtggccgcggatggggaggccatgatggtcggggacatggcccgtggggccacggtggctggggccacggtggttggaaccggggcttctgggcgcccggacactggtggaactggtggtggtgaccaccatctccgcgcggtagccggccatcaccgacacgccaaccctcgggatggacggcccgtgtatggggggaaccatgccggcttgactcagtcaggccggcatggcccatttctgcgcccggttagggatcgcgcggcaggcccaacaaccgttcggcgatgatgttcagctgcacctcggacgtcccgccgtagatggtggtcgcccggctggccagcaggtactcgccccatttgccgggcagttggtcggtgtcgccgatcgcggcgtcggtcccgaaggacgagaccgcgaattcggcgtaaccctggccggtgcgcatcgacaacaacttggagatcgccgccgacggcatcgcgtccccgcccgccagcgtcagcagcgtggaacgcaggttcagcaccttggccgcatggccctcggcaatcagctgaccggcgcggtgctgcgcgacctgatcgaactgcccgtcacgaacgaactcgacgaactgcgacagcgtggccaggaagttcgcctcgctgctgccgatcgacacccgctccgcggtcagcgtgttgcggctgacctcccagccccggttcacctcaccgagcacgcactcgtcgggcacgaacacgtcgtcgatgtagacggtgttgaacatcgcgttgccggtgagctcgcgcagcggcttgacgtcgacgccctcgctcttcatgtccagcaggaagtacgtgatgccgctgtgtttcggcgcgctggggtcggtccgtgcgagcagcgcaccccactgcgagaactgcgcggcggtcgtccagatcttctggccggtgatgcgccaccctccgtcggtccgggtggccttcgtggacaggccggccagatccgaacccgcgccgggctcggaaaacagctgacaccagatcatctcgccgcggaaggtcggcggcaggaaccgctgcttttgctcctcggtgccgaacgccacgatcgacgggacgatccaggtggcgatgccggtctggggccgcttgacccgcccggaggcgaactcctgcgcgatgatgatctgttccaccggcccggccgcccggccccacggcttgggcaggtacggcagcacccagccgccctcggcgatggcgaccttgcgttgctcgcgctcgatctccttgagcgccgccacttcggcccggatctccgcccgcagcttctcggtctcgggatcgaggtcgatgtcgaccgcgcgcatcccggtggtggtcgcggtgtcgaccaccttttgcgggtagtccgagctgcggccgaaggaggcggccaacatcagcgcccggcggtagtacacgttcgtgtcgtgctcccacgtgaagccgatcccgccgtgcacctggatgcaatcctgcgcgcaccgttgagcggccgccggcgccagcgtcgccgccacggcggcggcgaactcgacgtgggaacccgcggtgtcccaacggttttcgcgggcctcgtcgatcgcgcgggcggcgtcccacaccgcagcggtggcccgctcggtgtcggcgatcatctcggcgcacttgtgcttgatggcctggaattggccgatcggcctgccgaactgctcgcggatcttggcgtagctcgacgcggtgtcggtcgcccagcgcgccacgccgatggcttcggcggacagcagggtcgtcatcagcgcgtgcgcggtgcccatgctcaggttcgtcaagacgacgtcgtcgccgacctccacggcgttggcccgcacgtcggcgatgggccgcaacgggtccaggcttttcaccggctcgatctcgagctggtcggcgcgcagcaccacccacgcctcgccgctgtcgatcgcgacgggcagcaccagcagcgacgcctgcgcggcggcggggaccgcgcggagctcgccgcggatcaccagagaactgccctgccgggtggcggtcagcgcgcagcaattcaggccgtaggcggcgatctcggcgccggatgccagcccggcgagcgccttggcgtccgggtcgtgcgcggagatcaacgcgctggcgatcgcggacggcacgaaggggcccggcaccgccccgtagccgaattccgcgagcacaatggccaactcgagaacgccgaagccctgcccgccgacggattccgccagatgaacgccctgcaggccctgctcggccgcggcctgccagtacggcggcgggttgccgacctccgtctccatcgcctcgtgcagcgtctcggacggggcgatgcgcgccaccagcgctcgcacggaatcggccagttcttgatgctcgggatttatcgcgatcggcattggtcgccttccgttgctgcaggacgccgtctcggccaagtaccttccaagctaacaaccagtcggttggttgacgacatcacctaccgccaccgcttgccgatccatccggcgacgatgtcggcctgctcgctgcgggccccgggggtggtgaagtagtgatcggtgtccaccgaggcccgggtcttgtccgcgccggcgagggcgtcgaagatgcgttgcgcgtcagagggaaacacgccggtgtcggcgtcggcgttgatcaccagggccggacaccggacccgggccaggtgcggctcggcccgggtctgggccacccgcaggctccacatgcccagccagttgcgcagcgtgcacgccgccgcgatgccgtgcgccgagcggttcgccttggccgggacgcccgcgtagcacatgttgggctgccgtttggtcggctcgatgccgggatcgaccatgcgcgggtcggcccaggtgcgcatcaccgaaaacgggcgatcggaaaaccctgccgcgcgaacgcgtttgagctctctttcggcccagtcggtgatggcgtgattgcgcgcgacctgcgcgctgcggtaccgggcgaggaactccggggtgtaggggggcccattgcgcccgttgaacaggtcgaggtcggcgtcggtggccacgggatcgttctcgtcgacgacggcggcgtccatccaggcggtgagcacttcgggtcgcccggggtgggcggcggtggccacgtagccgtcggcttgcggcaactcggtcaccccggccgcggggcgcatgccttccagcggggtcacgttcggctcgacggcctgggactggtaggcggccatcaacgaccctccgcccgagttgcccagcagcacaacggtatccacgccctgcacctcgcgcagccagcgcactccgaccccgatgtccaccagcgcgtggtcgagcagaaagctgctttcgaagccgcgaaacctggtgttccagccgaggaatccgatgccgcgagtggccatgtaatcggcgagatagtgctcggagaagtcgatctggtagtgcgcggcgatcatcgccaccttgggcttgcgtcccaccctccggtgatacaaaccctggcaggggtgcccgccggcgccggcgcgaccggccgtaggcgacggcagcccgacgaattcgcggatgactccggcaccggtacgacgagtcaattcagcggtccccctcagtggcgtagatggcccggtaatagatgttggccagggtttggatgcaggcctcgtcgtcgggttccccgcaacgtgccgaaccgagctggacgtagcagaactggttgaacatcgccacgatcgcctccgcgatcagctgcgggtcgtcgtcgcggcaacggccctcggcctgtgcgcggcggaccgattcagcgatgaaagatattggtatcgagcagatttcggcccagtactgggcgaagtcgtcgttgatcatcgtcagctgtgacacgctgatcacctcggcgagccggttgcggtaggtgtgccagtgcgcggcggccgccccgtacgcgcgctcgcgatcggtcaacccgtgctgggtcaccgacagcgcgcgctggttggcctcgtcgcggaagcgcagcgcccattggcgcaccatcgcctctttggactcgtagtagttgtagaaggacgccgccgagcggccggcctccgcggcgatgtcggcgatggtcgcggccaggacacctttgcgcgcgatgaccgtccgggcggccagatcgatcgcggcctgcgtccgcctgccgcgatgcgtgggcaactccgcgggtggcccgctccggtcagcaggggatgccgcggtggacacctgcgcacctccctgggccaaaactgaatctgatgttagattcagattcggatcttggccaggctcatcgagccgggaaccgaggggagccgcacgatgatcaagccgcacaacaccaacgcggaattcgaactcggcgggatcaatcacgtcgcgctggtgtgctcggacatggccaaaaccgtcgacttctacagcaacatcctgggcatgccgctgatcaagtcgctcgatctgcccggcggggcgggccagcacttcttcttcgacgccggcaacggcgactgcgtcgccttcttctggttcgccgacgcccccgaccggttgccgggcatttcgtcgccgggcgccatccccggcatcggcgacatcaccagcgcggtcagcacgatgaaccacctggctttccacgtgccggccgagaagttcgacgcctaccgccagcgactcaaggacaaaggggtgcgggtcgggccggtgctcaaccacgatgagagccccatgcaggtctcggcgaccgtgcatcccggcgtctatgtgcgctcgttctatttccaggatcccgacggcattaccctcgagttcgcctgttgggtgaaggaattcgaaagcggcgacgcgaaggccgtgcccaagaccgccgcggaccgccgacccccggtgggcgccggtcgctgatcgcgccgctgctccgcgagtcggagaatgctaggtatgaccgacggcattttgaccgacgaacagatcgccgcgcttacccccgggcagcgccgcgacctcatctcccggctggagcggcccctcggcgaggtcatcgacccggacttcctggaccgcgtgcgccgcgtccggctgagtctgatgatcggcggttccatcgcgatggttccctggctgggatacctggcgatgacgctgcccgagaagtacgtcgcccacaattggccggtcacctggatcggcttcgatgtgctgctggtcgccttcatgctgacgacggccgcgctggggtatctgcgccgccagctgctggtgctcgccgcgttcaccaccggggtgctgctgatctgcgacgcgtggttcgatctcatgaccgcgggccccaaggacgtgtggctgtcggtgatcaccgcgctgctgatcgaggtgccgctggcgattttcatgatcttcagcgccatgcgcatcctgcggctcaccatgatgcgtttgtggctgctgcgtcccggcatgcgcctctgggagctgccgctgttcccgtgaggcggtgcgggtttggcccgcgcaccggctcgagggccggacaactgtatcccgagttgcgggcgtagcgggccgaatcggcgataagtcgtcgcgaatcgaccccgcccggcgtggccagggccgttgagggggaaaagattactgcaccgccggcgatctcgcggcggaattcgagtcttgacaaaaccgcgaaatattcgcctgcgtcagctagcgtccacagcagcgacataggggtatgaccggcggggtagttcaccaacacaggcgaaagtccgtcggacaatttcaagcgcgacacacatcgacgatcctcgaaaagccaagcgccaaccgcacttccagcacccccagaccgccccgcaaacgtcgtcgtctcacagcacaaggactcgaggaaatggtcgcactcggaaatatcaacgaatggcacccgccgcacggcccggtcaccatgtggatggccgcaccagccgcacgcgaagcggcccgcgccgcacggcgaagcgacctggcgccgagttaccaacagaatcaacacctctgggcctcctaccaaggcaaggccatgaaccgccagctgccccgtctgatgatcgtcgcgtgggacatccccggcacctgcgacattgcggcgatgacggcgacgatcaacgcccacgttcgccgccaggacacctatcacaactggttcgagtacgacaacggcacgttcgtgcgccgggtgatcgacgatcccgaagcgatcgagttcgtccccgtggcgctggggcacaagaccgcggaccaagtccgcgcccatgccttgaccaccaccccggacaccctcgagtggggctgcttcacctacggaatcgtccagcacgccgactatttcacgttctacgcgagcgtcgaccacctgcacatcgacggcttgtcggccgcgctcatcttcctcgacgtccacctgacgtatcaggaactcgcgcagaccgggcaccagcccgccggcctaccggagatccgcagctaccgcgactacgttgcgcgccaacgcgagaaggcggcgacgttgacgctctcgtcgcccgagatcaaggactggatcgagttcgcccgcgacaccgacggcgactggcccagtttcccgctgccccttggtgacacgtggtccagcaccagaggcgacctgttgacggtcgagctgattaatgccgaggacacggagtccttcgacgccgcctgcgtggcggccgacgcccggttcatcgggggagtgctggcctgcacgggcctggccgagcacgaattgaccggcaagaagacctatcacgggttcacggccaaggacaccaggacaccgggcgtcgactcgatgaccgtcggctggttcgccagcctgattccgatcacggtgccgaccgccggcgagacgttcgcccaggccgcccggacggcgcagaagtcgttcgacgacgctcagcgcctcgccgacgtgccggtcgagcgggtgctggagctcgccaccccggacgaactgggcatcaagctgcccacgcagctgccgatgatgttgtcgttcctcgacttccgcaagatccccctcaacgggttgtgggcggagacgaagttcggcacctacggcgacagcctgtcccacggcggggtgaacatgtggatcaaccgccaggccgcgaacaccacggtgacgatgtccttcccggacaacgtgatcgcgcgggagtcggtgctgcgctacatcgcgacgctgatccaggtgttcgcgcgtgtcgccaggcccaccggggacgagccggttgtggttgcgccccaggtgaaaccggacgacacattcgctccggcgccggacacggacgatcacgaagcggcgtagcgatgagcaacgtgctggacctggccgaccaaacactcttcctgggtgagcgggcgacgggtgccacctgcttgctgcagtgcgtctgggtgtacgaccgtgccgtcgacgtcggtgggctgcgtgagttccaccgccacctcgggcgggggcggctgtcacggcgagtcgagcgctccgccttgccgtttggccgtcatcgctgggtggcggccgccgagtgctcccccttggagatcgtcgcgccgccgcgggagcgcgaggacatcgacgcgtggctcgacgagcagacccacaagcggccggacgccgagcgcgggcccggatggcacttggcgatgctcccgctgaccgacggcggcgcggtggtgagcctggtcaccacgcactgcctcaccgatggcgtcgggctgtgcgaggccctggccgacgcggctcggggacgcggcgaccggacccgctggcccgccgcgggaggtcggcggcgctggcaagccctgcgcgaggacgcgcgccaaaccgcgcacgacgcgctcgatgtcggccgcgccgtcggtgccgcggcccggatgctccggcagggccgcgacggcaccgcgtccgtcgccccgccacgcgggaagcggcccgcgccgccggccgcgcccgacgaccgcattgccctgccgatggagacgatcttcgtcagcgccgacgactgggacgcgcgcgcaaccgccttgggcggcaccagcaacgcgctgctcgccgggttggcgggccacctcgcccagcgggtggggcgggtggcccccgacggctcggtcaacatcggcatgcccgtcaacgagcgcgccccaagcgacacgcgcgccaacgcggtcacgaacgtcgacgtcacgctggggtccgcggcgatcaccacggacctgcgcgagatccgcgccgccatcaagcgggcgctggttcgccatcacgacgagcccgacgagcggtgggcgctgctgcccctcgtcccgctgatcccgaagccggtgtttcggcggttgctcagcgtggtcaccggcggcgcggcgaccgtggtgtcgtccaatctcggcgcgctcgacccggccgccaaccggccggacggcacggacgccgactacttcgccatgaagtcggtgtacccgggcgtgaccgccgcgacgatgcaccgcaccaacggggccctggcgttgctgtcggggcgggtccacggccgggtcttcatctcggtcctcgcctacgaattgggccgccacaattcgaacgagggtctgcgacaagcgctttccaagacgctgagcgacttctcgctggccgccacaacgggctggcacacggtctgccccgtgtgaggcgctaggcctcggcccgtgtttcggtgagccggtagaggtttggctcggcaagctcgtcgagcagggcggccaggtgatcgacgagctcatccggttcgagccggacgtcgccggccagccaggcgctgatggtctgcccgaccccgccgaccacgaagtgcgctgcggccttgatgcgatcgtttgccggcacctgaagcgcgttgccgacgtgctggccggacagcatcgcgaacagggcgctggactcggcgcgtttgcgcaccaccacggggtcggccagctgcgtgctgaacaacaggcggccgacgcgggcgtcgtcggtgatggtccgcacgatgttggcgatgcccgcgcgggtctgctcgtcggcgggcaccgtggcgaccgcggcctgcgtggtggcggccagctcggcgaccacccagtcgaagacgcaggagacgaattcgtccttgtcggtgaagctctcgtagaagtaccgggccgccagcccggcgcggcggcacaccccgcggacggtgaccgccgagatgtccggccgctgatcgccgagcaggtccaggccggcggccaggagccggtttcggcgggtggcgaggcgttcggcggcctccaccccgcgatacggccgcgcgctggacgtatcgctcatgcggaccatcttgacactaacgccgcggcgcgacaatatcaggaaacaagcgttcgcacattagcggccgcgctgcgggaggatctgacgatggcaattcaccagtcggtgcaggcaccgatcgggcacgtcgagcgcggggccaccgacccgccgcgcccgcagcggcgcaggcgcggacggacgctgggcatcgacgagggcctgatgggcgtcgccctgctggccggtccggcgaacgtgatcatgcaactggcgcagccgggtgtgggttacggcgtcatggaaagccgcgtcgaaagcggccgggtggacctgcacccgttcaagcgggcccgcaccacgttcacctacctggccgtggcgaccaacggcagcgacgctcagaaggccgccttccgccgggccgtgaacaaggcccacgcgcaggtctactcgacgccggaaagcccggtgtcctacaacgcctttgatcccgcgctgcagctctgggtgggggcctgcctgtacaagggcggcctcgacatctaccggatgttcatcggtgagctcgacggcgaagacgccgagcgccactaccgcgagggcatggcgctggccacgaccttgcaggtgccgccgaagatgtggccggccgaccgggcggcattcgaccgttactgggaagagtcgctggccaaggtgcacatcgacgacgcggtgcgggaatacctgtacccgatcgccgccaaccgcatccggggcgtgaagctgcccggtcccatccagcggctctccgagggcttcgcgctgatgatcacgacgggcttcctgccgcaacggttccgcgacgagatgcggctgccctgggacgcgaccaagcagcgtcgcttcgacaggctgatcgccgtgctggccacggtgaaccggtatctgccgcggttcatccggcagttcccgttcaacgtcttgctgcacgacctggaccgccggatcaagaaggggcggccgctggtgtagcggcccggcgagcgcggaagcccatgaactgcgggctgtatttctttatggccgatcctggaaacatgcatcgtgaatgtagccccgcaggggtagggacctggcgcttccttgcgtcgccttctccctggccgggtgatcgcgccgtcggggtagtggcccgctacggtcgtctcggtctgttgctcctcgatgagcttggctacgtccaaaccgactctcgcggagcagaattgctgttcccgatcatcaccgaacgcgaagaatgagccagcatcgggctggcgagcaagcttccgtttagtcactggggagagaccttttccgacgacgttgttgcggcggccatggtcgaccgcttggtacaccacgcggaggtgctcactctcacccgcagactcctaccgtacccatcagcgccgacgactgctcacaaaagaaaatcgcgccgccaacgatcaacacccatatcccgcttgggatttcgagcaatcggtggggcgggtgaactccattcgactccgttgtcgagacctcgacgcacctgctgggaggcaggcacgacgctgagtgcccacctcccgagtctcgctttacctttggcggttggattgaggtctggggtgtcatcggcgctttttgctggctctgcgcccagatagcccgtcaacggtcacagcttgccctgaatgatccatcgccagacggtgacgagcctgcctctcagtagtgccactggttagtggaaacccaagcttgcccacgccttggtcgtatcgatgccgccgcgaagcggagacttcagatgattcaccgtaattgcggagctaattcacagttgagaacgtatttgcggtaagaatagccgcgtatcctacgtgcatgcggtcgacctattacctgcagctcggcacctgcggagtgtgggggtggaggcaccgaccgcgtggtgaacctgcgcgaatgccagtgcggtcccgttgattaccacgatagtgcgaccggccgattcggtgtcgctgcgtgacggtgctgctagggcggcctgtctgacttctggatcaagacgatgactgccccgatctggatggcgtttccgccggaagtccattcggcgttgttgagcagtgggccagggcccggcccactgctggcctctgcgggtgcgtggaattccttggctgctgagtacacctcggcggctgaggaactcacggcggtggtggaaggcgtgcaggctggggcgtggcagggccccagcgcagaatcgtatgtggccgcccacgcgccctacctagcgtggctgacacaggccagcgccgacagtgcgggggccgcggcgcggcatgaggccgcggccgccgcgtataccgccgcgttggcggcgatgccgactctgggcgagttggctgccaaccacgccacccacgccgcattgcaggcgacgaatttcttcggcatcaataccatccccatcgcggtcaacgaagccgactatgcgcggatgtgggtccaggcggccaccaccatgacgacgtatcaggcggtgtcgaccgcggctgtggccgcaactcctcagaccatgcctgcgccgcagatcgcaaagtccaccgccgccaccattcctttccagcggccctaccccaaccccaccaacttcagccaggtctgggcggatctgtggtatgacatcccgtattcgatcgagaccttccagggcccagtcgatcccgccaactggacgcaattgttccagttctggaatgtaacgtttgccaacctggccgggacccctgccaagctggctcagatcttttcgaatccgtcggtgttgttcagctggcccacgctgctgtgggtgttggatttcatcgccggccgcatcttcgacatcctggtcaccctcaaatttcttcttgagcagccgttgctgtacgtggtggggctcggcatggcggtcaccagcttgggtgcggccgcgggcgcggcgggtgggttggtcgggctcgccggcctggcgagcccgggcccgctgcccaccggggccgagatggtcccggtgaccgcaccaccacccggcgctacgccggcgccaaccgcgccgctgattggcggtccggcctcggcgccggccacgattcccgtcagctcggccgctgctgcccccaccgcgccagcgccggcacccgccgtcgcggccgccggctcggctgcgccgccgccggcgggcccgggcggctttccctacctggtgggcggcatgagggtgagttcggcggccagcgcatcagcccaaagccgcaaaccgaaatccgctgccgccgccgcggctcgggccgccgctgccgccgcggctgaaacacaccatgcccgccgccgcctgagggtgaaggcgaaaatgctcggtcgtggttatgaatatatggatctcgaggacgaccacctgagctcgagcgccgcgtcggagcatggtgcggggccgctggggtttactgggacgatgcgagaatccggtgctgcgaccccggcgggtttgaccgcgctgggcggcggctcgttcggtggcggctcgaagatgccgatgctgccgaccagctgggtcaccaacggatcaggcgaggcctagcggttgacgctgatcaagcggtgtgtccgcgggaatggttggcgcacaacgctgctgatgctgttgctgctgaccgcggtggccgcatcgctgatggtggggcgctacccggtgggggtgggcgcgatggccgggatgctgtttggtcgtcttcctctgctggacactagctttactccggtggatcagacggtgctgacccagatccggttaccgcgcatcggctgcggggtcttagtcggtgcggggctggcggcctcgggtgcgggctatcagacgatgttccgcaatccgctggtgtccccggacattctgggggtgtcggcgggcgcaggcttcggcggagcgctggcactgttactgcatgcgccgtactggcagctagaagcgatggcgttcgccagcggattgctggccgcggcgttggcactgatcatcgggcgcggcatcggccgcgattcggcgatactgctggtactggccgggatggtgatcgccagcgtgttcggcgcgttgatctcggtgaccgaatacctggccaaccccgatgacaccctgccggcgatcgtgttctggctgatgggtgggctgggacgccaacacctcgacgggttgttggccccggcgctgatcatcgccgccgcggtcctggtgctctacgcgttgcgatggccggtgacggtggtggtatccggggatgaagacgcacacaccctcggcgtcgacacccgacgcacctgggctgcggtggtaggcgtctatacgttgatcaccgcaaccacagtgagcctggccggcatcgtgggctgggcaggcctgttgattccacatatcgctcgagcgttggtcggcccgggattcggtcggctgctgctggtgtcggcggcgctgggcggggttttcgtggtcggcgtggacgacgtggcacgcgcggcggccagcgccgagatcccgctaggcatcctcagcgctctcatcggggcgccgttcttcctggtggtgttggccaagatgcgccggcaatggacgtgagcagcgcggcgatcgccgccgaacagctgtcattcggctaccccggcgacggacagcggctgatcgcggtgtcgctggcggtgcagccgggccaggtgtgctgtctactcgggcccaacggtgcgggcaaaaccacactgctgcgctgcctgctggggctgctgacgccgcagtccggcacggtccgggtggccggcgacccgatcgaccgtctgtcacggcggcagctggcccggcgggtcgcctacgtcccgcaacgcagcaacaccccgttcccgttttccaccctggacatcgcggtcaccggccgcaccccgtatctgcgcgcgatgacgtccccgtcggcgacggaccgccgggcggccgccgcggtgctcgaccggctggggatcggcgcgctggccgatcgaccgtatgcggtgctttccggcggggaacggcggctggcgttgctctcgcgcgcgatggtgcaggacgcgccggtgctgatcctcgacgaacccatggcagcactggatttcggcaacgagagccgcatcctgcaggtggtggccgagctggccgccgccggccgcgccgtgctgatgaccactcatcagccctggcatgcgctacacagcggcgatcaggcagtgctgatcgccgacggccgcctcatcgccgacggccccgtcgagcaagtcgtcaccgcggccgccctcagcgagctgtatggggtgccggtgcgggtgctgaccgctaccgacgacgccaccgggcgcccggtctacgcctgcgcgccggtggccgcgggggatgaccgatgatccgggcggtgctggccgccgtctgcgtcgccacctcggcggccggctgcggcgccgcacaccattccccggcggagccgacgcgcaccgtggtggatatgaccggacaacacgtgcagatcccggccaccgtaacccgggtggccaccaacatcccgctgatcccggccaccatcgaactgctgggcgggatcgacaccgtcgttgcggcggcccgcggctcgttcaacgctctgttcaccaccatcgcgccggcaacccaacagattccgcggtccccgcctaccagcctcaacgccgagcagctgctcgacctgcacccgcaggtctttttcatgaccgacctgaccccaggcctgctgccgatgctgcagcggctgcagatcccggtcgtgcagatcaccgccttcaccagcccgcaggatctgcagaaggcggtgaacctggtggcccaggtgctcggcggggcggcacccgcgcgggcccggcaatatgacacctatttcgacgccgtgatccagcaggtgcacgccggcgcccaaaccgaccggcccaccgtgtattacgcccccggaccggaccccaccaccaccgtgggtgccgacaacatcatcaccgcatccatcgaggccgccggcggccgcaatatcgccgtcgaacacggcatcggcgggcatcagccgggtgcattcgcgttcccgaccatcacggccgaaaccttgctggcctggaaccccgacgtaatagttgcgagcaacgcccgagtcgccgaccagcttgcgaccgaccccacgttcgccaccctgaacgccgtccgcgatcaccacatctacacctgcccggtggggatcttcccgtggtgcgcctcgagcagcgaggccgcgcttgcgccgctgttcctcgccaaaaagctggaccccgaacgcttctcggatctaaacctcgccaacaaggtggccaacttctacatccagttctacggctacagcctcaccggaccgcaagtgaccgcgatcctggacggggcgggctaatgccgttgagcctgcgccctgccgcggcgttattcggcgccgagatcggcgggatcgatctgcgggcgcccctgacccgcgagcagcgcgatgaactccagcgactgctacaacgctaccgggtgttgttctttcgcgggcagcagctttccaccgcgcaccagatcgagttcgctgaagctttcggcccgatcctgatcttccgcagcgtcgtccccgccgacccccagcatcccggagtgcacaacgtggacggcagcaccgtgggctggcacctggacgccagcggtctcatcgaacccccggtggccagcgtgctgcgggcggtcgagatccccgaccgcggcggtgacacagtctgggctgacggcatggccgcctacgacgggatgcccgatgatctcaagtcccggctggaaggtttgtcagcgacccacaccgcaccgaaccagcatccgctggtcgcgcacccgctggtgtcccaccaccccgacatcggccggcgctacctgaacatcaacctggcgccgtgggtggacacccggatcctagggatgagcaccagccatagcagcgccctcgtcgagcagctgcgggcgcaccacctgcgatcggactaccaacttcgattccggtggagcgccggggcggtcgtgttgtgggacaaccggggtatgcagcacaccgggatccgcgactacggcgacgacacacgccgtcggctgcagcgcatctgtatcgcccacttcaccgaaggcgttactggccgtgcataacggccgcgccagtaatcacacaccagcaaccgcccaagcaacaaagcgccgaaccatctacctagatcgaatcatcaagctcggtccgcctaggacaaatcgttagacacagcccaactgggtagccggcgcgcaggaaacccacgatcttggcgataacctcggaaacaggcatcgggacccctcgcgcactgcagctgtcggcaccttgacgcaccggcttggtgattagccaaccgcacccgatgttggccagcggcggtgtccgatggtggcgcacggtgaaggtggtcggtgcaggcttcaaacacgatgcggcggataggatcaatcggttatgcgtgccgcacaacggatctgaccgttaggggttgcgggtatcgagtctgcccgcagagcagagcgacggtcaccaaagcaaatgctctcgcgggcaggaccgcacccgggggcaagattcagaagttggtacggggtcagctttcaaaagttgttgacattcggatgtcccgcccgaaagcgactttgctgaacgatcgaacttgccgagcgatgtcgaggcagtttgccgatttggcgatcgcgattgtgggtcttcggtacctgggccatgctggtatgcatgacagcttcaccggacgacaccaacgccctggctgctgagtgggatgagcgctacgccggtttgacgacagagatgcgcgatgcagaacccaatgccgtgctgataactgaggtaagcaagttcgcgccgggaagggcactcgacatcgggtgcggcgtaggcgctgaagcgatttggctggccagtcgtgaatgggacgtgacggcgttggacgtgtcacgagtcgcattagcacgcgcaacggctcgcggtcgacaggcaggcgtcagggtgaactgggtgcgtgccgcactcgaagacgcaccgcttcgagttggcggctacgacctggttactgcgttttatccggcgctgcgtcactcgtcggggcgcgccgctgaggagtccctgcttgcagctgtcgctcccggagggacactccttgtcgtacaccatgccgacgttgacgcggaaaaggcaaaatcctacgggttcgacccagccgactacctcagccatgacgacattgccacgttgctcgacggcgattggcatgtccgggtcgacagacggcagccccgcaagacacccgccaggccagaactgcagcacacgcacgacgatgtgctgctggctcgacgtctgcgttgacgtaacgcatccatagggggcgacccgggcaaggcagacgatctccaacagacttcccgcgcacccggtcactgttgtagctcagaacaatctgagtgctttgtcgctgtaacatgcgagcgggggtctgctagtcggatagcgtttcaaggcaagcattttcgccggccgccttcctacgggatctcgcattgagagtgtcggcaacccgcatgcgcagttcctggtcagccgcgagagtcaacagctcctgatcgtgactgatcaagataacgactactccttgggccgcgacgtcacgcatgacattggtgatcgagcggaggtggcgccggtcgacacccgagctcggttcgtcgaaaaccatgatcttgcgattgctcagccgtgcggcggcgaccaccagacgttgctgctgtcctcccgaaagtgacaatgggtgccgatcggcgaactcttccagccccaggtctcttaacagggtggatgcaacacctgctgccgccgggggtgcaccgagccgtagctcggcacggacagactcggtgaacagctgccgctgcacatcctgcatcacgatcgctgacattcgctgccgacggctgcgagatatccggcttccgccaaacgacacctcgccgtcatgacgttgcagcccgacgagaaccctggccagggtacttttgcccgcgccgttcgggccggtgatggcggtgaccgttgcagccggaaaccgcgcctcttcgatgtcgagtacgcggtggccgcggaagcaacaacgaatacctcgcagcaccacctccgacggtgacgaagctggggcagccgtgcccgatggtgtgcccgcaacgcttgcgccgtatgcgcacgccgggggtatgtgattgcgcactggagaattgttgctgcgcaggccctctgcgttcaacgccgcatcgtcaagacgcgcgaattgcttacgcgaccattcggcggcgatacgtccgttgcgtagcaggacgattcggtccgcgatttcgcgtaggtagtgcagccggtgttcggcaatgacgatcgtggttcccagtgagcgaagcctcgcaagcgttgctgtgaaacgctcgatcgcgtccgcagccaggtttgccgttggctcgtcgaacaacagcagcggcggaccgtgggtggcggcggccgcgcaggcgatctgttgctgctggccgccggacaactccgccaatcggtggccggtgagttctgcgagcccgtattcggtgatcacggagccgacacggtttcggatctgctcgggcggtgtcccgaaattttccagagtgaaagccaattcggtgtcgacagccgcggtgaagaattgtcggcgcgggtgttgcaatacggtacctgtcagccgaccaaccctttccagagacaattcggcgaccgatgtaccgtcaatgtgtacgctaccgtcgaggctgccctggtggaaatgtgggataaggccattcatcagccgcaggacgctgctcttgcccgatccgctggccccgcagagcagaacggtctcgccacggcgtatgtgcaagtccactccgtccaaaacggcagcgtcggttccggcgtattgccaacgtacgccgtcgatgcgaatcacggtttcaccggccacagcacggtggtgacggtcagtgcgctgacgatgcaaccgattagcgcatccgctttaccgaaacgcggggggtacatcgttgtcggccgtgctgcagagccaagaccacgcagtagcgcggttgctgaaagatcttctgcgacacgaaggctcgacgctataaggggaacggtgaagtactcgatggtgcaaacgggatggcgcagcattccgtatgtcccgccgatcccacgcaatcgcatggcgtcgctgacggcacgtgcttcaccaacgatggttggcaggaatcgcagcatgacggaaccggagaccgtgatcgcacggggaatgtgggtagcgcgcagggcagcggtgaattcgctcggtgtcgtggtgttcaccagatgaatgacgattgcgccgacggcgatgagccgtagcaggtaggcggctacggtaccgattgcgccgattatcggatgtggaatagcttgtggtagtaggtaagcgactgcggccgtggccccggcagccgagggaagaatggcagcccgcacccacgcctgctcggcaaccgccagcagcatcccaacgatgacggcggctgggacgaacacctcgccaccgggggccatcacggcgatgcttgaggccagcaccagcacggttttggttcgagggtcgagttgggtcacccgagtcgttgtccgcgtcaagctaggccggccctctgaaaatgcttgcgcagcaaccttactccgagcagtccgccgatcagcccgaataccaccgtggacaggtcgaatgcgattagcacggctggcgacaacaaccgttccatctcttcgaggtagcgcggacccatctgtgccatgccgggactggagaaatattcatcgcgagcgtagaagatgggcagcagcggcccgatgtaccacgccgcgtagattgcgtacgccagtacacccatggtgcgggagcgatagcgtcccagccacaggacgacttcggccaccaacgcgcacgcaactgtgatcacgaagcagatcggggggtgcccggtcagtgcgagcagtccggccgtgataatcgcaaacaccgtcaccatgcccgcatgtcgcacccgggtgaggaacaacatgaacggcacgccgccggcgatcatgctgaccgccagggcgaccaacatgacgagcggattgatgaaagcgaacacgttgatcgcgaacacagtggcgatgtagagagcgccgaagaccccgatgttgatgagatccctggcgctcatccggacgtcgatgcggcgactggactgggtcgtcgagctagtggccgtcatggtcgaggtgcctgcagttcaggagtgggcgcaatttggcgcagttgccaccctcgcgcgcgagttcgttcttcccagaagcgggcgtaggtgccgcccgcacccaccagtgtgtcgtggcggccacgctcggtgatccggccgccgtcgagcaccagtatctgatcggcggccgccacggtcgaaaggcggtgtgcgacaacgatgactgtgcggtcacgcgctagttcgtggatagcgtcggaaacggcggtctcattggcggcatccagcgccgcggtcgcctcgtccagcagtactaccggtgcgtctttgagcagggcgcgcgctatggagacacgctgcttttccccgccggacagcgtcgaccccgcctcaccaacgcgggtttcccacccattgggaaggcgatcgactacctcgtcgaggcgactgatcgtggcgacgtggcggagatcatcatcggtggcttgcggatcggccatccgcaggttgtcggcaattgtgccttcaaagaggtacacgtcttggaaaacttgcgccgtgagatgtgagacgccggcggtgccgagttggcggatgtcgcagccgccgatggtgatgctgccttcgtcgacgtcgaagaaccgcccgattagtttgagcagcgtgctttttcccgcgccagacgggccgacgacggcagtcaggctaccttgtggaaagacggcgtcgataccatcgatggtgggttgacctccgtcgtaagcgaaacgaaccccctgcaattcgatgtcggcacccgtggcttgacctggatgggtgggttcgggcaacgggggtaccgtcaacagttcacgcactcggcggatggcgtcggcgttgacctggacatggccggcgagatcgccgagctgagaaatcgggtcgatcatgcgcaaggtgatgatcagcaaaccgaccatcgtcgaaagcgcaaggctgccgcttactgcgagagcgacggtgagcgcgatgatggcggtcaccaccagttggacggttccgaagaatccgatgagcgcccacgcgccgcgaatggtcaagcgggactgcgaagtctgttgccggacaagcgattcctctagcgttcccagtccgggccggttcaggacgccgtatgcacgcagtgtcggctgctgacgggcgtactcgacgatgcgtgacgcggtcactccgatgtcgtgatcgtactggtcgtcgttgcggtggatgacgaccatgagtagtcgaagcgtcagtgcgcatagcagcgcgccggcggtgaatgcgagcccgacccgccagtccagcacatagcttccgatgatcatggtggcaggcgcggctacacccacgatgacatgccgcagcaggtgcgcgggaaggtccgcgacgtccatggtccccttgctgagcagacgcccgatcggtccggtgcgatcggtgcggaaccagccgattggcagcgtggcgagatggttgccgatgcgggtgtgaaagctggtcagcacatctgtgccgaccaggtaacccagcgaggtgctccacgcaagcagtccgtggtgagcgacgacagcgacggcgatcgccacaatccagcaccaaagggcgtgcgtatcaaccggcttgtggatgagcacacccatcagcggtacgacgaaaaggaaaccgagtccctgcagaattccctgtgcggcttgcaaggcaagcatcacgcgaaggtgacgccgaccgcgttcgtcaagtaattcaagcaaataacgaatcatcgtgctcatcgcccaacctccatgtgttcggcgacgccgctctgaacacgacggtcatgctcccacaaacgcgcataaagtcctttgctctccaaaagctcgaaatgggtgccttgttcggcgattcggccgtcgtcgagtacgacgatgtggtcagcgccacgaatggtgttgaggcgatgggcgattaccaataccgtccggcccgaagcggcttcgttgagcgcgtcctggattcgagcttcgttttcaggatcggcgctggccgtggcctcgtcgaggaccagcacggggcggtcggccaagatggcgcgggcgatgcagacgcgctgccgttcgcccccggaaagctcggcgtcctcgcccacaaccgaatcaaagccgcgcggcaattgctcgatccgctctaggatttgggccctgtccgcggcgtcgcggaccgcgacgtcgtcggcgtccggccggctgagtcggatgttgtcgcggatgctcatgcgtaacagttcggcgtcttgaaacacgaaagcgacatgtcgatacaactcggcggggtcgacgctgcgtaggtccacaccgtaaagctcaaccgaaccttcgaccggatcgtcgaaccggggcagtaacttggcgagggtcgatttcccggatccggaagggccgaccaacgctgtaatggtgttgcggtcgagttcgaggttgatgccggacagcgcaacggtctcaccgtaggtgaacaccacgtcacgcaggcgcaccaccggcgcggcgctggatggatcgagaccgaccggctcatccggtgtcggcagctccgggccggccagcagttcgcggatatcgcgtgcgactcccagggcagtgaccagcgggtgtatcgacatcatcacggtcatcagaccggcggttatcacagtcccgaaaaccaggaacgcgataaagctatccagcggcagcttcccgttggcggtcagagctccgccggcccccgcgacgacaaccagaatgctgggcggcgacagtagcgtttcggcgataaccgctgcgacgctggtggatttggcccagtcgagaaaaaagtgcgcaaaggcacgcgacacttcctgaaagcggcggctcgccacacctggcgtgccgaacgctttgacgacgccgatcccgttcacgaactccaccgcagcgctgttgagtcgggccagccactgcatgaactctggatacttggtgtccgcgctggccatcgcgcgctgatacatgaccagcccaatcagtaccgggagcaaagtgacgagcgccatgcgccagtcaacagcaaacaggtaggtcaaggcgactaatgggggaactgtcgccgcggtgagttccacgatggaatgggcgatcagctggtgcagggccgctgacgtcgtcttcaacggtcttcttgacaatcccggagttgcggtcggtaaaccagccgagtggcagtttgctcagcttcacgagcaaatctcgtcgaattcgaaacgagacctggatgtcagccaggtgggtcagaacgccagcgcaaaacgtaccaagctgcttgacggcgagcgcaacgagcgccgctgcaatgatcgcccaaacagcagtgtcaccagctagtagccgtcggctgacctccaccaccgcgatcagcggtgccatcccggcaagggcgctgagtgcggtcaacagcgcgcatccaatgagcgtggcgcgggcagcgccgaaaaccggggattgcggcccaacttgtgatggcgtattcgggtccatgctcaatccttccgcgctcaaaccgagccatcgtgaaccgataatgaaaatcgttatcgataacatacctccacgcaagggatggatcagtgggtagggagccgtcccttccgacacgctcagtagggcgagcccgcgcggcgaacgccgattaatccgatggctgtgcctgcgcccagagagctgaaaactccggcgcgcagcggaattcgcctccgggcgctctggcggcgcgcgcgcataaggggtaccggcgtgaaggctgtggaatcccgagcattgccacgaccgcaaggcatcgcagcccccgcggccaaacctcgggcagggcattcgatcagcggtcaagcgcgcatcggacgccgagcgccacggcgcgcaccccgcgaccagtgtgacctccgtcacatctgggttattgaaaatgactttcattaaaggtctcagtgccgtagggtccccgtccgtaatgaaaatgattttcattacgggggtgtttgcatgtgatgaaaggggatcagcccgtgcccatatcacgtcgaatctcacaagttcagcgccaaccgcgcgcgatggcgtcgccgctcgccaccgcaatggcggttctcgatgcgaccgctgatgcagcagtcctgtcgtcctctgccaagggtggtgggcgatgacagccccggtgtggatggcttcgccgccagagattcactcggcgctgttgagcagcggacccgggccggggccactgctggaagcggccgccgcttggtcgtcgctgagcgctgaatacgcctcggccgcagacgaactcaccgcgacgctggcggcggtccaagccggtccgtgggagggcccgaccaccgaggcgtacgtggccgcacatgctccctatctagcgtggttggaccagtccagtgccgacgccgcgggggaggctgcccagcacgagattgcggccagcgcctacacagtcgcactggccaccatgcccaccttgcccgagctagcgacgaaccacgctactcacgcggcgctggtggcaaccaacttcttcgggatcaacacgatcccgatcgcgctcaacgaggccgactacgcacgaatgtgggtccaggccgccaccacgatgagtacgtatcagaccgtctccaccagcacattggcggcggcgccacgcagcagcgcagcgccggcaattgtgaaaagcgaggactcatcggcgggagacaccggcgactcttccggcggcggaggttttttcggcgacctgttgagcgcctgggagaacttcgtcatgaacctcatggatcaactgttcggtgtcgatagcccacccgacctcgcttcggcggtggcggcattcttggcgaatccgtccccggcactctttagcgcgctcctgtttgcgctggcctacgaaatcgcctttgacacgctgttcttctcgcccgtggcattgttggccgctccgttcctgccgtttgtcggtctggccggcctggcgggtctggcagggttggctgggctggcccctgcgcccgagccggttccagcaaccgtcgcggacgtgccggccccgacgtcccctccgaaccaggccctaccggtcgcggggatcccatcggcgtccacgccggcatctgctcctgcatccgcgcccgcgacgagcgcgacggcaccggcatccgcgccggcgccggcccccgcatcggccggttcacccgtgttcggctacctggtcggcggcggtggcggtggggaatccgggcccacgctgactggccgctccaacgcaacagcacccgcgggtcttgccgcggcctcagcggccgcagcgaaagcgccgacacgtgaccagacgcggtcgcgacggcgccgccgaaccgtaatgcgggaccacggcgatgaatttatggatctggacatgggcgcgccggtcgactccccgcccggcggaacatttgtgtcggggcaaggtgcgggttccctgggattcgccggaacggtagcgaacgcggccggtgcacgggcagcgggtttggcaacgctggatgccgatggcttcggctcgagtcccaaagcgccgatgctgccgggtagttggcatggcgacgcgacccaggaatcgcagggaagcggtgacgacgagcacccgaccgagggcaacgctggaaccgagtaatcgtccagatctggtcggcatcctctcgtcagcgtcgagcccagaactcgattatctcgcgctcatcgtgtctcgcgctcaccgtgggtgcagcacaccgatgatcgggtgtagctgctcaaaggtcatgtcgtgtgcttcggcctcgtgggcgagttcggcgaggcccacggtgtgccacgtgtgttcggcggtgaattctctggtgaccttgtcgccttcgctcaccacatagcgcatcgtccagtgttccgcgtcgctgccggcgggctggcccgatatgcgaacttcattgtgccgcacaccaatgcgctgttgggcaatggtcatctcgggcaccggcatgggctggtcgagggccatgacttcgacgatcaccggtgcgcggggggtgagacgtgggcgtagcgctgcccaaaagtgttggcgggcttgcttgtccatatacccgatgacgccaaacaacaccacggccccaagacgctcgggaaggtcgagttcttcgagattgaccgggtgcacggtgacccggtcaatcaaatcaggccggctgaggatcctggagacgagcgcggcgcgcatcgccgctgacggctcgaccgcgtggatggggacgtctgcgatggtgtcagcaacggtcactgtcgagagccccgtacctgccccgatatcaagcacgtgatctttcaccggtccacgtgcggtcaacgcggataccagcacttggcgcttcatatcccaatgtgggatcgccatcacctcgtagaactccgccgacagggcgtacggatcggcgccaggtgtcacgctcattcggtcaccgactccgggctttcagcggccacacgtggacgatgtgtgatgagcgcgcccgacaaccccgccgcgaccagggcggcgcatcctgcaattccgaagatcaggcgaagcgcatcggtgaacgcagaggtcgcgaacgcggtcattgcctgggtgggaaacctcaacacccccgcaacgatggcggacgctacggaatctgcactgtgcaccgggataacccctgaagcagcgactttcgcatgcacgaacgatgacaacacgacaccaaaggcggccacgcctgtcgctgtccccagtggaaacgcggtgtttgcggcaccggtcgccatgccggccttgttggagggcacgacatcgaccgcaaggttcatcaggtggggcatcgcgacgccgttaccaacccctagcacggcaagagccggcaggatcgtcgtccacgacccgtctcccctgatcagcgtggcaaggaaaagtcccgcggctgttatcaccatggcgatcgacatggtcgcgcgcactccgacagcgcgggcaaccgacgtgctgaggactgcgcaaaccatcagtggcagggcgagtgccgacaggatgagtccgatgtcgaaggcagagcgaccgtgcgcgccggcgagccagaggatgaggaagggaaagacaccaaagctcaaggcgcgcacggtgaatcccaggacaatagctgccaggaatgtggggattcgaaacaaggtgaggtcgagtgtggcctcggagccccgccgcagctggtgcaggacaaacccgactccacccgccagtccgatggccagtgccgcgagcacatcaccgcggccccagcctttggcggcgccggtcaacagaccgtagttgagggcgaacaacaccactatggcaacgacggctccaaccgagtccacccggctgttgtcagctgcgtgcggcgcgtggggttccctgactttgagtgcggtgcatatcgccaaggcgacgccgacgggcacgttgatggcgaagatccattgccacgtcccgatttcgacgagcccgccgccgatcagcggtcccagcgtcgccgcggcggcgcctgcggccatcgctagaccgaccgccttacggcgttgctcttcctcagcatcggtgtaggcgtcggcaatcaacgcaaggcacgttccgaacaccagcgccccgccgatcccctgtagggcacgggctgcaatcagggggctttcggtgcgcgaagccacgcacaacgccgatgcgacggtgaacacggccacgccggtcaggaacagtcgttttctccccaaacggtccgacacactgccgacggtcagtaagagtgcggcaaaggccaagacgtaggcgttgacgacccactgcaatccctccagcgaggcaccgagatccttctggatcgacggcagcgccacgttgaccacggtgatatcgagggtcatgaggaaacatgccaatgcggcgacggccgttgtccatgtttggttcgatctggcatggtcgagcatttgagcccctatcgacaatgaaaatcgttttcagtaaggtgcatcctagctcatgcgtcaccacatggggggaccgcgtcctgctcggctaaacgcaagatcggcaggcttccctgcgcgatgaaatgctttgcaggacaacagaacagtacggagaccggcgccgaaaatgatgagctcgacacctggcccaccagcactgcacgacggtgatcggagtgttcctgccgtattcgcggaatgggttggacggcgaccagacgccgttgcgctgcgaaccgttgccgcaaccgggatcgacgactggacatatcaacggctctgggatcacgtgcgcgagatccgggacgtcgccttctccggactctccgcaggtatacggatcccgatggccttgccgggcggcgccgattatgtggcaggcatgctcgccgcgctggcggcgggcctgatcccggtaccggtgtacctgccctcgactcgcgaaccgcagcggtttctggcccgcgcgcagcacatattgcgcgactgcgaaccctcagcggtgtacacctgcggcgagttggtcgaggtcctcgagcgtgatcccatcctcggggcgctgccaatccgcacaccggcctcgacggccgacggtctcgccccccatccaggtggcacaaccgccgacgccgaccatggagaacacgtcgccttcctccagtattcgtccggatctaccgggaaacccaaaggtgttgtcaacacccatcagtcgattctgcggcaggcggccttcgccgcgaatgtgtggaacggcgacgacgacatgcacatggtcagctggttgcctctctaccacgatatggggatcttctggggcgtgttcatgccgctgctcaacggcggttgcacgacgctcatcccgccgcacgatttcgtacgcaatccgcgaatctggcttgagacagtcagcaggttccgcggaaattggatcggcggacccgatttcgcgtatcgccgctgtatcgaagcctttgacggtaccgcgctgcagagtctggacctgtcgtgtctgcggcttgcgaccaatggcgccgaaccggttcgcggaaccacgttgcgggacttcactgcgaaattccgggcggctggtctgcgggatgatgtcatggcgccgcagtatggcctcgccgaggccggtctgggagtgacaggctctcagactgttcgcgtatgggtcgaaaagagcttcgacgctgacgcattggagcgcggcatcgccgtcgaagtggcgcaacccaacccggcggacggtcgctcccgcgccttggtcagctgcggcgatggcgccttcggctgggatatccagattgtcgatccggaccgccatatgacgttgaccgatggcgaagtcggcgaaatatgggtcggaggtccgggtctgcctgacgggtactggcggcagccggaacagacggcgacaacattcggcgccaggaccgcagacggcctcggtccatacttgcgtaccggggacgcgggattccgctaccaaggcgaactctacgtctgcggccgataccgcgacctgatcatcgttggcgggcgtaaccactttccgaacgacatcgagaagaccgtcgaggaagcccattgcggggtggcgccggggggcgcctgcgccgtgcagcccgacgccccccaggcaaacggcgagtggtggctggtgttggaaaccggctctcccgtcgaagacctcgacgacctgagccgcatcctgcgccgtcgcatcttggcccaccacgagaccgctcccgagcgcgtggtgtgggtgccgtgtcgcacgcttcccaccacgacgtccggaaagatcagacgacgcgagacgctcaaccgtctcaccgcgggccaactcgaggtcgtccatgaggtatcgccgcgagcgcaggcgccggacactcccgccgcacccgacgacccacccaccgagctggctcaacacctcgcagccatgctcggcgtcgagccttacgagctggcgcccgacgccgacttgaccacgctgggcctgacctcgatgatgaccgcccagatcgtcgaatggtcgtcgtcgcagtcgcggcgcctggacttcgccgacctgtacgccgagccgacgctgcgcagctggcagcggctcttcgacgcggcgcccccggtccagaccggcacgagcagcgtcgccgcatccggcccgtggcccacgacaccgctgcaacaggcctactgggtcggtcgcggggccgagcagccgctcggcggtgtggggtgccaaacctacttcgaactcgtcggcgcgcgcgtcgacgccggccgactggcagccgctctcgacgcgctgacccggcgacacccgatgctgcgcgccaccttccccgaccccggccgatgtctcatcacgcccgaggccgtccgcctcccgctcgcagtgcatgacctgaccgacgcccccgtcaccacccgcgacacccaccttgccgagatccgccgccgactgcgcacgcaccgcttcgacatcgaaaccggggacacctggacggtcgaactcacccgcctgcctcacggctgcatcgtgcattttgcggtcgacctcatcatcgccgacgtgaccagtatcggcaccatgctgcgcgacctcgccgcgtcgtaccgcggcgagaagcttcccgcgccctccgccacgttcgccgatctaatacaaagcacgtcaccgccaccccaggcgtgcgcggaccggctccccgaaggcccgcagctaccccgagttcaggaagctgacatctccttcctgcggcaccaacacacgctgagcgccctcgcgaccaaagccatcgacgacgcgtgccacaaccacggcgtgacccgggccgcggtattgctggccgcatacacgttggtgctgcgacgatgggccagccaggacgacttcctggtcaacgtgaccacctttggccgctcacccgaagtgtccgatgtcgtcggtgatttcaccgagacccatctctatcgtgctcagcttgacggccagatcagcttcgtcgaccaggcgcaggtcacccagaaaggcctgcgcaccgcactgcgggcagcaccggccccggacctgctcgccacccaattacgctcgggcaccgggcattccggaatcgtgccggtggtgttcacctacgccgcggacagccccctactgagcgccgaggatgcgaacaccctcggcgccatcgacgaagtggtatcgatgacgccacaggtgctcatcgaccaccaagcgtgccgcctcggtgacgatgtggtgctgtcttgggattaccgcgcgggctgcttccccccgggtgtggtcgacgacatgttcgaggcctatgtgacgctgctggagcgcctcggcggccacgactggtccaccccagcgacgccggggctgtcagcgcactctcggctggcccgagcgcaccgcaacgcgaccaccacgccggcaccggcagggctgctctacgacgccttccgggagaacgccgccacccaccccgcccgtctcgccctgcgctggcggcccgacgactaccgaggtgaacgccacggcgacgtgatcgcgcaggacagatcccagttgacgtacggcgaactagacgaactggcacgcagcgtcgcgcgggccgtagccgcacgccacgctgcgggctcggtgatcggtatccagctgcccaagggaccatcccagatcgttgccgtgctcggcgtcatgatggccggctgcacctatctacccgtcggtgtcgaccagcccgcggagcggctcagccgtatctgcgccagatccgcgatggcgggactgatccgcaccgacagcgacacacaggacgcgggggtcgcggtctctgacatcacggcaatgatcgagtgcgcaccgaccgatccgatccggatcgacccacacgacgccgcatacgtcatctacacgtcgggttccaccggcgaacccaagggcgtcctggtgtcccatgccgcggcgttgaacacgatcgtcgacgtcaaccgccgcaaccgcatcgacacccacgaccgcctactggccttgtcggcgttggacttcgatctcagtgtctacgacactttcggcgcactcggctgtggcgctcagctggtgaccatccccgaacacgcacgccgcgacgcattccactggctctcgctgacaacggaattcggtatcacagtgtggaattcggttcctggtctgatggacatgctgctgatcgccgcgggggacaaggcgggatccctgccgacgttgcgctcggtcttcctgtccggcgactggatcccgttggacttgccgcggcggctgcgtcgcgccgcccccggtgtgcgcctggtggcaatggggggagcgacggaggcggcgatctggtccaacgagttcgtcgtcgacgacgtcgacccggactgggcttcaattccctacggatacccgttggccaatcagatgtttcgggtcgtcgacgacaacggcgacgaccagccggactacgtcgcgggcgagctgtggatcggcggggccggcgtcgcactgggctatcacaatgcaccggagctgacctccgatcggttcgtgcacgacccgaccggatcacgctggtaccgcaccggcgacatggggtgctactggcgcgacggcacgttgcaatttctgggccgggcggactcacaggtcaagatccgcggacatcgggtggagtgcggggagatcgagcacgcgctgcgcggccacccgctggtcgccgccgcgacggtggtccccatccacaactgcactgcgctgggcgccgggatcgtcgtaaccggcagcggcgcagagcaatttgacgactccacacccggcgcgctgcgcgcccatctcgccgtccgactcccgcagtacatgatccccaaggtgttcgtctcatgccccgagctaccgctcaccgccaacggcaaggtcgaccggggcaaaatcgcggcgcgcctcgaagcggccgcgcgggcaccccagccgctcgacacgtcatccaccctcactgtggtcgagcggctggtcgccgaggtctggtccgatgtgctgggcgcgccgatcaccggccgcgaggacaatttcttcgcccagggcggcgatagcctgcgcgccaccgaagcggtcgcccgactgacgcgcaggggagtggccggagcggaggtgggccagctgctcagccaccagacgcttgggcagttcagcgcggcgtgtgtgctcgccgacccggcatccgaggcatccgagtcggcggccgatgtcggcgaacccgtgacaccgggcgaggggttcccgctcacccggttgcagcaggcctacacgctgggcgcggccggactcaatgggagcacctgtgcaccaacgtatttcgcggtggtgctggccgccgcgcccgagtctgccggtatagacctggatcggtttgcccgtgtggtcaccagatgcgtcgacgaattcgcgatgctgcggtgcgcgctggacgccgacaccacccaacgggtgcaggtcgacgccgggccggtgcccgtccatgaccttgatatacaagacgaccccgacctgttactgcggcgcatggcggccgccccgttcgatccgcattcggttccggtgatccagtgcttcgcaccgtcgaggtcaccccgtcacgtcggtctgctgatcagctatctgggcctcgatgcccgcagcctgtccaccgtcgtcaccacgatcatcgccgaataccagtcgcaaccccggccgcggcaggtcgacccgaccgcggcggtcttcgcccggtttgcctccgaaagcgcttggggcgaaaacgatgtcgacaacagcgttgccggccctccgctgctgccgctgcacgaccagcgacgtgaccccttcgagcgggtcaccttcgcgcggcgcagcttcaccatcgaagaacaggctgccgccacgctgcgtgagcacgccgcacacctcggcgtcacccccaccgcgctggtcttcgaagccttcgcacatgcgctggcgtcgatcggcgccggtcagcgattcgcggtgacagtccccaagtcgtaccgtcccgactacgcccccgcggaccgcgaggtgttgggcaacttcacccgcctggcgctgtgcgaggtcgactacggcgccgtgagaccgggatctgccgaagcggttgccgcggcgcagcgggaactgtggcgcgcggtgagccacgacggtgacatcaccggcgggctggccgcaacgcggaccgcgggtggctaccccgtggtgttcaccagcaccctggggctcacccatcaggacgccagcgggctgaccaacgtgcggacattgacccagaccccgggcgtctggctggactgccagaccgaggacgaggtcgccggaattcgtatgagctgggacatagctaccaatgtggttgccgcggaatcgatctcggtggctttttcccgattcgaggaggcggtgcggcgccacgcggggcaagccgagccgccgggcacggccgttgctccggcggtgggcgggtcacccgggcccgagtgggcgagcgcggtgatcgccgccgcgctgcgccactgccgacccgagcaggtgctgccgcaatacaccatgctggtgcggcgctgggaggcactgcgatacgtcccctcaggatacgccgcttccgacgtcgaacgggcggctcgccggttggccggcatcgtcaccggagccgtgtcaccccagacgctgatcggagacccgcagctgacgcccgaggcgctgctgctgcgtgacgaccgcatgcggatggccctcgacgacctggccggggccatcttcgggcacgcgcgcacgctggggcggcggcttcgcgtcgtggaagtcggctcccggaccggcctgatcaccgaacggttgaccgagctggtgggcgtggtggtcgaggaatacttgtgcctggagccaaacccgacgctcgccggaatcgccgccgggcggcgcttcccggccccgacccgccacgtcgacgcacccgacgcggcgtcgggcgtcgacgtggtgatctgctgtgggtcgctgcatcagctgcccgacgcggaggcggtcctcgaggcgatcaccgtgtccgacgacggttggctgtggatggtggagaattccgaggccacccaagcgacgctcatcagcgcggccgttctcgaccccggcctgctcgcgtccgattcgaagacgctgcgtccggccgatcggtggtggcggctcatcgccgaccacggttggcgaccgacgcacatgatccaggacggacccggcctcacgctcatcgcgcaccgccccgacaagcccggcatgccgacaccgccggccgaacagcgccgcgacggtaggtggtcgcgaccggctgtgccggcgtcgtcgctgccgaccgacgccacggtggtggccacgcttgccgagatctggcagcgtcatctcgccattccaacacccggcgtcgacgacgacttcttcctgctcggcggtgacagcctcgtcgcgacccgggtctacgccgaccttcgggccgccggtttcggccaactcgctttcgtcgacctgttcaaccactcgacgctcggtgagctcgcggcacacgccggcccgcgcaccggcccggaagtgtcggtggcggctgagtcgacccggggcggcacccacgacccgaaccgattcccgctcaccgtcgtgcagaacgcgtatcgggccgggcgagaaggcgcgttgatcctcggcggcgtcgccgcgcactgctacttcgagttcgagctcgcggacttcgaccggccgagattcgattcggccgcacgccaactcgtagcacgccacgccggactgcgcaccacggtgtcaccggcgggcaccgacgcggcctcctcgggtgaggtcgccgtcgtgcacaccgcgccgatcgagcccgtcgtgcgagaccacgacgacgtgcgagccgcgatgcgcgaccagatcatcgacttgacggcccgcccgggcatcgacttcggggtgcaaacccgcggcgacgggcgcaccgtcgtcggcatcagcatggacaacaccatgctcgacggcgccagcatgatgatcgccctgtccgaactcgatcacctctatcgcggcgaaaccgttgaccaattgccgccgctggaaacgtctttcgcgcactacgtgtggaaccacccggagctgctgcccgacgccgacgaggcggtgctgccgcggctggccgccagccgagactattggcgcgcacgcctgccatctttgccgccggcgccgaaattggccgacatgtcactgctgttcgagatcgaggagccgaggttcgaacgggcaaccgcgaccattcccgccgtcgactggtcgcaggtaacgcgatcgtgccgtgccgagggcgtcaccgtcgcgtcatttctgctcgccaactatgcacgggtgctgtctcggtggtcggggaccgaccacttctgcatcaacgtcacgctattcgaccgcgaccccgatgtcgtggggatcgaaaacgtcgtcggagatttcacttccctggtgttgttggagtgccgagtcgatgagcccgcctcgatctgggagagcgtgcgcgctctgcagcggcaattgatgaccgacctgccgcaccgcggcgcggacgcggtgtggctgcaacgcgaactgctgcggtttcacggcaacccgacggccgcgctgtttcccgtcgtcttcaccagcggactgggccttgtcgacgcctcggctcgggcggcggtccggttcgccgaaccggtattcgccgcctcgcagacaccgcagacggtgttggacttccaggtgtgggaaagcgcgggggcgctgaagctgtcgtgggacttcgtcagtcaggcggtgtcgccggccaccgcgcgcactcagctcgagtcgttggtggacggcatcaccggtgtcgccacacgcagccgccgcatcgaacacaagttgggcgagggggcatccaatgacgagctcctgcaacgtgtttcgaggatctgcgcgtccgccctgggtcagccgagggtcgaacctcacgacaatttcttccagctcggcggcgattcggtcagcgcgaccaaggtggtcgaacagatcggccgtgagctgtcagcctcggccacccttcgactgctgttcgccaatccggtgatcggcgacttcgccgccaaaatcgccgacactgacaacgccgacgaacccgacctgaccgttgaggagggcatgttatgaccgcggccgagctcgtcgaccacctgcggggtatcggcgtccaactgtgggccgacggtgagaatttgcgctaccgagcaccgcaacaagtcctcaccgcggacctgaaagctcaactggcggcggtcaaaacggacgtgattaccctgctggcggaagagacgaccctgctgcgcgcgccgcaggaccggttcgagccgtttccgctcaccgacgtgcaagccgcatatctggtcgggcgcacgtcggcgtttcagtggggcggggtaggctgccacggctacgccgagttcgcggtcgaccacaccgtggcaacaccgagcgccgagcaatatcgggaggcgtggcgcaaggttgccgaccgccacgacatgttgcgctgcgtcgttcatcccgaggggtatcaggtgatatgccccgacgtgcccgacgacgggctggtcatccatcagtgtcacacggtcgaagacgttgccggcgtacgtgccggggtcacggaacatctgcgtaaccggatatatccgctgggcgaagcgccgatgtatgacctggtgatcacgatgggccctgacgacaccgtggtccatctgtccgttgacctgctgatcgccgacttcgtcagcatctccatcctgatgaccgactttcagcagtgcttgcttgaccccgaatgcgaccttgcgcccgtcgatttcagcttccgcgactacctgctgaatctcgctcgcgagcgaagctcggccgccggtagtgcccgccgggaacgcgatctcgcctactggcgggatcggctcgatcagctgccgtcaccactgtcgttaccggtgctgcccgacgactagacgccgtcagcgtcgcggacggcaccgaccttttcacggcgttcgatgcgcctgtcggccgagcgtttcgaggtgctcagccggcgcgcggcagagcacggagcgaccgtcaacgtcgccatcgtgacggcattcagccgggccatcgcacgctatggcgatcgcgaccatttcctgctgaccctgacgaccatggaccgccacgcgttcactcccgccgtcgggcagttggtcggggatttcaccggcaccagcgtgctcgaagtcgatgtccgcggacagcgcaccttcgccgaactgctgcacggcgtcggtgatcgtctcttcgacgacatggaccattcgaccaccggcggcgtcaacgtcgcccggctcctggggcagcgcgacgacgaccgaggtgagcagacgcccgtcgtgttcacctcgacactcggcgccacgacccgaatcgacagcggcgcaacatctttgttgcacccgattcaaggtcgcggtctgagccagactcctcaggtgctgctggactgtcaggtcgccgaaatcgacggcatgcttgaggtcaactgggacacccgcgatcaggccgtgcccgccgaggtcctcgaccgcgcgttcgccgacttccgccacgccctggatctgctcagcaccgacgcctcggcctggcaccggccgctattgccggcccagccccccgagaccacaccggtcgaggggccacgcacacaccatgaaccggcgctgatccataccgggttcctgcgcaacgtgctggtgacaccggatgccgtcgccatccgccacggtgatcgggccaccacgtacgccgaattgctcgctgccgcgaccgcggtggccgacacgctggccgcgacgggggtgcggccgcgtgactacgtcggtatccggttgccgcagggccccgcccagatcgcggctctcctgggcgcattgctggcccgggccgcctatgtgccgttggacgtcggctggcccactcaccgcgtcgaccagatcgcggcccaatgctcgctggcagcgctgtgcgagccggacggagaggtggaccggctgcttgccgacccgcagacctggtcaccgcgcgcggcggtggtgccggagccccacagcgaggtgctcgccccggacgacacggcctacgtcatcttcacgtccggctcgaccggtgtacccaaaggcgtgatgatggcccacggggcggtggtgaacacactgaccgacatcaacgaccggctggccatccgcgcaagcgactcggtgctggcggtgtcgcagcacaccttcgacctctcggtgtacaacatcttcggagtcctcgccgccgggggcaccatcgtgttcgccgacggaaacgaaacaagcaacccgcaagcctggtgcgacgccatcaccgaccaccgcgtcaccgtgtggaactccgtcccggcccagatgcagcttctgctcgaccacgtcaacggcacacagaccttgccgtcactgcgcaacgtcatgctgtcgggagactggattccggtgtcgcagccccccgagatcgcggcgctcgccccgaacgcgtcgatgctcagcctgggcggggcaacggaagcggcgatctcgtcgatctgtcatccccttgccgcgcaggtctatcagcgcagcgttccgtacggaaccgcgatgcgcaaccaaagtgtgcgcgtgctgacccaccgcggcgaacccgcgtcgccctggcagatcggcgagatacacatcggcggactgggcttggcacagggatacctcggcgatcccgagcgcaccgcgtccgcattcgtcgtccatcccgtcagcggggagcggctgtaccgcaccggggattacggccgtctcatccacgacggggtcatcgagttcctcggacgccgcgacaaccaggtcaagatccacggtcaccgaatcgaattagccgaagtggactccgcgttaagtgcgctcgccggcgtgcacgccgcggtcagcaccgtcgtcggtcagggtccgcacgaccggctcctggcggccgtcgtcgtcgccgacgcggccgacgacgacgaaaaacggcaacgccgcgacatcgcggccgcggtgagatgcgctgccgccgacgcgcaccgcaacagcaccgccgacctcgacggcgacaagctcggccatttcgccagcacggcacgagcggtggcgatcgagagcatgtgcgcggcgctgcgaaccgtaatggacgtcggcgaacgaatcgatttcgccgaactcgccggacggttggccctaccgcaacggctggaacggttgctgcgccgatggctcgacgctcttgaggaagcgggcatggtcgtgatgcaccggggacccagtatcgaattacgcgggggacctgagctttccgcctgctcggcccagtggcagcacgtacgggcgctgggagcggccgtcgactacggcgacgaactgctggactacgtcggccagtgcgtcgagaatctgtccggcctactcgccggaaccgtcgacccactcgctttgctgttccccgagggaacgttggacaccgctaccgccgcctaccgggacaacctggtcagcaggtacaccaacgggttggtgatcgccggggtggccgaacgtgcgcggtgggccaccccgacgcggccgctgcgagtactcgaagtcggggcgggtgtcggcggcaccagcgtcgggctcgttgcggcattggcccatcaccacgtccggtataccttcaccgacgtctcccactttttcctcggccaagccgccaaaatgttcgccgagcacgacttcatcgactaccggctcttcgacgtcaaccaaccgcctgccgcacaagggctcccgccgggatccttcgacgtggtcgtgtgcgccaatgtcttgcacaacgccgtcaacgtcgatgacaccctggccatgtttgagcggttactggcgccgggcggctcgctggtcttcatcgacgccaccgccaccaatcaccccttgatgatctcgatggagttcaaggagggactgcacgggttcaccgacgcgcgcgcgggtaccaactcagctttcctgtcctatgcgcagtggggagacgcgttagagcgatcaccgttcggcgaggtatggagctttccgccaccggagcatccgttgagcaagctcgggcagcacgtattctggtgcgattccgcctccggcgcgcatgcgctacgaccgggcgagctgaccgagcgtgcccacgcggtcttgcccagttacatggtcccccaacaggttatctgccttcgttcgctgccgctgaccaccaacggaaagatcgaccgagccgcgctcaccgcggaactcgagtcgcttcgcgccgcggcccggcggttcggccgcggcggagacggcgtgtcggccagtctggatgcgatgcagacgcgtatcgccgaggtctgggtcagcgtcctcgggctgccgtcaaccgaagccctgtcaccaaactcggatttctttgctttaggtggagattcgctgctgttggcgcaaacgatcggccgcatccgtcgagagatcgacgaagccgccggcatcgcgtgggacgacctgctgcgcgcaatggtgtctgatcccaccctggccgcagccgcgcaggcggttcagggatgcggtccgacagcggattccggggattacagcgctgaacttgactcgcccttggtgtatcttggtgcgggacaaggttttaggtcagggaccgagatcgcggtttgcgtccacgacggaagcggtggcctggcgccgtacgagcagctggtgtcggagttgcggtcggctgctgacggcgcgcccgagctctacggcctacgcagggtcgccggtgacgcgtactcgcgtatcgcaccgccggagctgttcaccacactggcgtcgcgctacggcgccgcgatcactgctctggcacccagcaaggttcatctggtcggctactgcatgggtggcctgttggcgacagaaatcgccaaatgtctcgaggaatccggcattgtcgtcgcacccgtgaccgtggtcagctcctaccgcgtgccattcgacatcgaagacgacgacatcctcgactactgcttcgcccagatcatgggtgtatcgcccagcgatctaggattgcgggtcgcggatgacgccatccgcgcggcattcgcggccgtccggtcgcgccatgccgacctcataccgcccggcgctttgcgcgcggtcgccgcgccggagctcgccagcgccctcgatcagagcgccgctccgggggagcagcgattgaaactgcttgcacaatcgggcgttctgggggactcgtggaccgccgagtcgctgaccgagctgcgggcgatctttgtgcatagcctgcggtcggtagtccagggggcggcggacccgtttttgggcgacgtccacttcctccggcagcgcggcgatatccatttcctgcccaccctcaaggaggacatgaccgaattctggcgtggctactgtcttggtgaattgaccatcacagagatcgacgggaaccatttcgactgtctcaccggcgaaaacgcacgctctgtagccggcctgctcctagggtcttgggtggtgcgcacgtgaggaaggtgctgctgttaggcagtaccggagcggtcggatccggttgcctcgacgtcctttcgcggcgggacgatctcgcgatcgtcattgcgggacgcgacgaggcacggctgcgcgcggtcgcttctacgaaacggtcaggtgtcgaggttacgcgactggacatcgccgacgtaccggccgtcacggcgaccgcagcgcactgcgacattgtggtcaactgcgcgggtccgtcgtatcggttcagttcagacgtcgctcgcgccgccgtcggtgccggtgcggcttatgtcgaccccggtggtgaccagacgttgcttgacagcctcgccgcgatcgaaacgaccgcccccgttgtactccaaacaggcgtacagcctggcctatcgggcctgctgctgcgggctctcgcgctgcgtcaccccgaacggatcgaaaacatgcatgcgtggtgcggtggattgcagcccctgacggcggcggcggtgcacgaatacctcgccagcctggaaagtccgcatagctatcctgccagtgcactgcgcggcggcgccgtccgacgtgtccgcaacgaagagtgcgtaccggccccggcgcagtatttccccgacaccgcgtcagtgcatccacatctggactccgaaaccatcgcggtggctgcccagttgggtatcggaaaggtgtggtgggccaacgtgttagacggtgcacgcaccatacgagcgatacatctcttggccgccgaggacagacaagggtgccgtgacaaggacctgcgggaagtgctggcagctgtcaagctcgacctgttcggccgcgccgcgtacttcgccatcgtgtgcgctgcgcaaagcgactccgtgtctacgactttggcggtgacatgcgaaaacagctatcgcgtatctggtgctctggctgcctttgccgcacaacgtgttacgcgcatgaccgccggagtgcacccgttctggacagtggatgacccatgggatgtgctcgcgttcctggccgcgaccgtaccgtgactttgcggtatcattcgcgggcgatgcctcgcccgtcccgcatagcgcgctgtcggcggccgaggagggttcactgtgaccactcggccgcaccgtcctcgggcgatcgtggtgggttcgacattcggcgccgtgtacgccgaagcgctggcggcgccggaatcgccggtggaactcgtcggattgttgtcgaccgggtctcggcaatccgccgatctagcctcgcgccttgccattccgctctataccggcatgaacagcctcccgcgcgtcgacatcgcgtttgtggtggtgcggtcaggagttgtcggcggtgagggaacacgagtgtgcaaggagttgctctcacgcggcgtgcatgtggtccaagagcagcccgttcacgctgacgagattatgtccctgctccacgtggccgcggaaaatgcggttctctacacggtgaacgacttctacagccgggtcgcgccgatgcgccaatttatctgtgcggccaagactctcgatagcctggcgcgtatcaggtacgttcatgcacgggcatcgctgcacgttgtctaccccttattcaccattctggcgagcatcgtcggcccgctgaccccggcccggatcgtcatgccggaacagaccggaggcgccttcgtcgccggccggattgtgctcgccgacgtccctgtcgacctgctgatccaaaatgagttgtgcgccagcgaaccagacaactacgcacggttgttgcacaccctcacggtagggtccgacgccggcgaactcgtcctcgaccacacccacgggccaacacggtggcatccgcgtccgtaccccgatagctgggcgtcgcagtccggctgtcctatctccgaacgtgtcggtatcgactttgacccgacgacggcgacggtgcgcaacgaactctggcccgacgcggtccggttggccgcctccgaatttctcggatcgatcggccgcgtgcgcgcaggggttacgcaacgattcgtccgggccacccggctgtggtccgaatttacgtcggcgatggggcctgccgcaccgatcaatccggtgacatcggcaaggctttcggcctcggagctggttgccttatgaccgtgcgtatcggagcactgaccgaaccgacacccggcaaccgcaccgtcgtcgtcttcccgcacgcgggcgccagcccgcgcttctacgcttcctggtgccgcctactgcccgctggcgtcgatctctacggtgtcacctatccgggccgggacatgctgctcgacgagcccgtacccgaaacgcttgctgacttggcctgcaactgcgcagtagagctgaagccgatcatctactcgtcgagttctgttgtggtctttggtcattcgatgggcagtctcgtcgcgtttgaaaccatccgagaacttgaacaggatggagtatcggtgactgctctggtcgcttcaggggcggacgcaccgcatctggaaaccgaccagtcgtggcaccgtgctgcggacgaggacctgatccagcacctggccgaactcgacagccgcagtcgcgacgtgttcgccgtacccgaattgcggcggatgttattacccaccgtccgcgaggacttccgcctcgtcgaaagttatcgcgccgagctgcacccgccggtttcctgtcccatccatgtcatgaccggggatgcggatcctgaagtgacagcgcaccgttgggcgcagtgggcggtccacacccgggcgccctggcacgtacggtcctttgctggcgaccatttctacatccgtactcacgaagacgacgtcgtcagacacctatgcgggattctcacttcggccccggccgcgacccaatagcaacgactgcaaatgcggcggtccaatatcgtcaccgagttgcaggagagcgaggttgagcccgatgacaaggacacccgaaagccagcaggaaagcgactatggatatgtagcccacaaggacggctacgccaagcgattgcgcagagtcgaggggcagatccgcggtattgcgaagatgatcgaagaggacaaatactgcatcgacgtcctgacccagatcagtgccgccaacaatgccctacgttcagtagcactgaatctgcttgacgagcaccttgatcattgcgtgagttctgcactcgctgagggtggcgacgaggcacaggcgaaactctccgaagcctcggccgcgatcgctcggcttgtccgctcctgatcgcggccccgaattctttgggggcggtcaacccccgagcgtatcgctaatgacacggaaaatgcttgacccgatataccctacgggggtagtgtaatatgcatgaacgacaacctgaattgcacgtgtaggtccaccggatgtacgtgcggggaatctggctgcacccaagcgcatggctgcaaatgcggtcacccgaattgcacgtgtaacgactgatcgccaacagttaccgcctcgactctcgttgaggcggtaactgtttcgcgtgagatgcccactcgggcggaatgcacagcgatccgtcttagttctgatggctgactcgggccaggttcaggtcggcccgcaatcgggccggtagatctgcgctttcccagcccccggcggcgacccaccggcaggcaaccctcgcgtcggcatcggtctcaataggtccaacccaaaccatcgcggcgctgggcgtccggtcaaccgtgcacggctgcaggaccatgatcgggctgcgactgggatgcatcgttgcacaggtaaattcgccgaggaggcactgagtctgtaccagtacgccgtgcggagaccggcgtacgagccgacgcagcagcgtcatgatcaggggctcctgctccgcggtacaccgcctgcataccgcgacggtgaacggtcgatatgtccagcatcggtccgacatgtcgccgtctcctcctttttcactgtgacgctttacaacctgcgctcattcgcggtaggccaaccaggtgcgaccatcaagacgtgtctccgatcctgtcgtcggcgccgtgcccacgaatgatgtctggatgctcgccggcagagccataggaaaccgactcaaatggaccagcgcgccaatcaccaaagggatcggcatagtttgcccaccggccgggctgagaaaactcttcgtcggtcagcagtgcccatcgtaggattcggaggatctcaccgggatcggcgccacaagtgaggatggtcatcgcgacatgtcggtctccgtgctggtcgtcccagcgcgccgcggccatgatacgtcgatcggcatccgcggcggccatctcggacgcgtccatggctgccagccaacggccgacgttgcccacgcgcagttccattccagccgattcgatccataccactgtgtcgggctggctggctagccatactcgaccgcgagttctgaccacgccctcgagcagcacatcgatggcggtgtgcaatcgggcgggatgaaatggccgcgttgcagtgaaatcgagaagggaaacgcctgcctcggatacgagcggcggctgtccggtaaggagcgattcatgcgggtcgaagtcggcgcctcggcgtgcgaggggatgcaggttgcgcaagattgattcgatactcgttatgtcgcaggtgattcgcgacctcggcgccagtcgccgaagcacggcctcggtcctgcgttcgggtttggacaacaccagcacgtcggcgaattcggcttggtcgaccaccgcttgggcggcgctgcgatggtcgtccagttcgtcatcgcccatggcgtgggccagccagctatccgtgtcgacacacgtcaccacagaactgatgtgcacatcgagggccgcgggtccgtcagcgtagccggggccaacgcacaccggggtgtgattgatcgcgtagcaaatcagctcgagttcggtccgctcgtcgagtagcacgacgacacggtccacgtcctgtcgacgatggacacgccgcaacaggatgagcaagtcgtcgtggatcgtacgccctgggtctgcgttgcccagctcgaggatccaatcactgtcccacggtgcgcccgcgcgcagcatactcacccgtcgtcgcaccacatgtccgtcgagggtgtggctaatcactgcggtgcccggtgtttccctcagggcggcggcgacccggccggtgcagcctcgtccggtcaggagcaccacgggagtgtgcatacccctccttatcgacaatcgttttcatctagccgagtttcacggtacagtcccagcggaatgttgtcgaaaatcgttttcaataagcgtgggtttgccgtgatctcccgtcgcgctctcaatgaagaagtcaagccgcggattcggtgatcgggggtgaatcaggttgccaggtgcggttgtcgcggatgagggcgtagaggacgttggtacggcgtcgggccgggcagatggttgcttggatcgactgtttgccttcgtctcgtttggactggtagtaggcccgagattgcgggtcgcagcggatcgcggtcagcgcggacatgtacatcactgggcgcaggcgacgactgtaacgctgcggtgtgtgcagtcgtccggtgcgtttacccgaatcgctagggactggggccaggccggcccaggcggcgagctggtcggccgacccgattctggcggggtcgccgacggcggccaggaactctgcgccgagtcggaagccgatgccgggcaggctagtgatcacctcagcgagcggatgtcggcgaaatcggccctcgatgtcggcgtcggtggctgtgatgcgggcatcgagggcgatcaccccctgtgccaattcggccaccaggtgggcggcgacttcttcaccgggcaggcgcaccgtttgggtcttggcggcagtgactgcagcgtcggcgatcgatgcagcgttgcgcaccccggcgtcgccgaggatcttcgtcaatcgcgaaacaccgctgttgcgtatggctttcggacgctgatatcgcgacagcaacatcacccagccgcgatcagaggtcagcgcagctactcgctccaaggctgggcatactgccaccaactgctgacgcagccggttgatggtgcgggtgcggtcggcgaccaggtcggtgcgatgggcggtcagcatccgcagttcggtgatcaggtcatcgtcgggcgccaggaccggcagatcggccccacgcatccgggattgatcggcgatcacccgggcgtctttggcgtcagtcttggcctcaccgccgcgatagaccgccgaggcctgccacaccgcccgaccgctcaggtaacgcaccggcgtatcggcagcagccaacgctgtcaacaacaacgccgcatataccgtggtcagatcgaccgtccaggacacctcctcagccagttggtcaatctcggcgacgagttcacggatgggttgctcgtcgttgacgagcttgcgcgacaacaccaccgcaccggtgtcatcgaccacgcacacccagtgatattccctgccgacatctacaccagcccacaaccggcccgctgccatcgcaccccttttcgcttgtctgccaacatgatccccacggacaaccccgccagcatttccttaaagcagcgatcacatcgcagatctcaatcagcggccagagcagtccaggcaggccgggcggccagtcctctcaagccgcacactaggccggcaagacacatgcagcctcacccgacccacccgggttgcagcacaacgtaacaacacgaagtaactgcacctacgaacttaaggaggatccatgggccgactggccggcaaggttgcgctcgtgacaggtggaggtcgcggccagggccgcagccatgcggtgcacttggccgatgaaggcgccgacctcatcgtcgtggacatcggcgaggacattcccagcaatcagtacgcactggccacacgggctgacttggacgacaccgcgaagctcgtcgagaaggccggtcgccgcgttgtcgccgcacaggtggatgtccgcgaccgggtcggtctgaaggcgctcctcgatgaagcggtcactcaactcggcggcctgcacgtcattgtggctaatgccggaatctgcccgcttggcaacgacattcccgtccaaggcttcgtcgatgcctttgacgtcgacttcatcggtgtcgtcaacaccgtccatagcggactaccacacctcaacgccggtgcttcgatcattgtgaccggatcagtagccgggctggtgccgcaagctggcggcgttagcggtcagggcgggctgcagggacccggcggcgacggttatggcctggcgaagaaggtgattcgtgattacacccggtcgctggctctgacattgggtccacagcagatcagagtcaacgcgatacatccgacaaacgtcaacaccgagatgctgcacaacccggccatgtaccaaacctttcgtcccgatctaaccaatccgagtcgcgaagacgccgaagtaacttttcccttcatgcaggccatgccgattccctacatcgatccttgcgatgtgtcgcatgccgtggtgtatctggcagccgacgaatcgcgttacgtcaccgggcagcagctctttgtcgatgccggggcttcactgaagctcggcatgtaagggttatgtcctggttcggcatgagtggaacacgaccggcgtgggcaatgcgggcctaccacggcgatctcgagactcgtcgatccgttgtccgaaggtgatcgggtggcacgtattccagtcgccaagatggtgaagaagctttggatcgtgctggtcatcgtagccgtgatcgcggtggcgggactctgtgtctcgcgcctacgtgccgccttcgccaaccgcgacgaccggccgatcagcagcggtgccgctgacgacatcaagccgttcaatcccaagcgggtggtctacgaggtctacggcccgccgaagacggtggccgacatcaattatctggacatcaatgcccagcctcagaaagtcgccaatgtggcgctgccgtggacgctttcggtgatcacgacgcttccctcgatgagcgtcaacgttgtcgcgcaggcagacaccgatcagatcggctgccggatcatcgtgaacgaagtggtgaaagacgaaaggtcggctgacggcgtgcgcgctcaaaccttttgcatagtgaagtcggcatgagcatcgaccacttcgggcagccccccaaaccccagacgttcgcccgcgcggtccgtaggtttgcggtgcccgtcgttgtgttctggataggactcgtcgtcgggctcagcgtctttgtcccgtcactggacaaagtcgcgaaactgcgctccgtgggcgttagccccagcgaagcgccctcgatgcagtcgatgaagcgcgccggcaaggtgttccacgagttcgacagcgacagcgtgacgatgatcgttctggagggcgaccacccgctgggcgacaatgcgcatcacttctacgatcagatcgtccacatgctcgagcaggaccacaagcatatccagcatgtccaggacttctggggcgatccgctcaccgcagccggatcgcaaagctccgacggcaaagccgcctacgtgcaggtgtatctcgctggcaatcagggtgagagcctggctaacgaatccgtcgccgcggtccgcaagaccgtgggcagtgtgcccgcgccgccgggaatcaaagcctatgtgaccggccccgcggcactgctggccgatcaatcctcggcaggcgagaggggggtgcagaaggtcacgatgatcaccttcggggtgatcatcgtgatgctgctgtgggtttaccgctccatcgtcaccgtgctcattaccctgatgatggtcggagtcgagcttacggcggcgcggggcattatcgctcttctgtcctataagaacatcattgggctgtcgaccttcgcggtgaacctgctggtactgctggccatcgcggccggcacagactacgcgatcttcatcctcggacggtatcaagaagcgcgcggggtgggcgaagaccgtgaaaaggcttactacaccatgtttcacgggacggcccacgttgtcttgggctcgggtctgaccatcgctggggcgatgtactgcctcagcttcacccgcctgccctatttccagacgctcggagtgccctgtgcggtcggcatgctcgtcgccgtcttcgccgcgctgactctcggaccggccgtcttgacggtgggcagccggttcggtctgttcgatcccaagcgcaggatgcgcacccggggctggcggcgggtgggcactgccattgtccgttggccgggcccggtgctggcggtgtcggtcgcggtcgcgcttgttgggttgctcgccctgcccggttatcagaccagttatgacaatcgtccgtacctgcctacgagtaccaaggccaatatcgggtacgacgccgccgagcggcacttccccaacgcccggatgaatcccgagttgctgttggtcgaaaccgatcacgacatgcgcaacccggcgggcatgctggtgctggaccgcattgctcggggcgtcttccaccttcccggcgtggcgcgcgtccaggcgatcacccggccgttagggactccgatcgagcacacctcgatcccattccagatcagcatgcagaacacgattcaggtggaaaaccaggagtacatgaagcagcggatgaaggacatgctgcagcaggccgacgccatgcagcagaccatcgacacgatgcagcggatgtacaacatcacggcccagctggtcgccaccacacaccacatgacgggcctgacacacgagatgacagatatcaccaaggaattgcgtgacaacatcgaaaatttcgatgacttcttccgaccgatccgcagctacttctactgggaaaagcactgtttcgacattcccgcctgctggtcgctgcgctctgtattcgacacgctcgacggtatcgatctgctctccgacaagctcaccgaattgtccagagacttggacaagctggatgtcctgatgccgcagatgctggcgcagatgccgccgatgatcgcgcccatgacgacgatgaagacgatgatgctgaccatgcacagctcgatgtcgtcgctgtatgaccagatggacgtgatgagccagaactcgaccgccatgggacaggcgttcgatgcgtcgaagaacgacgactcgttctacatcccgccggaggtcttcgacaaccccgatttcaagcggggcctgaagatgttcctgtcgccggacgggcacgcggcccgattcatcatctcccatgagggggaccccgctacccccgaagggatttcgcacgtcgacccgatcaagaacgcggccaaggaagccatcaaggggacgcctctggagggtgcgaagatctggctagccggaacggctgcggtctataaggacatgcgcgatgaggccaagtacgacctgatgatcgccgggatctcggcggccagcctgattttgatcatcatgttgatcatcacccgcagcctggtcgccgcgatcgtcatcgtgggcaccgtgctgttatcgctgggcgcctcgttcggattgtcggtgctggtgtggcaggacatcatcggtttcaagctgcactggatggttttggcgatgtcggtcatcttgatgctggcggtgggatcggactacaacctgctgctggtttcccgattcaaggaggagatcgccgccggaatcaagactgggatcatccgctcgatggccggtaccggtgcggtggtgacgtccgcgggtctggtgttcgccgccacgatggcctcgtttgtcttcagtgatctgaaggtcatcgggcaggtgggcaccaccattggtctgggcttgctgttcgacacgttgatcgtgcgctcgttcatgatgccgtcggtggccgcgctgatgggccgctggttctggtggccgcagcaagtgcgcacccggcccgccagccagatgctgcggccctacgggccgcgcccggccgttcgcactctgctgttgccagaaaatcgcgacgtcgccggctcgtatgttcgggtcggcaaattgtctttcagtcgaccacattactgacggctgcgatggagtttcacgcgtgccgccaagcctgcgtcacccctcacctcgtgtctttacaatctgcatgacacccgattggtcgtcgccgcatcgatgacgaggaaggtaacgagatatctgtgtttggttcttctgttcaggacgtgctgcgtgagcgcgccggcatgcagcccaatgacgccgcatttacttttgttgattacgaacatgattgggctggcattgccgaaaccctgacttggtcccagatgtatcggcgaacgttgaacgttgcacacgagcttaggcattgcacatcgagcggcgaccgcgcggtgatattggcaccacagggcctcgaccacatcgccgcatttctgggagcgttggaggctggcctcatcgcggtcccgcttgcgcctcctgcgggcggcgcccacgatgagcgggtccactcggtgttgcacgacacatcgccctccgtgctcctcgcaacctcatcagtcgtcggcgatgtcgccaagtacgctcagccgcggagcgatggatccggtccttcggtgatcgagatcgattcactggacctgcaaagatctcgagtgactttcaggcgcggtaatcgaccggcgaccgcctatttgcaatacacctcggggtccacccgccgaccagccggggtgatggtctcgcacaagaatcttctggccaatttccgtcagatcatgtccgactacttcctggactacgggaaggtggccccgccggataccacgaccgtgtcgtggctgccgttttatcacgacttgggtttaattttagggatctgtgcgccgattttggccggagtccgcagtgtttttactagtccggtggccttcttacagcgcccggcgcgatggatgcagttgctggccaacaatagtcgggtcttttcggcggcgccaaacttcgctttcgacttggcggcgagaaaaacgactgacgaggacatggccgggctggatttaagggacgtgctcattatccaaagcggcgcagagcgggtgcagcccgcctcgatgcggcgattccaagaccggttcgcgaagttcaacctccgcgacacggtgatacggccttcctatgggctcgccgaagcgactgtttacgtcgcgacccgcacaccggcgctaccgccccgagtcgtctactttcagcccgaaatcctatcttccggacacgcgaaggggtgcgagagcggaagcggcaccgcgttggtcagttacggtgtgccacggtcgcagacgatccgcatcgtcgatcccgaaaccagcactgagtgcccaccgggaacggtcggcgagatctgggtgcatggtgagaacgtttcggcgggctattggcagcgacctcacgagactgaaaagaccttcggcgcaaggcttattggtccgtcggccggcacaccacaagggccttggttgaggaccggggactcgggcttcttcttcgacggcgaattattcatcatcgggcgtatgaaagatctgttgattgtgtacggacgcaaccattctcccgacgacatcgaatcgacggtacaagcgatcgcacccgggcggtgtgcggcggtagcggttccggctgagggcaccgaaaaagttgtggtaatcgtcgaatccaagaaacgcggtggctcagacgaggaagtaatgaacaacctcgccgccgtcaaacgcgaacttacttcggcgatttcgaattcgcacggcctcgccgtggcggacgtcgtcctggttgcgcccggctcgattcccatcaccaccagcggcaaggtcaggcgagcgacgtgcgtcgagcagtacaagcaggaccagttcgcccgtctggacgtgtagggtgctcaagaaccaggcaggtgcgcaatcgctttcatctcagctgttctgcacgatgaagtcagccaaacccatgattgatctgtggcggtcgtgatgcctcgggcgcggatatattcgcgggtggcgcatccgggcggtgccattccggacaatcggctcgcgttcaccgatcagatgtcgtttctctcggtgcgcgctaccggacaggggacggtcgctcagtgtgtgtggatttatgagcggaccgtcgatttcgaaggcctgcgacgcttccaccgcaatctggatctcgggttgttgggtcgacgaatagaacgttctccgctgccgttcggccgtgatcggtgggtttcctctcccccctccgtggacatcgaagtcgctgagggcgcccgtccgcgcagcgagctcagcgagtgggctgacgaacgtggacgactacctgttaacgccgaacggggtcccgcttggcatctcggcgttgcgcacttcacggatggctcgacagcggtcagcctggttgcatcgcacttggtggtggacggactcggtttctgcctggcgatcgcggacgccgtcaacgggaccgcccgcgatctgggctacccgccgccacgttcacgccaccgactgcgtgcggtggttcaggatgcctaccaaagcgcgcggggaacacatgaggttgcgcgagcactcttcacggcagtgcaagcggggagtcgtcgacgctccgatgttgcgagggtgcgggcggcgcggcccatgcctattcacagaagcaacccggacgacggcgtgatggcaccggccattacgatctatatcgatccggatgagtgggatgcccgagcaaaatcacttggtggaacgagtaattcactcttcgcgggtgtcgccgcgaagctcgctgagcactctggatgccggtctgccgatgacggcaccgtggcgatatcgttcccggttagcgaccgtaccgaggatgacatgcgtgctaacgcattgtcgtttgtgatcgtcatagtcgatccagcacaggcaacaacggatttgcgcggtatccgaggcgcgataagccaggcgcttcagaccctgcaggaaaacccagaggaactcttgcaggtgcttccgctggccccgctgacgccgaaacgggtgatgagaaagttggcccacgtggcgtacggctacaccgacgtggggtgctcggccattggcgaactcgatccggcggtgggacgacccgatggtaccgacgcagaccatgtcttcattcgtggagtacggcaacgctttacgcgtcaaaacttcgatcgcccccgcggcatcttcatggtctcggggcggatccgcggacgaatgttcatcaccatcgtggcctatcagctcgagggcagggattcgaagcatcacctgcatgagctggtggcgcaaacgctttcggagttcgacctgacgggaacgattgactaatccttttcgagaatgtacatccggtatgaattggcctgaccccgatcggttgatccatcgcttatgagcgtcttgtggcccaacgagatgggcaggaaagctcaacacggtcatggcgacgaggaagcggcacactcctgagcagattgtgcgtaagctgacggcagctcggctgcgggctgcgggtaatgagaccgcggcggtatgccgcgagttgggtgtgtcggaggtgacgtatcactgctggcgtaatcagttcggcggactcaaggccgaggacgccaaacggctcaaggattcgaacgcgagaacgccaccctcaatgggctctggttaatgcgacgttagagaaggacgcgctgcgggagagagcacaccagatgatccagacgtcgcgttgcggacctgcctacgccagtacgccaaagatcatccccgccgcagattccgctccgcctaccacgatgcgcgcgccgagggctgggccgtcaaccacaagaagctccaacggcgttggcgcgatgaaggcctgcgtgtgccacagcgacgacgcacggcatatcaacagcgctacccacggtcgtcgcggatgcgcccgaccaggcgtgagcggtggacttccaattcgacgtcagtatcgatggccggccaatcaagatcgtctcaatcgtcgacgagcacacccgcgaatgcctcgcgggaatggtcgagcgcagcatcaccggtgagcatctgattgccgagctggaccagctggccgttcagcacggcacctatcccgggtgctgcggtgcaacaatgccccctgaattagcgtgcagcgcaatagctggctgggccagcggccaaattggcccgggtagccatcagcgactggaaacacgactacaaccaccaccgccgacactcggtcctgggcattggtgtggcatggcgcgggatccgataattctcgatcaggcaacgccgcccggacgccagccgagttgcaacaagaggcctaggtcgtcgcggatggcgcggtggtgggtgatttggccgtcggtgatggtgaagatgtgaacttgtttgtgttcgatgtgtttgccggtaggttggatgccgttgaaaataccggtatgttcgccggtcatcgtgctcaccgcgatgaccgtgttgccttcggcgagcgtttcttgatgctcgaagctcaggttggagaaggcgttgcgcaaccattggctggtggccaggaaccctgccgcgccgtgttgttggcgttcgacctcctcagggtcgtcatcggcttcttgattgacgaagtcggaagcgatgattttctccgccagttcgacgtcgccgttttcaatcaatcgaaaagattccagtgcaacggttttggtgtcagacatcggctttggccttccttgatattggttgggttaactttgtgcggagtacagcttgccgcggccaggtcagtagtttgatcagttggctgaagtcatagccctgttctgtgggccgcatctggacgatgaggaccctggcccctgcggctacatattcgtcggcggatttgtcatcgaaccagggcaccgctcgggtgatggcggtgccgtctcggccgttgtgttgcgcgagatcgtccagcagttgacttttgatgcggaactgttcgatcggcaggaaggtgtgccagatgtcagcgtggcgggcgactctcgggagggttttcttttcacccgagctgccgatcaggatgggtattgggtgcagcggtggcggttttagttgcgcgagacggtatttgatgcgcgcaaggctggcgtcgaagagcgacatgcgggatgcgacagtaccgaattcgtatccgtaggtggcatagtccttttcgtaccggccagcgcccaaacccaagatgagtcgtccgttgctgatgtggtcgacggtgcgggccatgtctgccagcaggtcggggttgcggtagccgactccggtaaccagcaacccgatctgggctcggttgatgatttcaccccaggacgcaagggcgctccaaccctcaaagtggttcacctcgggctgatgtggggacaacacggggccggcatcggtggccttgtcaaaaaccggttcgtgaaaatggtcgtatccaaagatcaggtcggcccccatacattcggcttggatgaccgcggcacgccaggtccggtagttcggggtcccggccggctggatctgaacaccaacggaggagatcattgcccgccacccggctgtcgatcccgcgagggttgcagtcggtgggtgatccagtcgaggatgattgactgggtatctgccgtgtagcccatgtgcccggtggcaaagaaccgcgccgatttgggggacccgtgctcgagcagcaggtagtagtcgctgatcgggaatacggtgtcgtgtagcccgttgatgagcagcgtctcagcgcagggccggtccaggataccttggcgtacaagggacagcttcggcgcgtagtccacccattgctcgaaggtgtcgcgcccaaatgcataggcgagggtctcggccagctcgaaggggtactcgcctgattgggcctgctcgatccactcggcgtcaaagccatggtcgatgcagccgccttggctgaccacacaggcgagggagttccggtgggtgtgggcgattttggccgcccagtagccaccggtactaccaccccaatagcccacacccgccgggtcgagttcgggtcgcccggcgatccactccaacacgggggtgaacattcgctcggcgtcctccgaaccagccagcggagcatcaccgaccccggggatgtcgatcgccaatgttgcgacgttccgggcgagcacctgatcggtgtgcatgtcttccttgaaggtgtcgatcccgcccgagacgagcaatacaggcagccggtccgtcgccttcgggacacgcagatgggcgatgatgcggtcaccctccccgggccgcccggcgaacgggatctcgacacgctcgatggggatgtcgaagtaccgggatgcgcgcagcaacatttcctgcgacttgcggtaggcgctcttcttaccggccgaattcatcgtcgggtagcgggccatgcggtagtagccataggcgcgcaaatagttttcgtgtgccacactggtgtcgccaatctgttcggcctcttcggctcgggcctgatagcgtgcggccacggcactgaacgcggccgcccaggcgtcgcgatcataggagttcaggccgctcaacacgccctgcacatcatcggcgagcgtgtactgaaacggataaattcccgccgtggccgagaccgccatagcggccatagctcggtcaccggtcgcgtgtgtcgcttcacacggccaagttatgaccgctcgcggctgcagatattggagaaaacggacatctcacgcgtgccgtgggcgagccgcaccgggaagttctgtgggagccgctccagccagtgccaggcattcgctgatcaggtgggactgatcggcgtaacccgcctcgatcgctagatcggcccaccggattcggtgatcaccggcatggatcaaatccagcagccgctggaaccggaaaatccggccaagccgcttggggccgaagccgaccgcggcgtcgaaccgacggcgaagctgccgctcgctcaacccaacagaggaggcgacatccgaaacagagcgggccgggtggacacgcagcatctcgattgagtgcgccactggctgatcgaccacgggatcgatcttgaccacataccgcgccagcaccgccgccaataatgcgacccgttgccgaaaagcgttggcctccagcacatcctcagccaatccggacgcggatgtcccgaacaccgagtcaacccggatctgggtatctcttaactcgctgacaggatggcccagcaccgcggcggcagcacccggtcgtaaccgcagaccgatcatcgcaccttcggtgcccgcacattggtcgtaaaaggttgtggccggaccagaaaccatgactgcgccctcggcggtgacgaacagatcgacgcaaccgtccggcatcacccgcagcgccccacccgcggtattcgagcgcacccagccacagtccacatacggcgcgagcgcacccaaaggtcgacactccaaatacccgaccatcacgctcacattcagccaggtcctacgtcgctccgcaacaaattgggccgcaatccttcgaagccgcccggtcagcgcagactcccaggcggcaatactcgtgaaccgtaaactgcggcgtagaggaaatgcccgccagggcgcaacacccgcgccacttcggcgagaaagcgtgacagggaggttgtgccccgtgaagtggtgtaaagccgatcggcgtttcgcctgaggctctgcgagtttccactatgccgtgatggcggcggggacggcaacggattggtcggctgaatcggagcggggatgtaatagggccagggtggtctcggagagatagcgcttttcggcgacttgccattcgtcgtgggcttcgacgagaacggagccggccagccgtagcagcgcggcggggttggggaagacgccgacgacgtcggtgcggcgtttgatctccttgttgagtcgttcgagggggttggtgctccagatctttttccagtgcaggacagggaaatcggcgaatgcggtgatgtcgtcggcggcctcgcgcagcatcgtttcgaccttgggcagttggcggccgagcatgccggcgatggtgtcgagttgctctcgcacatgttcggcgtcgggttgggcgaagatggtgcggatcgctgcggcgaccatctcggctgatcccttgggcacctgggcgagcacgttgcgcaggaagtgcacccggcatcgttgccaagatgcgccgatgaggatggcctcgatggcgctgcgcaacccggtgtgggcatcagagatcaccagctgcaccccggacaggccgcgggttttcagtgagcgcagaaacgccgtccaaaacgcgccgtcctcggagtcaccgacgtcgaagccgagcacttcacggcgtccgtcagccgcgacaccggtggcgatgacgaccgcttgggagaccacccgatggttgacccgagccttgcagtaagtggcgtcgaggaacacatacgggaagtgctgttcggatagaggccggtcccgaaaggcgcctacctcggtgtccagatcggcgcaaatccgggagacctcgcttttggagatgccggcgtccgcgccgagggctttgaccaaatcgtcgactttgcgggtggaggtgccgtgcaaataggcctccatcaccaccgcgaacaagcactgatcgacccggcggcgccgctccagcagcgccgggaagaacgagcccgaccgaagcttgggaatccgcaactccaaatcgccagcgatcgtcgacagtgtgcgcggccgagacccgttgcgctggttggttcgtgatgcgctccgttcatgcggaccggcgccgatcaccgccgtcagctccgcatcgatgagtgcctgataaatcgtctcggcggcctgcttgatccgatcagcggcatcggcattgcgtaatgcgtccagcacctccagcaaggcagactggtccagggccatcgcgatgttcctctcggtagtgatccttggtcgtttcaccacagagactcacgcgatggccctctacatcagtaccgacacgccgccactatttacaccacgccccggcacgttccctgacagggaagtgtagttggccgaggattcgatattgagcaccgcatcgaacgactcgtcggggaaggacagattttgggcgtcacctcgcacaaaatcgagtccaggcacgatgtgccgttttcggcagaaggcgataccggcctgatttaagtcgacccccgtgtacgaggcgggccgcatggtgcgcgtgagatatgaggccccgccgccgttgccgcagccaacttccagcacccgcctgccgctgagatccgcctgagccgccgtgcggtggtagagctggatgcagtaccgattgcgctcgtcggcggcatcgagcggcaaggacatcggcgggtcttcctcgtatcaaattgaggaagacaacgtcatcgcggctgagtcgacgactgagcaacgagtaaccatacttctggtacttctgctgatacctctgttgaaacttctgaccgagcttgaagaggactgggtaacctttcggctgcttggatgctgaaggcattaggcgccacccagcccggcagccaccatccagaccgcctccgcagcaacgacgacggccaggagctgccagcggcggggcagcacccaatcgtgtattcgctgcatgaccgcttgggtttgcgccggtgacgccgagtagctgacgagggggatctctatgaccaaaagcattacgactgtgaacatgacagcggcgctgaactgcacgccgacggagttgcccgacgccgcgatggccgcgagtgcaatcggatactcgaccgctggaaatccagagccgaggccgagtataaacgccacagacaggccgtcgctggtcagtacatccctgatgcggccgcgaagccgcgccaacgtgctcggcgtgttcggccgcggcagcccggcgcgacgatcgacgctggcactcgttacccgtgtcggccggaccgaagagctgacggcgaccaatgccgtgatcgcgagaatgaccagaccgattgcgatttgagtgtgtctggcatcaggagttgcggacagggcggacacggattgcatcaacgtcggtgcgaaagagtgcaccaccgtcagaacacccacccctgcggtgatcgccgttgccatggcgccaagccaaaacgcgagcaggttgagcacgggtcgtgaccgcgaaatcaagagaagagcgatgcccagacgcaccgggttggtcgccgcgattagcgccatcgcgataacggtatccatcggctatgtcgtctccccgcgagcggcattctccagaagatcggcggccaccgctgcgctatcggaggatttcgtcatccttttggctacttcgcgggcccgagtcatgtagtgaggcctgaggatcgagcgcaggcacgtggccagcgattcctccgttgtcttcgagaaacgttgactagaaccgactttcatctgcttgacggcagctccccagagcggctgctcgttcctcatccaaaggaccaacgtggggactccggctcgcatgcccgcggcggtggtaccggcgccgccgtggtggacgacagcgcgacaggcgggaaaaatggccgcgtggttcatcgccgccacgatcttgacgtggccggagcgcgggacgtgggttaagtcattggtgcctgcgcaaatcaacgctcgctcatccagtcgcgtgcaggccgcgctgatcattgcgacggtgtcggctggtgatttgaccggtaggctcccgaagccgaaatagacgggcggtgatccggcggcaatccacgacaagacttcggcatcggcgtccgtcggtaaccccagcgtcagcgcgccgacgaagggccgttgaccatcccagtgcgcccattcggctgctagcccgggaaagagaaaatcctcgtatgcctggatctccagagacttacgccccacgatgcggcgcgtcgaggaaccgctcgccttcgacagacccaatcgccggcgctggctctcctcggccttgttcgtcacgcaccagtacccgcaccagaaggccgaaaccgctaagcggctcaacggcgacggaacgttcgggagaagccggccgttgacccgggccggcagacaatgcaacgtggcgagcgggatgtcgcagtattcggcgacattggcagcaagtccctgctgcgccacggcagtcaacaatagatcggccccgttcgccagtgatgtcagcgtctcccccatctccagccagattcggccgaagtactccttcgatgtggacagcagtttgatcggattcgtcttcttaccaaacagcacgtcccgcgtgtccggcccatagtcgatcgcggtaacaccggccgactcgacgaagccacgcaggtcgggcggggctgcaacacaaacttcgtgtccccgacgcaacagctctcgggcgattgcggcatggggctcgacatcgccgcgagagccgtagacggccaaagcgaatttcatctgcgggtccttggcatcagccgaaaggctgtgccactcgttgcatggggtgcgaccaattggaaccggcccattcgttgcgtgcctcacgtcgagaacccaactgcggatgcatcgcagcgtggttgaggtgagactccaccgggtcgccgccatctacgacacgggcgtacaccgatttcatcactgccaggtagcgggtcacggattggcgggcgatcggattgttcgggaacaacacgatcacttgggtttcgctctcaagccgatttacccggatggcgacctgagacggaatcctgccgtcgtggtagagcctggcattcgcaccgtccaagtgcgaattgacgagagcggataggggaggcacgccggcgtcgaggaaaaacagcaaaggagcaccccgctgaggcatccgcagccacggcgccatctccacgacgcgctcggcgggaacgttcgcaaggtctttgttcgaatcgaaggacgcctgtgcggtgcggacgatgtcgctgaaggaaccggcgacagagacggtgagcggcacaaagccgacaaaccaacccgttgtcgcaagttcgtcctgagagcgacgaatgtcgacgggaatgactccgtaatacgtttcggtgccggtcaattcgtgttctacgagagcggcgcaggcaaacacaccgccactgaatcgcgcgcccgccgccaggcaaacggattcgaaccgggcagtctgtcgctcgtcgagcaattgcacgctcaacatgtcgcaggggaccggcccatcaccgagcggcagagggaatgccggcagggtgccgttgttgtcttcgaagaattcgacccagccgcgcacttccggggactccaaggtcagtgcgtccaactcgcgatgttgtcggacgcagtagtcgtcgtagctgcctgccgtcgccagcgtgagcggcgctctgcccgccaccaaagcgcggtacatcaagtggatctccgcgaatcccacgccgacaaacatcgcgtcgatgtggagatgatcaacgcacaagcagatcgtgaagtggtccgcgcgctgaatcacgatgaagcggaaagaatcccagcacagcggattcggtgtatccaggacaaggtcccgtacttcgtccgaagtcatctcaccgtgctcgatcggggtgaacttgatactggcggggtcgtcgattgtccgccgggcgatgcgccccccgtcctcgacctcgaaccaactgtggtaggtgtcgtgacggcgtaggtgcgcgttgatgacgtgcgtcatgacacggatatcgcaacggccgggtatgtcccagcctgcagtcagcagacgtgacatatcgatgccgcgagctgcattttcgcggaagcgacggaggtgctgagcctgctgatagctcgcgggtaccgcgctgttcggcgcgtgtcgggccttatcgagcgacgccggcgacgcctgccaactgacgacggaacccgcagcgggcaaccactcgtgaatcggtcccacttctactttccctacgagaaccacgattcctcccctacgcagcggcggctgcggctattggcggatggtgcgatgtcattcggcccggacttgtgatgttggtgcggcctctgccagcgtgtcgcagaggtgggcggcgagacctcgaacggtcgtgatggcggtcgacttgatccgcacccctgcttcggcctcgatccgcgtacgtagttcgagattgcccagcgagtcgaggccgtactccgagagtggacggtcgggatcaacggtgcgacgcaggatcaagctcacctgctcggagaccagacgccggagccgggtgggccactgatcgtggggtaatgtattcagctcggcaaggaatctggttgtgcccgttgggcttttccccgtggatcggaatgcttcagcgaaccgactgcgctccgcaaacgcgctcaaccatgccgtatcgatcacgggtgcgtagccggtgtatgcgcggtcgtgacacagcagcgcctggaacgcgtaagcgccctcgtcgggagtgatggcggtgcctacgtcttccgcgaagcccgttgcgcgtccgagctctgaccaggcaccccacgcgatcgcggtcgcgggaaggccctgggcgcgccgccagtgggtgaatgcatcgagccagctattcgccgcggcgtaggcgccttgtcccggggaccccaccagcgcggctgccgacgagaacaagcagaaccagtccaggggctcacccgccgtgacgcggtgcaggttccaggcgcccaccaccttgggcgcccagcagcgctccagcagttcgccggtgatgccgcccagcgcgctgtcttcgaccaccccggcggcgtggagcacgccgcgtaccggcagcccggtggtcgtggcggccgccaccaaccgctctgccgtgcccggctgggtgatatcggcgcactccacgacgacgtccgatccgatcgcccggactaattcgatcatctcctggactcgctgattcggctcggagcgcgagctgagcacgatgcggccacaacccgccgcggcgagtttctcggcgaggaacagcccgatgccgcccaggccgcccgtgatgatgtaggaaccgtcgggccggaatacccgaccgctgtccgggtgcaggaccgcgctacttttcccgctacgggcaacgtcgaggacaagcttgccggtgtgttcggcggcgctcatcacccggatggcggtggccgcatcggtcagcgggtaatgcgtgcttgcgggcatcggcagtaggccgtctgcgacgcgttcgtacgccgtgtccagcaattcccgcactcgcaacggatggtcgaccgacatcagacccaggtcgacgccgtaaaacgccaggttgcgacggaacgggaacagccccagcttggtgtcgccgtagatgtcgcgtttgccgatctcgatgaaccgtccaccgggcgccagcagcttcagtccggcgagctgtgcggcgccggtcaaggagttgagcacgacatcgacgccgtacccgtcggtatcgcggcggatctgctcggcgaactcaacgctgcgagaatcgtagacatgctcaatagctttgtcgtgcaacattttcctgcgctgggaactgcctgcagtggcgaagatttccgctcccgcagcgcgggcaatcgcaatcgcggcctgtccgacaccgccggtcgcagagtggatcaacaccttgtcgccggctttgacccgagccaggtcgtggaggccgtaccacgcggtggcgtgcgcggtcgtcactgccgccgcctgcgcgtcggtcagccccggcggcagcgtcacggccacgttggcgtcacaggtgacgaacgtgccccagcagccgttgggacagaggccgccgacatggtcaccgatcttgtgctcgatgacatcgggcccgaccgcggtcaccatgcccgcgaagtcggtgcccagctgcggcaaccgcccctcgaaggaggggtgccggccgaaggcgagcaggacatcggcgaagttaatgctggacgcggtgactgcaacctcgatttgccctgggccaggcgggattcgttcgcatgcaacgagttccattgtctggagatcgcccggggcccggatgtgcaggcgcatgccatcgtgctcgtgatcgacgacggctgttctccgttcgtccgggcgtaacgggctcagccgcaaccgcgccgtcagccactcatcattccgccaggccgtttcgtcttcttccgacccactcaccagctgccgcgcgatcaggctggcgcccgtgtgcatgtcggtgtcgatctgggtggtacgaaattgcggatattcgttcccgatcacccgtagcaggccgcgcaggccgccttgctcgagattggcgccgtcgccctccagcaccgtctgagcgttcctggtgacgacgtatagtcgcggtggctcgccgggtgcggccgccaactcgcggacgatgtgcgccacatgacggacgtactcgccgccacgggcggcgcactcgtcgtcccgatcgccatccttcgggccggtgagcaggaccacgcccgtgaaccggccgacgcgcagctgatcccgcagcgtcttgccattggcaacagggtcggcgcgcgacgaccagcggatgctcgtgcaatccgcacctagcagttttaacgagtcggtcaactcggtggccgcgacatccgccatcgcagaggtgctgaccagcagccatgtgccagcgtcgacgggatccacctcggtcagctcttgccgatgccattcgacggtcaacagtcgctcgttcagcgcgcgatcgcggctcgcttcctcggaggccccagtgcccatttgcagtccctggatgctcagcagaacggctccatgctcgttcagcacgtcgagatcggcctcgaaccccgtcgcagtggtactggttacccgggtgtagcagtaatgagcggtccgggcggacgcgtaggcgcggatgcggcgcacacccagcggcaggagcaaactgccgccgccggaattctggatctcggacgccgccccaaccgactggaaacacgcatccaagagcgcggggtgaatccgataggcacgctgctgcgaacgcatagccccaggcaacgcgacctcggccaagactgtgtcccccgaggtgtgcgccgccgtcagtccggtgaacgcggggccgtattgcacaccacgttcggcgaaccggttccgcaactcggcgccgtcgacgctggatgaacgagccgcaagtagagcgggaacgtcgtacgcgggcggtcgctcgccaggccccgctgcggccaggatcgcggtggcccgccgaacccgttcgccctcttcgaaggtctccaccacgaactcggcggcgctccgcgaggccatgactgccagcgcgaacaccggggtctcatcctcgatcagcaacatctggtcgaagcggaggtcgcgtacttcggacgcgtccccaagtgcggtgtgcgccgcagtcagagctatctcgcagtaggccgctgctggaagagctgccacttcgtgtatccggtgatcggccagccagcgcagcgtcgcggttccgacctcggcctgccacgcgtggcgctccggctcctcgggcaggcgcacatgggagcccaacagcggatgcacggcgacggttggtccagcctgcggctgggtgtcccggctgtcgaggccgaggagcaggtgacggtgcgtccatgccggcagcggtacatccagcaggcgaccgtcggggtacaacatcgagaaatccacggcggcaccgacgctgtgcacctcggccagcagatcgcgcatcccgtgcggcagtgcctgttcgcgccgcatcgcggccagagcggcggccggcgtatcgaggctggcggcggtttgctcgatggcgtaggtcagcagtgggtgtggcgagagctcgacgaacacgcgatgcccatcttccagcgccgcctgcaccgcggcgccgaaccgcacggtgtgacgcagattgtccagccaataatcggcatcgcagagcggctgctcgcgtgggtcgaacaggctggcagaatagaacggcacctcgggcgccgtgggctcgagttcgaccagggcgtcggcgagttcgtcgaggatcggatcgacctgcggagagtgcgaggcgacgtcgacggcgatctcgcgggcgagcacgtcgcgctcctcccacgcggcgaccagctcccggaccgtcgatgtcacgccgcctatcacggtggacgtcggtgaggccatcaccgagaccacgacgtcgtcgattcctcgggccatcagctccgaaagcacttgctgtgcaggcaattccaccgaggccatcgcgccggcgccggcgatgcgcgacatcagccgggaacggcgacaaatgacacgcaccccgtcctgaagcgacaaggctcccgcgacgaccgcggccgcggtctcgccgagcgaatgcccgatgaccgcaccgggccggacgccgtaggacttcatcgtggccgccagagcgacctgcatggcgaagatggtcggttgcaccttgtcgatgccagtgagggtgtgtggcgccgacatcgcctcggtcaccgagaacccagattcgcgcgctatcagcggctcgacttctgccacggtggttgcaaagaccggttcgttcgccagcagctcagcacccatctgcgtccattgcgagccctgcccggagaacacccacaccgggccgcagtcgtcacgtccgaacgcagccagataggaagtccggctgtcggcgacctcatgcagacccgcggccagctcgtcgacactgccggcgatgaccgcggtgcgcacgggacgatgggcacgccgccgcgccagcgtataggcgagatccgacagctcgacagaggccgcacgctctttcacccagcccgccaggcgcttagccgtttcccgcagcccctcatcggagcttgatgacacggtgaacaacagtggacccgctggtgtgggtttgacgcctccgcttgcattgggggcttgctcaacgatggcgtgggcgttggttcccgacacgccgtaggacgacaccgccgcccgccggggctgctggagcttgcggggccatggcgtgttgtcctgtggcacaaagaggttggtgttgagttggcctattttatcgggcaggcgagtaaagtgcagattttgcgggaccacaccatgttgaagagccaggaccgccttgaccaaacccaacgtgcccgcggcggactgggtatggccaaagttggtcttcaccgatgtgagcgcgcaggggccgtcttggccgtaaagctcagccagactggcgtattcgatcgggtcacccacgggagtaccggtaccgtgcgcctcgaccatggcgacagtgcctgcgtccacacccgctgcggccagcgccgaccggtagaccgcggtctgcgctgtcagcgacggtgtcgcgaggctcagcgtgcggccatcttggttggcggccgtcccgcggaccaccgccagaatgcggtcaccgtcgcgcagcgcatcggggagccgcttgagcagcaccatggcacaaccctcggacgaaacgaatccatccgccgcggcgtcgaaggcgcgacagcgaccggtcgcggacaacattccctgcgccgaacctgcggcgagtttccggggttccagcagtaccgtggcaccgcccgccagcgcgaggtcgctttcaccgtggtgcaggctgcggcacgccacatgcaccgagaccagcccggacgagcatgcggtatcgaccgtcaacgccggtccgtgcagacccagcgtgtgcgcgatccgcccggacgccacagcgaaactgttgcccatgaacccgtacggctgatccagcgcgccggcatcggctgtccgcagtgtgtggtcgtcgtgcatcaacccgacgaacacaccggtcctcgagccggtcaaggcggccggattaatgcccgcatgttcgagggcctcccacgacgtctccagcagcaagcggtgttgcggatctatcgcggttgcctcgcgctcgctgatgccgaaaaagtcggcatcgaagcccccaacatcgtcgaggaacgcaccccaccggcacaccgaacggccgggcaaacccggctccggatcgtagtgctcatcggcatcccaacggtcaagcggaatctcggtgacgaagtcgtcaccgcgcaacaacgccgcccacaacgcgtcgggggaatcgatcgctccgggcagccgacaggccataccgatgacagcaaccggggtcgcgctttcgtccatcgtcgttcctcgtctgagcgggtgcgtcacctatctggtgtctccccgctcccgatcaccggctcgtcggatgcagtactggatggccgggggtgtctccagagtcctgatgcgccttcaacgccatccgatatgttgagtgcgggtggagctttccgcaggtcagcggcctcgcagaagcttactgaaaatgattgttattatcaaccaagtgcgagactggcggtctcagtgcggagatggaccgcttgcggagctgtttgcggaggcccatgtcagggcatcgctgcgcacggatcccacgaccagttgttaacgaaaatcgttttcagtaaacttgcatgaaatcagccccaatttcgaaaacgaggagctttcgtgatggctttgcggctcctgcttgaaggccttgccaccgcggcgtcgtacacgttggcgggcggtcggcgatgacggcgccgatctggatggcttccccgccagaagtgcactcggcgctgctgagcagcggtccggggccgggctccttgctggcggcggcgggggcgtggaactcgttgagtgccgaatacgcttcgacggccgaggaactcagcgccgtccttgcgtcggcccaggccggcgcgtggggggggccgagcgcggaatcgtacgtagccgcgcatgccccgtacctggcgtggttaacacaggccagtgcgaacagcgcggaaatggccgccagccatgaggtgatggcgacggcatacacagcggcgttggctgcaatgccgaccctgcccgaactcgccaccaaccacgtcgtccacggagtgctgctgtcgacgaatttctttggaatcaatacgattccaatcgcggtcaacgaggccgactatgcgcggatgtggacccaggcggccgccacgatgtccacctatcaagcagtctccaccgcggccgtcgccgcgacaccgccaaccgatccagcgccaccgatcgtgaaatccgctgcgttaagcgatgattcagatgactcgggtgacgtcgatcatgaccccaaaatcgacaattggctggacgaactcattgcaaggttcctgaagcaactgggcataaactgggatcccgcccagggcaccgtcaacggattggactacgacgcctacacgaacgccagtcagccaattttctgggtggttcgggccctggagctgctcgaggacttccagcagttcggttactacctggtgcacaatcccgcgctggctttccagtatctggtgcaactcgcgctgttcgactggccgacgcacatcctcgagattctgaccaccgcgccgcagctgttggcccccgcgctcctcctcgcggttgcccccttcggcgccatcggcggattcgccgggctggctggcctggccgccataccccaccccgcggtcgtcccggcgacggtcgcggcaccgccgccggcgcccacgccgagcatccctccggccatcgccatggccccgactcccgtcgcgccggccgcggctccggcgtcggcccccgcgccggcgcccgccaccacggcgacgaccgtggcaccggctccggcggcgcccgcacccgtcgcggccggagcggggttcttccctccctacgtggtcggccctcccggcatagggactggatcggggatggctgccagcgcaagctccagtgcgaaaaggaaggcacccgaacccgatagcgctgcggcggccgccgcagcgtcggcgcgcgaggctgcgcgagcgcgacggcgccagcggcagcggcaacgcggatttggtgatgagtatatggatatgaacgtcgatgtcgatccggattggggcgggccgcaccctggccgcgagtcggtggcgtcggatcagggagcccgcaatgtcggatttgccggtacggcgcgtaggaacgcggccgcggccgcgggcggattgaccacgctggccgatgatgagttcggcggcgcgccaaagatcccgatgatgccgggtacgtgggacccggtcggtgacggcgagcgcagggaacagggcgacggccgcgaccactaacacctggaatctgtgcgcgctgaaataatgtgccggtggcgactctgaagcccgggcgcaggcccgggtcgatggaactgctggtgggcatcctgttggcctgcgctttggcagcgacaaccctgcgcaatgcggtcatcaacagtgcggcattgtcgacggtgggcaccgtgttctgcggcgttttcgtgcaggcgattccgttcctggtgcttggcgtggtggtcagcggactgatcgcggtattcgtgtcgccggagcggttggcgcgctggttgccacgtcgcgcgtccatggccgtactggccgccggcattggcggggcggcgctgccgggctgcgagtgcggttcagttccgttggcgcggcgcctgtttggggaaggcgctgcgactggagccgcggcgttgacgttcatgctggccgcgccggcgatcaacccggtcgtcctggtggcgaccgcggtggcgtttccgggagcgccgagaatggttttcgcccgaatgatagcgtcgttgctgaccgcggttgtgatgggctgggtatggtcgcgctggggccgtgcggaatggatcacccgccgtctgcccgctgcggggactgcaaccgaatcgcgatggacgaccttcaccgaagcagcccgccacgatttcttgcaagccgcatcgtatttggtgttgggtgccatcgccgcggccctgcttcatgtgatggtgccccagtgggcgttcgcgcatctggccgacaatccggtcctggcggtcgcgctgatggccgctttggccgtggtgctggcgttgtgttcggaggcggacgcgttcgtcgcagccagcatgacgatggtgcctttgctcccaaggctggtgtttcttgttgtcggtcccgccgtcgatgtgaagttgttcgccatgcaggcgggcatgttcggccgggcgttcgcggcacgctttgcgccgtgcaccttcgcggtggcaacggcaagtgccggtgcgatcggactattcgtattgggccctggttgatgagccgggaagccgaaaacacggtgttgctgttggtgggcatcagcatcatgatgatcaccgtgtcgggcatgttcacccgctacgtcaagcccggactgttgccgtggctggccgcatccgcgatcgcgctcatcgccttagcgctgatggcgatcatcggtgacatccgacggggtggacctcgagagagtgttgctaccggcgatcatggccacgagcactcccaccaaaccgggaccgtttggttgctggtggtggcagtcctggttctgatgttcgtggcgccaccggcgctgcggccttcggccgccgcgccttccgtgacatcggtatccaatgatgttctgaacagagcctttccaccgctacccccggggcgatctccggaggtttcgctgccggaggtgctgatgcgcgaggcacatgacacgaccggggcgttgacgaaccggtcgatcagcgtgaccggctttgtgctcaacgaggcgcggggcgtcgacctcggtcgcgtcgtgatcgtctgttgtgcggccgacgcgcagctggctcgcatccacctgggtggtccggccgcagcagctgcggccggcctaccggacaacacctggcttcgggtcgaggggcacgtcacgtctgcaccgcgacaaccgaattcggcgccgattccgacactgcaggctaccgtagtgtcacgcatcgacgccccgcccaacccgtacgcgtacccgcactgagggcccacgcatatgcgactggacggttacgtcaattgacccaccgggaaggagggcaaatgccggatgctggaacgcaactcattgatcactaaggggacctggtctccacaggccgcattacggcttgatgccttgccccggatatggaagaagcgccatttcgcgggcgttcttgatcgccgtcgcgacctgtcgttgttgctggacggacaggccggtgacctgacgggaacggatcttgccgcgttcggagatgaacacccgcagcgtcgcggtgtccttgtagtccacggtgcgcaacccgaggctgtcgagaagattcttcttacgcgcccggccggccaaaggagccggcctgcgcgtccgcgcaggtttcttgggcattaccagctcgccttccgcacgcccgggagctgtccggcgtgtgccagttcgcggacccggaccctcgacaacccgaatttgcggaggtggccgcgtggtcgcccgtcgacggcgtcgcggttgcgcacccgcaccgcgctggcgtcccggggctggtgtgccagctcgttttgcgccgccgttcgttgctcgggggtgctccgcggcgagcggatgatctctttgagctcagcgcggcgttcggcgtagcgcgcgacggtcgcacgccggcggtcgtttttgacgatcttggatttcttggccatgttcagcgctcctcccggaactcgacgtggcggcggatgaccgggtcgtatttgcgcaacactaagcggtcggggtcgttgcgccggttctttcgcgtgatgtaggtgtagccggtgcctgcggtggagcggagtttcaccaggggccggatctcgttgcgtgccatctagattcgctgtccttgttggcgtaaccgtgccacgacggcctcgatgccgtcccggtcgatcactttgattcctttcgcactgactcggagccgaatgcgccggccttccgaaggcaggtagtacgccttgagttggatatttggtgaccaccgtcgacgggtccggcgatgggaatgcgagacggcgttaccgaaacccggggttcggccggtcacctgacagtgggcggacactgcgcacctccacaacaacgcttattgaaaatgattttcgacaagattcgtcgtagacggtaccgtacgaagagtcgagatgaaaatgattcccaataaggagcctgatgcggacgcccgtcatcctggtcgccggccagaaggacaccgatccggtcgtgggtgcactgctgcgcatgccggggacgctggtcgtcgagcaccgtatggagggtcatgtggtgcttcgaacgacggtgatgctgcagcatggcgtgttgacgaccgccgaaagtgcgctcgaattggcgcacggatgcgtgtcgtgcaccatccgtaatgatctgctggtcctgttgcggcaactgcatcgtcgagccgaggtcgaacggatcgtggtgcacttggcgccgtggctggagcccgaaccgatctgcgtggcgatcagtcatgtccgggtgcgcgtggcagcggggtatgtcgacgggcctgcagccctggacgtctcgatcgccgcggtggtgacctgtgtcgattcgtcggtgtgggtgagccaggcgttgggtgacgaggaactcgacgacggacgcacccaggcgcaagtcgttgtcggacaggccgagttcgccgacgtgctcgtgctcaaccgcgccgaccccttcacggccgccgcgctgcgccgcctggcgccgcgcgcgcgtattcaagtgggtgccaatggcatcggggatacgctgaacaatctttatcgcgacgcgcggcaggggcgaagcgacgatccacacgatccgctgctgtccggacagccgcccctgaattcccgggggccgatcaacctcgttgagttccatgcccgacgtcccttccacccgcgccgtttgcacgagtgcctggatgtggtgctcgacggcgtcatccgcacgcgggggcggctctggcttgccagccgacccagccacgcgatgtggctggaatcggccggcgcaggactgcgggtcagctcggccggcaagtggctcgctgccctcgcgccgtccgagctggcccatatcgatccgggacgacgtgccttcgccgagctggaatgggacgccgaccatggggaccggcacaccgctatgaccatcctggtgtgcggtgcgaacgccagcgacattcttgacgctctcaacggcgcacttctcactgaccgcgagttcgcctctcgcccctgggttttcgacgacgatccatttggggactggcacgaagacccttgtggtgatcccgcgcaagggacagaggagaatacgcccgcccattacagcaccgacggagaccactgatgaaatctggcattcaccccgactaccatcccgttgtcttccaggacgccaccaccggcgcgacgtttttgactcggtcgaccatcaccagttcgcgcaccatcgagtgggagacgccgcacggagtgcgcacctatcccctcgttgtcgtcgagatcacttccgactcacatccgttctggacgggcagccgacgcatcgtcgacactgccgggcaggtagagaaattccaccgccgctacggcagccgtcgacaaaccaaccaccgtgacgacgcggctcactcaccctgacgagctctaatcctgtgccggtgagttcagtaacgcgtcccagtgaacgacggcctcccccgcggcaggagcggcgtcgccggtgaccagtccgagcaaggcgcgggatacccctcccagtccgatcccgctggcgtgcacaacgccagtgatcacccccagcgcctgctctgccgagcagcgtcggagacccatgacgacactgatcgcctggtcgatttcgcgtcgcgatcggtggtcggcgggccggtagttgggcgtgtggatcatggtgactccgaggtaatcgaattcgttcgacgtttagtgggcgtgaacgacgtcccacggtggcaacgggtcggggtagccgacccaccgctgaggaccttgggccagttcggtgtcggtcagcagcgccgcctgcatgaggtcgagcacccggctgtggtcgaggttgaccccgatgaacacgatctcttggccggcgggaaagtcggcggttgaccagtactgggcgggttctatcaccaggttgggcccggcttgggaccagatggccgcaatgtccggtcggctggcaatccagcagaagcctttgctgcgcaacactccctgcagctggcccagcgctacgtgtaatcgctgcgggtgcagagggcgcgcggcgcggaaagtcacactgctgatgccgtattcctcggtctcgggtgagtgcccgttggcgagttcctccgcccagccggctgattcggccgcaaggtggggatcgaatagaccggtgtccaggacctctgacagcgctacccggccgtggtcggtggggacgatcttcgccgccggattaaggcgccgaagtactgccgccaccgttgcgttggttttctcactcaccagatcggtcttgttgagcagaatcacgtcggcgaactccacttgatcgacaagtaggtcggcaatcgtgcggacgtcgccgtccccggcggctaggtggcgggcagccagggcttcgccgcgcgcaagctcgcgcagaaacgtcgacgcgtcgaccacggtcaccatggtgtcgagtcgcgcgatccgactgaggctgaatccgttctcgaattcccaactgaagctggcagcaaccggcatcggttcggagatacctgtcgactcgatcagcaggtaatcgaaacgcccggcggatgccaagcgggcgaccgattcgatgagatcttcacgcaaagtgcagcagatgcatccgttggtcagttcgaccagtttctcttcggtgcggtccaggaaacccgtcccggccaccagcgccgcgtcgatgttcacttcgctcatgtcgttgacgatgaccgcgacgcggcggccttcctggttagccaggacgtggttgagcagggtggtcttgcctgctcccaggaacccggataggacggtgacggggaggggcgtagaactctgtggcggcataagcgttaatgataatcattttcattaacgctcgcaaagctcctaacgccgagtcctcacggttgtgtgttttggcaaagcggacatgtgccgtaaaggtcgacgtagtgagtgacgtcggcgtagtgatgttggcggcttagccggcgggtgtgttcttcgatgtcgacgggtgtaaaggcgacggctctgccgcactgccggcacagcaggtagtgacgatggcccgcctcggtgcggaggcggtagaggatctcgccgtcctccgcgcgctgagtctcggcgatccggtcggcagccagtgcgcgcaagatgcggtaaacactggtcaggccgatcctgagctgttggttctggcgaatgtcctgataaagctgctgggcgcttcgaaagttctcttgcgctcgcagcacctctaagacggtccgctgcttgactgtcgcgcgtcgccgtcggggcgcagcgggcgatgacaccggtgatactccttttcgaactggatccgaggtgtttactcgtcacttccgcgttgtcgcggtgggctcggtggacgacataagcgcgggaggggcgttcgttgcctcgtccactgctttggcgatgactcggtgccggtgattgctggcccagacggccgaccagatgccgcaggcgaggaccacgatggggaaactcggcggcaggttgaacatggcggatgcgcccagtccgagaagtacggagctcagaccgattgccgtggagacgagcatcgccatcgacggacggggggtcagcatgatcgcggtcgcggctggtgtgacgactaaggcgaacagcagaagtgttccgaccgcttggacggccatggtgacggtgagtcccaggagtgccatgaagatcatggcaagggcacgcacgggcacgcctttcgcctcggcgactaccggattgaccgaggcaaacagcagtggtcggtagatgatgccgacgattaacgccagcacggccagcaggatcgcgaaaccggctagctggtcgcgggatatcgcgagcaggttgccgaacagtacgttcgtcatggtgccggagctcttggtggccaaggaattgaagaacaatcccaggcctatggccagggccagcaccgtaccggtgaccacttcccggtccgctgcccgcttgccgagcacaccgatcgctagtgccccgccgacgcagaagacgcccagcccggcggccacgggtacacccaacaagacggcgccggtcgcgccgggcagtccgatgtgagccagcgcatgggcggcgaaggcgctttggcgtatgacgacgaagtagccgaccagcccggcggccagcgcgacgattgtgccgccgatcaaggcgttggtcataaagcccgatgtcaggatggaccaccagtgtggttcgtactgcagggcgagaacgcggacggtcacagtgcgcttctcatgtacagcgctccgtcgcgggcccggtgaacatggatgggggtgccgtagaggcgcgtcaacagcgtgtcgtccatgatgtcgccgacgggcacatagcgtggccggccgtcaagcatgtagatgacgctgtcgaggatcggtagcagcgggttgagatcgtgagcgaccaccaggatggtcacggcgagttcggcgtgcagccgggccaataaggcgacgatgtcacgctggctacgaagatccaaggaggccagcggttcatcgaggatcagcaattgaggtcgtgccaccagcgcaacggcgatcgcgatgcgttggcgttgcccgccggacagggtggaaagccgccggcagcccaagtcggtcgcctcgacagcggccaaggcctcagcgactctggtctgctgggatgtggtgctccgcccgaatgcccatcgccggccggtgagtccgagcagcaccgcatcggcggcgcgtatcgcctcgcctgagctgtcggcgtaatgctgcggaatgtagccaatgttgtcgttggcctgaccggggcgtcggccaaagatctcgagtcggccggttgccgaagggatcaggccaaggaccatgttcagtagggtcgttttgccggccccattggagccgatgacggcgacaatgccgccggcgggaatatcgaacgtggcatgcgaccagatcagacgtccgccgcgcacggcactcacatcggtgaaagccaaggcggagggaggggcggcgacgtcagacagcgacatggagcgccttggccagttggacgagctgcccgtactgccagtcttcaaacgacgtctccccgggcggtacggtctcggttatcttgacgacgggcacgcttgactgctccgcggctgatcggatttcctcggggattgagccctcggtctgcgtgttgtagatcaagaggtcgatatgccggccggcaagggcggtgaggaacgcgtcaacgtctccgggtgagggttccgattcgttggccgatgcccgccggtacccggcaggggtcttgttgaccaggcccgccgcttgcgcctggtagtcaaagaccgtctctgtggccccataggatttacccgccgcctcggccttgatcttggcgatcaggttcacgtatagccttgtcgcactggtgaattgcgctctccgctggctgaagtagccggcggcaggcggttccattctgctcaattcttgcgttaccgcatcagcaacggcggtcaccgcggagggcaggtaccacaggtgagggttggctccatccggtgttgtcgtgactgccgcggcgctcaccaagggggcaccggaagcggagctgccggccagcttggatgcccacgagtcgtaccctgcaccgttgaccacgataagtttcgcgttcataaagtcagcggcgtcggccggtgacggctcgtaatcgtgcgggtcgaccgacgagctggcgagcacggtcttgacgttcgcgcaggcgccgcccagctcggagacaatgtcgccccactgatccacgctgaccacgacagcgagtggggcggtgggacacggcggcgcggccgttctgccaatggctgatggcgaggcggcattacgggacccctcggctgtttgggtcgggcttgacgagcaactcgttacgactgtcagcaccaggacagtagcgataggggcgccgtgccaccgcgagagcaacccacccacaccgcaaacgataaccgttttcatatctaatgcgcgagactttccggaaacgcggtccgcgtcgcggtgcgcgccggcccggttccgcgggaccccggctggcccgcccgagcggcaacatgcgcccaccgtcgccattcgcgttgcgcgccagcggaaaagggctcaccgcccggcggcgtactgtgggcggggtgcgaagcgaaggcgatacctgggacatcactacgagcgtcggttcgaccgcgttgttcgtggccaccgcgcgggcgctggaagcgcaaaagcccgacccgctggccgtggatccgtacgcggagattttctgccgcgccgtcggcggtaccgccgccgacgtcctcgacggtaaggatcccgaccatcagctgaagaccaccgacttcggcgaaaacttcgtcaacttccagggcgcccgtaccaggtacttcgacaactacttcgcccgcacggcgacgcgggcgtgcgtcaggtggtcgtgttggcggcggggctggactcgcgcgcctaccgcctggactggccggccgcgaccacgatcttcgagctcgaccagccgcaggtgctcgacttcaagcgtgaggtgctcgccagggccggcgcccagccgcgcgccgagcgacgcgagatcgccatcgatttgcgcgaggactggccgcaagccctccgcgacagcggcttcgacccggccaaaccctcggcgtggatcgccgagggcctactgatctatctgcccgcgagtgcccaggagcagctgttcaccggtatcgacgggctggccggccacggcagccacgtcgccgtcgaggacggcgccccgatgaagcccgaggacttcgagaccgccgtcgcggaagaacgggccgccaccgcgcagggcgaccagcgcgtgttcttccagctcgtctacaacgagcagtgcgcgcccgccaccgaatggttcggcaaccgcgggtggaccgcggtcggcaccccgctggccgactacctgcgcgaggtcggccgcccggtgcccggcccggagaccgaagccggtccgatgatcgcgcgtaacacgttggtgagcgccgtccgggcctgaggcgtcgcgacaagatcggaggcggaactttttctatccgccagccgactagtggctgcgtgatcgctccaccggcccatcgaggacccgttgccatgaccccggtgcggacggtgtcgtcagtcgcaacccgagttgataatgaaaatgattttcgttaaggttaggccttgctgtgagaccgcccgacgtgcggctgtgagtatcccggaaatgcggcaaaaccgtaggcagaacgtcctcaatagcggtaaaagaagggcagtgcagtggtgagtcggacaggcccaaacgcctcgacagttagcttatgcaatgctaacttcaggcgggtcaggttaggggagactacatacatgaaaagacgcggccgtggaacacggtgacaccggcatgctcacagttcagccggccaattcgcgcgtggacacgcgcgttgacggcgacgtcgtcagccggttcgccacctgctgccgcgcgctgggcatcgtcgtctaccagcgccagcggccggcggacctggccgccgcgcgttcgggtttcgccgcgctgacccgcatcgcccacgaccaatgcgacgcgtggacgggactggcggccgccggagacacgtccctgcgggtgctcgaggcggtgtcgcgcaccgcggcctccgcgggcgtgctgcagcgccaggtcgacctggcacccaactcgctgggcttccgctacgacaccggactgtatctacagttccgcgcgaccactcccgacgacttccaccttgcctacgcggccgcgctcgcgacggcgggacggtttgctgacgccgacgcgatcgtcgccggcctgacggccgagcgaccgaactggcgtgaggcccgctgggtgtccgtcgtcatcaactaccgcgccgagcgctggtcggacgtcgtcaaactgctgaccccgatcgtcaacgacacggacctggacgaggcgttctcgcacgcggccaagatcgcgctcggcaccgcgctggcccggctgggcatgttcgccccggcgctgtcctatctcgaggagcccgaggggccggtcgcggtggcggccgtcgacggcgcgctggccaaagcgctggtgctgcgcgcccacgtcgacgaggactcggcgagcgaagtgctgcaggacctgtacgcggcccaccccgagaacgaacaggtcgaacaggccctgaccgacaccagtttcggcatcgtgaccaccacggcggcgcgcatcgaagcccgcaccgatccgtgggatcccgaaaccgagcccagcgccgaggatttcgtcgaccccgccgcccacgaacgcaaggccgtgctgctgcacgaggccgaacgccagctcgccgagttcatcggcctcgaagaggtcaagaaccaggtgtcgcggctgaaaagctcggtcgccatggagctggtccgcaagcagcgtgggctcgcggtcgcgcagcgcgcccaccacctggtcttcgccggcccgcccggaaccggtaagaccaccatcgcccgcgtggtcgccaagatctattgcggcctggggcttttgaagcgggagaacatccgcgaggtgcaccgcgccgatctcatcggccagcacatcggcgagaccgaggccaagaccaacgcgatcatcgacagcgcgctcgacggcgtgctgttcctcgacgaggcctacgcgctggtcgccaccggcgccaagaacgacttcgggctggtggccatcgacacgctgctggcgcggatggagaacgaccgcgaccgcctggtggtcatcatcgccgggtaccgggccgacctggacaagttcctggacaccaacgagggcttgcgttcccgattcacccgcaacatcgacttcccttcctacgcaccgtcggaactggtcgagatcgcgaacaagatggccgagcagcgcgacagcatcttcgaaaaagccgcgctcgaccacatggaggagttgttcacgaagttggcaaccgagtcgacacccgacgccaacggaatttcgcgacgcaacctggacatcgccggtaacggtcgattcgtccgaaacatcgtcgaacgctccgaagaagaacgagagttccggctcgaccattcggaacacgccggaaccggcgaattcagtgacgaggagctgatgacgatcaccgacgacgacgtcgcaaggtcggttgagccgctgctgcgcggcctcgggctgtcggtgccggcatgacgtccaatcagcaacccgacgaacgccgttcgttctcgtcacgcaccccggtcaacgacaatcccgaccaggtcgagtaccgccgcggcttcgtcacccggcaccaggtcagcggctggcgattcgtgatgcgccggatcgcctccggtatcgcgttgcacgacaccaggatgctcgtcgacccgctgcgcacgcagtcgcgcgcggtggcgatgggcgccgtcctgctggtcaccggtttggccggctgcttcgtgttctcgctgatccgtccgaacgggacggcgggcaccaacgccgtgctcgccgaccggtccaccgccgcgctgtatgtccgtgtcggtgaggatctgcatccggtgctcaacctgacctcggcccgactgatcacgggtcggccggtggacccgaccatggtgaaaagcagtgagctggaccggtttccgcgcggcaacctgatcggcatccctggtgccccggaacggatggtgcaaaacccctcgaccgatgcgaactggacggtgtgcgacgcggtcagcgagcccggggggcacgccgcccacagcgccggtgtcacggtgatcgccggccggccggacagcagcggcgcccgcgccgccacgctcccgtcgcggcaggcgttgctcgccgaccgtgacggcaccacgtggctgttgtgggacggcaagcgcagtcagatcaacctcaccgaccacgcgatcacgaacgcacttggcttggggcagggcaactccgagatccccgcgccccgcccgatcgccctgggcctgttcaacgcgatacccgaagccccgccgctgaccgcgcccggcatcccgaacgccggtgcgccggcgccctttaccgcgccggcaccgatcggtggggtcgtggtgtcctacaccctggaccagagctcctccggggcgccgcgctactacgcggtgttgccggacggcctgcagcagatctcgccggtgctcgccgcgatcctgcgaaacacgaattcctatgggctggaccaacccccgcggctgggcgccgacgcggtggccaagctgccggtgtcgcggatgctggacaccgcgcggtaccccgaccagcaggtcggggtggtggatgcggccaaatcgcccgtcatgtgcgcctattggagcaagcccgccaaggccgccagcagctcggtgaaccttctcacgggctcggccctgccggtcgccgaatcgatacgcaccgtcgacctggtgggcggcggctcgccggccaccgccgcccgcgtcgccctggcgccgggcaccggctacttcacccagaccgtcggcggcgggccgaactcgccgggcgccgggtcgctgttctgggtctctgacaccggcgtccgctacggcatcgacaacgaggccgagcactcggccgccgggcagaacaaaaccgttgaggcccttggccttaccgggtcgccggtcccgatcccgtggtcggtgctgtcgctgttcgcgagcggcccgacattatcgcgcgccgacgcgctgctggcacacgacgggctggcgcccgaccagaagcccggccgcgtcactgccgctgctagggaagccgagggagccccccgatgagccgactgatcttcgaagcgcgccgccggctggcgccgccggtgacccgcaagggcaccatcgccatcgaggccccgcccgagctgccgcgggtgatcccgccgtcgttcctgcgccgggcgatgccgtacgtgctggtgatcctgatcgtcggcatgatcgtcgcgctgttcgcgaccggaatgcggttgatctccccgcagacgctgttcttcccgttcgtgctgctgctcgccgcgacggcgatgtaccgcggcaacgacaacaagacgcgcaccgaggaggtcgacgccgaacgcgccgactacctgcgctacctgtcggtggtccgcgacaacatccgcacccaggccgccgcgcagcgcgccgccgcgcaatggtcccacccggagcccgcggcgctggccgccgtgcccggatcacgccgtcagtgggagcgcgacccgcacgaccccgacttcctggtgctgcgggccggacgccaccacgtgcccctggcgaccgcgctgcgggtcaacgacaccgcggacgaaatcgacctggaaccggtgtcgcacagcgcattacgcagcctgctcgacacccaccgcacggtgcgtgacgtgccgaccgggatcgacctggccaaggtctcgcgaatcaccgtgctgggctccgaggacgaggcgcgctcggcgatgcgggcctgggtggcccaggcggtcacctggcacgacccgaccgtgctcggggtcgcgctggtcacccccgacctcgagaacccggactggtcgtggctgaagtggttgccgcacattgacattcccggtgagctcgacggcgtcgggccggcccgcttcatggccaccaacgtcgacgaactggtcgccaagctggggtccgcgctcgtcgaccgcccggcgttcaccggcgaacccgccgacgcgctgcggcacctgctgattatcgtcgacgacccggactacgacctcagcgcctcgacgctggcgatgggccgcgcgggcgtcaccgtcgtgcaccgcggcgccaccgccccgcaccgcgagcagtattcggaccccgagaagccgatcctgcgcatcaccggggcggacggcgcgggcgggcggacccactccatcgagcgttggcagaccggcggctggcagccgtacatcgacgacgccgaccaactgggcgccgacgaggccgcccacctggcgcgccagctgtcgcggtgggactccaacccgacccacacggggttgcgttcggcggccacccggggcgccacgttcaccacgatgctgggcatcccggacgcatcgcaactggatgtgccgacgctgtgggcgccgcggcgccgcgaggacgagctgcgcgttccgatcggggtcaccgcgaccggtgagccgctgatgttcgacctcaaggacgaggccgagggcgggatgggcccgcacggtctgatgatcggtatgacggggtcgggtaagtcccagaccctgatgtcgatcctgttgtcgctgttgacgactcattccgcggaccggttgatcgtcatctacgccgacttcaagggtgaggcgggggccgacagcttccgccacttcccgcaggttgtcgcggtgatctccaacatggccgaaaagaagtcgctggccgaccggttcgccgacacgctgcgcggcgaggtggcccgccgggagacgctgctgcgcgaggccggccgccgggtgcagggcagcgcgttcaactcggtggtcgagtacgagaacgccatcgcggccgggcacgacctggcgccgatcccgacgctgttcgtggtggccgacgagttcacgttgatgctggccgaccacccggagtacgcggagctgttcgattacgttgcccgcaagggccgttcgttccgcatccacatcctgttcgcgtcgcagacgctggatgtcggcaagatcaaggacatcgacaagaacacctcctaccgcatcgggttgaaggtggccagtcccagcgtgtcccgccagatcatcggggtggaggacgcctaccacatcgaatccggcaaggagcacaagggcgtgggcttcttggtgcccgcgccgggcgcgaccccgatcaagttccgcagcacctatgtcgacggcatctacgatccgccgcagaaggccaaatcgcttgtggtgccgtctatcccggagcccaaggtgttcacggccgggcgggtcgagcccgatcaggacaccgtgatcaccagccccgacgaggtcgaactgaccgggccgccgcgcaagctgatcgccaccatcggcgagcagctggcccgctacggtccgcgcgcaccgcagctgtggctgccaccgctggacgagccgatcccgttgagcgccatgctggcccgcgccggcgtgccgccgcggcagtggcagtggccgctcggcgagatcgacaagcccttcgacatgcgccgcgacccgctgatcttcgacgccgcgtccgcggccggcaacatggtcatccacggtggccccaagtcggggaagtcgaccgcgctgcagaccttcatcctgtccgcggccagcctgcactcgccgcgcgaggtcaccttctactgcctggactacggcggcgggaaactgcgtgcgctcgaagatctggcgcacgttggcagcgtggcctcggcgctggaacccgaacgcatccggcgcaccttcggcgagctcgagcagctgctgttgtcgcggcagcgccggcaggcgttccgggactcccgcggtggggtgcccgacgacgggttcggcgaggtgttcctggtcatcgacaacctgtacgcgttcggccgcgacaacaccgaccagttcaacacgcgaaacccgttgctggccaaggtcagtgagctggtcaacatcggcctggcgtacggcatccacgtcgtgatcaccaccccgagctggctggaggtgccgctggccatgcgggacggcctcgggctgcggctggaactgaagttgcacgacccgcgggacagcaacgtccgggtggtcggcgcgctgcgccgccccgccgaggcggtgccgcacgaccagcccggtcgcggattgaccatggccgcagagcatttcctgttcgccgccccggagctcgaccagatcgccgcgatcaacgaccgctacccgggcatggccgcgccgccggtgcggctgctgcccaccaacctggccccgcacgccgtcggggcgctgtaccgcgggccggagcaggtggtgatcgggcagcgcgaggaggacctggcgccggtggtgctcaacttcgccgacaacccgctgctgatggtgttcggcgacagcaagacgggcaagaccacgttgctgcgccacctcattcgcaccgtgcgcgaacactcctcgcccgaccaggtggccttcaccgtgctggaccggcggctgcacctggtcgacgaaccgctgttcgccgacaacgaatacaccgccaacatcgaccgcatcatcccggcgatgctggggctggccaacctgatcgaatcgcgccggccaccggccggcctgtcgccgcaggagctgtcccgctggacgtacgcgggccacacccactacctgatcatcgacgacgtcgaccagatcccggactcaccggcgatgagcgggccctacgtcgggcagcgcccgtggaccccgctgatcggattgctgtcgcaggccgccgatctgggcttgcgggtgatcgtcaccgcacgcgccaccggctcggggcacgcgctgatgaccaacccgctgctgcgccggtccaacgacctgcaggcgaccacgctgatgctggcgggcaacccgcaagacagcggcaagatccgcggccagcgattcggccggttgcccgccggacgggcaatcctgttgggcgacagcgacgctccgacatacgtgcagttggtcaaccccctggccggggaatccgtcatggcaagtgaagcgcaacgggaggagtagagatgacactgcgagtggtccccgaaggcctggccgccaccagtgcggcggtggaggcgctgacggcgcggctggcggcggcgcacgcggcggcggcgccggcgatcacggcggtggtgccgccggcggccgacccggtatcactgcaaaccgcactgggtttcagcgcccagggccaggagcactcggccgtggccgcccagggcgtggaggagctgggccgggcaggggtcggtgtcggccaggccggcgcgagctatctcgccggcgacacggcggccgctgcgacgttcgggatcgcgggcgcctgacacatgacctccccgttcggaccgatctggatggcttcgccgcccgaggtgcattcggcgttgctcagcgccggtccgggctcggggccgctgctggcggccgccggtgcctgggcctcgctgagcgcccaatacgccacggcggcagccgaactcagcgcactgctgggccaggtgcaggccgggtcctgggaaggggagagtgccgagcagtacgcggcggcgcacctgccgtatctggcgtggctgcagcaggccagcgccgacagcgcgggggccgcggcgcagcaggaggtcgccgccacagcctacacgaccgcgctggcggccatgccgacgctggccgaactggccgccaaccacaccatccacggggtgctgctggcgacgaatttctttggcatcaacaccattccgatcgccgtgaacgaagccgactacgcccggatgtgggtgcaggcggccaccacgatgggcacctatcaggccgtcgccggctcggcgctggccgcggcaccgcgcaccgccccggcgccgtccatcgtcaaacccggcggggaagccaacaacctcgcggccaacgcggcccagaacagctccggggattggtggcagaacttcatccagcagctgtcccagttcttccagaacatccagaagatgctgcaggacttctgggcgaatctgccggcgttcctggcggccaacggacccctgctgttcttcgtcgcctaccaggtgttcttcaacgcggtgggctggccgacctggggtgcgatcctgaccgcgccgttcctgctgccgctgctgctgggcatcggcctgagctcgctgctggccgcgcccgccgagatcgcgcccgtcgccgcccccgccgcgatcaccccggtgctggcgtcgaacaagccgcccacgttgccggcggcggtggcgctggccccgagcgtcgccaccccggccggggccccggccagcacggtcgccgccggctccggcgcgtcggccgcccccgcgccggccgccgcggcgggaaacttcgcctatctggtcgccttcggcggcgacccggacaccggagtgggccccaccctgagcgggcgcggcggggccaaggccccggcggcgaccatcccggcggccggtgcggccgcgccggcccgcgccgaggcgcgagcgcgacgccggcggcgggccgcactgcacgactacagcgacgaattcctggacatggactccggtttcggtgtccccccggattacggcgccgaggaggagctggccgcggcggtggcctccgggcagggcgccgggacgctcgggttcgccggaacccagcagcggcgcaaggcctttcaagcggccggactgaccaagctggccgacgacgacttcggcggcagcccacggatgcccatggtgcccggcacctgggagcaggacacacagaacggagctcatccgaccgagccggggaaaggggggtaaggcagtcagccagatgcaggtgaattaccgaaaccccaacggacgcaacagaaaggaagcaccatgagcatgttggacgctcacattccgcagttggtagccgcacaatcggcgttcagcgccaaggcggcgctgatgcgcagcacgatcagccaggccgagcaggaagcggtctcggcccaggcgttccaccagggcgagtcctcggcggcattccaggccgcgcacgcccgcttcgtggaagtcgccgcccgggtcaacaccctgctggacatcgcccaggccaacctcggcgacgccgccggcacctacgtggccgccgacgccgccgccgcgtccggctacaccgcgttctgacccagccgttttcgagacgccgacagcgaaaggacttgtgatgtcacagatcatgtacaactacccggcgatgctgagccacgccgccgacatgtcgggctatgccggcacgatgcagggcctgggcgccgacatcgccagcgaacaggccaccctgtccaacgcctggcagggtgacaccgggatgacctaccaggtgtggcaggcgcagtggaacgaggccatggagagcctggtgcgcgcctaccagtcgatggccagcacccacgaggccaacaccatgtccatgttggcccgcgaccaggccgaagccgccaaatggggcggctagttcgtggctgaactgacctgatggacccagcacccaacgccgtcgagctgacggtcgatcacgcctggttcatcgcggaaaccactggggcaggaagttttccctgggtgttggcgatcacctgcccgtaccgcgatgcggcggaacgcaacgcgttcctcgaccgtcagcgcgcggagctgagcgagatgggcctggtgtccgacgccgggctgatcaaccccgcggtcgccgagtggatcaaggtggtgtgcttcccgcagcgctggctggacctgcgctacgtcggccccgccaaggacaccggtgaaggcggcggcagcgagctgctgcgcggcatcgtcgcgcagcgcgacggcgcgggcggccggtcgatcacggtggtcgcgttgcgcagcgcgcagctgatcacgttcaccgccatggacatcgacgatccgcgcgcgctggtcccggtgctcaccgtgggcctcgcgcagcgggcaccggcctccttcgacgagttcagcatgcccacccgggtcggcgcccgggccgacgagcggctgcgtgcgggtgctccgctttccgaagtccttgactaccttggtattccgcagtcggcgcgtccggtggtggagtcggtgttcaatggcccgcgcagctacgtcgagatcgtcgccggctgccaccgcgacggccggcactccaccaccgaggtggggatgagcatcgtcgacgcccgcgaggggcgggtgctggtcagcccgtcccgcgcgttcgacggcgaatgggtgtcgacgttcagcccgggcaccccgttcgcgatcgccgtcgcgatcgaacacctgaccgcgctgctgccggacgacggatggttcgccggccatcggctggcccgagatttttctgtccaacactgaagagaaatagagaagagagcacgatgttccaggaacggccgcaacattctgcgagggtccggtgacgtccggaaccgtcatgccgatcgtccgggtggcaatactggcggacagcaggctgacggagatggccctgcccgccgagctgccgctacgcgagatcctgcccgccgtacagcgtttggtggttccggccgccgccaacggcgactcggaggacggcgccccgtcgcggggcgccgcagaggtcggcggggcggtgcaactgagcctggcgcccatcggcggggcgccgttcagcctggacgccagcctggacacggtcggcgtcgtcgacggtgacctgctggccctgcaaccggtgccggccggcccggccgcgcccggcatcgtggaggacatcgccgacgcggccatgatcttctccacctcgcggctacggccttggggcacaacgcatatccagcgtttcgcgctggccgcggtgatcgcggtggccctactggcgaccggactgtcggtcagctaccgggtcgccaccggagcgctggccgggctggtcgcggtcagcgcggtggcggcactgaccgcgatagtcggcctgctggccaccgcccgctcgccgcgcaccgggatggcgctctcgatcgcggcgctggtgcccatcggcgcggcgctggcgctggcggtgccgggccggttcggtcccgcgcaggtgatgctggccgcggcgggtgtcaccgcctggtcgctgatcgccctgatggcgcccagcgccgagcgggaacgcctcgccggcttcttcaccgcgacggcggtgctgggcgccgcggtgctgctggccgcgggcgccgaattgctttggcacatcacgcccgtcgcgctcggctgcggcctgatcgtggccgcgcttctggtcaccgtggaagccgcgccgctgtccgcgctgtgggcccgcttcccgctgccggtcattccggcgccgggcgaccccacgccgtcggcgcccccgttgccggtgctcgaggacctgccgcggcgggtgcggatcggcgacgcccaccagagcgggttcatcgccgccgcggtgctgctcagcgtgctgggctcggtggcgatcgcgctgcggcccgaaacgctcagtgccgcaggctggtacgtggtgggggcgacggcggcgacgtcggtgctgcgcgcccgggtgtgggactcggccgcgtgcaaggcgtggctgctcgcccagccgtacctggccgccggtgtgctgctggtgctctacaccgcgaccggccggtatgcgggcgccctcggcgcggtgctggtgctgctggcgctggtggcggtgtggatcgtggtggccctgaacccgggtatcgccgcgccggaaagctattcgctgccggtgcgccggttggtcggcttcgtcgcgaccgggctcgatgcgtcgctgatcccggtcatggcgttcgtggtcggcctgttcggctgggtgctcgatcgatgattcggccggcatcggcctgcctcgcggcggcgttggcgttgttgcccgccaccgcgacgtgggcgagtccgccggccctcgcgatcagcccgccgacggtcgatccgggggtcccgccaccgagcggggcgcccggccccgggcagccgatggagcagcgcgcaccttgtaccacctccggggtgatccccggcagcgagccggccgccgtcacacccagccagtcggcgctgaatctgcctgcggcatggcggttttcccgcggtgacggccagctggtcgcggtgctggacaccggggtgcggcccggcccgcggctacccaacgtcgagccgggcggcgatttcgtcgagaccaccgacggcctgaccgactgcgacgggcacgggacgctgctggccggcctcgtcgcgggccagccgtcgcccgacgacgggttcgccggcgtggcccccgcggcgcgggtggtgtcgatcaggaccacctcggccaagttctcgccgcgcaccccgggcggcgatccgctgctggcgagggcggccgccgaggtcggcacgctcgcccgcgcgatcgtgcacgcggccgacctgggcgcccgggtgatcgacatcggctcggccacctgcctgccggtggaccgccccgtcgaccaggccgccctgggcgccgccgtgcgctatgcggccgtggacaaggacgcggtgatcgtcgccgccgcctgcgacagcgggccgaccggatcgttcgccggcggaacctcgtgtgagtccaatccgctcaccgacctgagccgcccgagcgatccacgcaactgggccggcgtcacctcgctgtccatcccgtcgtggtggcagccctacgtgctgtcggtggcctcgctgaccccggacggtcaaccgtcgaagttcaccgtggccggcccgtgggtgggtgttgcggcgcccggcgaacgcatcgtgtcgatcggcaacggcgacggcgccggcctgaccaacggcctgcccgacgaacaccagcagctggccgccctcaacggcaccggctacgcggccggttacgtcgcgggcgtcgccgcgctggtgcgcagcaagtaccccgacctgtccgccaccgcggtggtgcatcggatcaccgcaaccgcgcacaacggcgcccgcgacccgtccaacgtggtgggcgcgggcagcgtggacccggtggcggcgctgacctggcaactgcccgccggcgatcagccgggcccggcggccaagccgatcgccgtgccgcccgcgccggcgcccccggacaccacaccccgcaccgtggcggtggccggcaccgccgccctggtcgtgctggtcgcggtggccggcgcggtcattgccctcgcggcacgccgacgaaaggaccccagcgcgtgagcaagcatcggataccgacgcccgaaagcgggcgaatcacgttggcgctgttggccgttgtgcccgcggcgatggcctacccgtggcactcgccgcgcgactactggctgctgggcatcgcggccgtggtgctgatcgtgctgttcggttggtggggcgggctgtacttcaccaccctgctgcgccgccggctggcgatgatcgggcggcacaatgcggtgcgcccgcagcgtcccgacccggccaccaccgtcctgatccgcgtcggtgcgcccgccgaacggctccgacgcgctgccgctgccgctgatcgccggctacctggaccgctacggcatccgtgcggacaaggtccgaatcaccagccgcgacaacgcctccgacgagtcccggcgccaaacctggatcgggctcaccgtgtcggcgccggacaacctggccgcactgcaggcgcgctcgccgcgcatcccgctggccgagaccgcgcaggtcgccgcccgccggctggccgaccacctgcgggagaccggctgggaggccggtgttgtcccgcccgacgacgtcccccgcctgttgacgtccaacccgcgcgagagatggcgcggggtgcagcgcggcccgtcggattaccttgccgcataccagatcccggtggacgagtcgctgccggagacgttggaggcgatccgctcgtacccggcgcgccaaagctgcgtcgcgctggagatcgccggggacaaggcggcgccgacgatcgccgtggcatgcgcgttccagaccgacaccgccccggaccgcggggcgccgctggccgggctgatcccgcaacgcggcaaccatctgcccgcgctgaccgccctggacctgttgtcgacagggcggctggacgggcacaccgcggcgaccgcggacctgctcgaccggctgcactggcccacccaaggagcgccggccggtgacgccgacaccgtcgccgccgctagaacatgacctgctgcaggaacgcggtcatccggcgcaggtagtccagctggctgatgtgcagcacatggctgcccggaaaccagtgcagcgcacaacgatcccagtgctgccatagcttgacggcgcgctcgggcggggccatccggtcaccgaggccggtgatgatcatccgccggtctttggccagcaccggccggtaggtgagcgggcagtggtaggccaacccggcggccaactgcgctcggctgatgtcggacgatcgcaggcccagcccgaccagcttgttggccgggaaccattcgtcgaacagcgtcgccggggtgacgacgggacagttggggatgacggcctcgagccgatcgtccaccgaggccaccagcgccgaggtgtagccgcccagcgagatgccggtgagcgcgatgcgctcgacaccggtgtggcgcagatagtcgatgagcgaacgaaagtcgtgcacggcctgggccatcgcctcggcgaagccgctgagtccaccggcgaaatagccgaaaccgctgaagggcgagaacctttcggaccgcttgccgtgaaaaggcaaggtgtacatcaacacgtcgtagccggcccggtagtaccagggcaacgaaaagaaccgcccgttggccagatacgacgaccccaggaaaccgtggatgacgcacagcgtgggccgcggcccgtcgtcgtggcgccaatgctgcgcgcgcaccacgttgttgcggccccacccgctccagcgcgcccgcatggccgggttgaccgcggtgaagctgctgtcgaacgcgaggttgtccaccgtgccgcgggccacccattcggccaacgggctggcccgccgggaggtgacccggggcggttcggtgggcggcggaaaggaccggtcggggtcggccgccgcgcccagctcggcgtagaactcgagattggcgcgttcggtggcggcgtcggcgtgccgcagcgcgttggcgaccacgaacggcgccaccgtggtggacagcagcgaggccacccaggtgcgcagggccagatcacccagagccgaggcctcgactaccattcgctgacgaggcgacaacgccgaagtggggggtaatccgccggcgccgggcggtacatcggcgccgggaacgtctggaacggggatgggcgggtcgaacggatccaagtcgggcgccacgaacgccgatgctagcccggccgtcgcgcgcttcctacagcgttcggcccgtttcgcttcgccgtgatgtcatctcgggcccacgcaggggcggtgtcgaggcgcaccattggggtactacggtgtgcatcggccggctagcgacggcgcgttgatcaggaggaccgacatgtgggatccggacgtctacctggcctttgccgaccatcgggcccgtcccttctacgatctgctgtcgcgggtgggcgccgagcgggcgcgccgcgtcgtcgatctcgggtgcgggcccggccacctgaccaagtacctgggccggcgctggccggacgcggtcatcgaggcgatggacagctccccggagatggtcgccgcggccaaggagcgcggcatcgacgccgtcaccggcgatctgcgcaactggaaacccaaacccgacaccgacgtggtggtcagcaacgccgccctgcactgggtgcccgaacactccgacctgctgctgcgctgggccgggcagctggcgcccgggtcgtggatcggggtgcagatgccgggcaacttcgagtccccgtcctacgccgcggtgcgcgccctggcccgccgggagccgtacgcgaagttgttgcgcgaataccttttcgggtgggcgcggtggttcagccgccgacccactacgccaacatgctgctggacgcgggctgcaaggtcgacgtctgggagaccacctatctgcaccagctgaccggtgagcatccggtgctggagtggatcaccggcaccgcgctggtcccggtgcgcgagcggctcgacgacgacgcctgggagcagttccgcgaggagctgatcccgctgctgcgcgacgcctacccgcctcgcgccgacgggacgacgatcttcccgttccggcgggtcttcatcgtcgccgaggtcggctccggccgcccggccgcctagctcccgccgcccaccgcgccggccccgcgcgccgagcaccgcgccggccccgcgcgccgagcgtgtggggcaggtacgaaaaacgaacgggacacgtgcgtaggccccacactgggcgcggcccgggcggcgacttcgcgtcacgatgaccgcaactaccgctgcgcggggttgccctcctcctcgatgccccggtcggcggcgatggccgagcgggcggtcggccgggcgccgtggtgaatctgcagatacgtttcggtgtagcgcgccgcgatgcgggtgccggcgaactccgagggaatcacgtccccggtgcgctgacgccaatcatgcagcagcacagcaagattggcggcgacctcgtcggcgtcggcgtcatctccggccagcaggttggtgatttcggtggggtcggcgcgcagatcgtagagttcacgctcgggccgcggcgcggtgaccaacggcgccaccgccatcccggacgggctctcctcgatgtcccagggcagttccagcagcggccgcgacgcgtaattctcgatgtagctgtaatccttggtgcgaatcgcgcgaatcggatcgaacgagtcgtggtaggtcttcatcgtgtacacgtgctcgcgcaccggcgcggcatccggatccggccgcagcagcgcggacgcgtgcgacacgccgtcgacatcgggcggcacgctgattcccaacagccccaacagggttggcaccagatcgaccgcgctgaacaactcgtcgtacacccggggcggcagtccccggccggtgggcggccggacgatcatgccgatgccggtgccggcgtcgtacagcgtggatttcgcccgcgggaacgccggcccgtgatcggtgaagaacaccacccaggtgctggcgtccaaaccggtgtcggccagcgtgtccagcagccggcccaccgcggcgtcggccgtgctgatggccccgtagaaggcggccaggtcgccgcgcacctccggggtgtccgggaggtagtcgggcggttgcacctcggcgctgtccgccggcgggtaccggtcctccggatatggccggtgcgtctcgaagaagccggcggtcagcagaaacggttgccccacaacaccttcagcgctctgccgcagccactcgtcggcccgctgcgccacgtagtcgcagtaggaattcgacacgtcgaactcgtcgaaccccaaccgcttcgggtaggaggtctcgtgttgcatgccgaaaagcgccgagtaccaacccgcttcggacagtatctggggcagggtgcgaatcccgctgcggtattcccagccgtggtgggccagcccgatcagtccgttggtctgcggatagcggccggtgaacagcgatccccgcgacggcgagcacagcggcgcggtggcgtgcgcccgggtgaacaggatgccctcggcggcaaggcggtccaggcgcgggctggacacatcccggtggccgtaggcgcccaggtagcgccccaggtcgtgccagtgcacgatcagcacgttgtccttgcggcccgcgtcgttgcggtcgccagcgtcgcccggcgtcaattgcgtcacctctcacattgccttgcgaccggcgacgataccgcaacacgccgcgacgactcccgccccgccgaccggtcagggcagctgcggttgcgcccaccggttttcgcagacgaactccgccagcggccgcggcgtggcccagccgtccagctccagcgccgggcgatcggggaattcgggcaccggtcccaggcacaggatggccaccggttcggcgccgtccggcaacccgagcagctccgccagcggccgcggctcgaacagcgacacccagcccatgcccaggccttccgcccgggccgccagccacagattctggatggcgcacgacaccgacgccaggtccatctgcggcaacgtccgccggccgaagacgtgcttgtcgcggtcgtcgcccagggccaccacgagcagctcggcgcactccaggatgccctccaccttgagcgccaggaactcctgcgcccgctcgcccagggcggcggcggtgcgcggccgttcctgctcgacgagggcgtgaatgcgccggcgcagcgcggcgtcggtgatccggatgaagcgccacggctgcatcagccccacgctgggcgcggcgtgcgcggccgccagcagccgcgccagcacctgctcgtccaccaccgcgcccgcaacgaagcggcgcatgtcgcgccgttcggagatgacgcgatagaccgcccgtcgctcctgcggactgaaagccggaccggtcacgcagccatcgtaggaaatccgggctagcgtggatcgtgtcttgaagggagtggcccgtgaagccgtccgacgtgctcgagcaactggccgccgaccgcggcgccgaccgcggctacggcgagccctaccagaccccggacggcaccaccgtcatcgtggtcggcaaaccgcagggggtcttcaccatccgtgacggccaggcccgctggacgccggccgtggacaccggccgggtggcgctgatcggggtgatcaccggcctgctggcggcggtgatcggcagcctggcggtgctgcgccagccgccctggccgcggatcacgatcagggactataggtaacgccgaccgcgcggaacacgtactccggcggcatgtcgaaggccagcgagtggcgcggcaggccgctgagcacatcggcgggaatggcgaccttgtagtgcagtgacaactcgccgctgaatttctcgtcgacccgcgagacgtcgacgtccacctgcaatcccgtcgaggagatctccacctgggccgccccggtctgcggcgcgtcccaggcgacgttgacggtcgggccggccagcctgggcagcatggacagcgtcgccagcacccgctcggaggtgaacaccagcgaccccgtgtagctggcgacgctgtgcggcagccgcacgcccgggatggtgccgctgaatcgccgggtcaccgcgacgtaatcggcaaggtagataaggccttccgcctcgacctgggcatgcaggtcgtcgggcagcttgccgatgccgaacaacctacggacaaacacggccatgctgcccagtatgacggcgcgcgcgccgtcgcgcggccgtgctggtatcgatggggcaatgatgcgaccgaggcccgcgcccgccgcggcgatcgccctgctggccacggcggtgtacgcggtgatgtggatcggctaccggcacggctggggctggctggcgcggatggactggtcgttgctgaacggcacgcgtgacctcgcggtcaaacacccggactggctgcgcgcggccgaggtggtgtcggtggtgctgggcccgggcacgctggcggtgctgggcatcgcggtaacgctgtgcgcggtggtgctgcgccggctgcgggccgcgctggtgctggcgctggcctgcgcgccgtgcaacgagctggtcaccgccggggccaaggcgctggttgaccggccgcggccgccgaccgcgctggtcggcgcggcctcgacgtcgtttccgtccggacacgcgctcgaggcgacggccggtctgttggccatgacgttgttcgcgctgccgatgctgaaccgggtgctgtgcggcctcctcgtcgccgcggtcgcggtggcgctgccggcggtcgggctgtcccgggtgatgctgaacgtgcactacccgtccgacgtgctggccggctggtcgctgggctatctgtatttcctgttgtgcctcttggtgtttcggccttcggctccggaccgctcgggctaaagccgtgcggcggcgggcttttggtcacggcgcagtgacctaaccgggtctaaagctttacttgacccccgggacgggccggtccgacgatggagtgcatgcaccgactgctcacgtcactgtgcgctgcggcgtgcgtgatcgtcgcctcggtggtgctctcgccgatcagtgccgcggccggcgctccctggttcgccaacgcggttggcaatgcgacacaagtggtttcggtggtcagcaccggcggctcgaacgccaccatggagatcttccagcgcaccggcaccggctggcagtcgctgcgctccggcgtgcccacccacgtcggctcggccgggatggcgccgcaggccaagagcggtgttccggccaccccgatgggggtttacagcctggactccgccttcggcaccgcgcccaaccccggcaccgggctgccctacacccagatcgtcgggcccaactactggtggagcggcgacgaccacagccccaccttcaactccatgcaggtgtgcccgaaagcccagtgcccgttcaacaccgccgagagcgagaacctgcagatcccacagtacaagcacgcggtggtgatgggcgtcaacaagaacaagacccccggcggcggcgccgcgttcttctttcacaccaccgacggcaaacccaccgagggttgcgtggcggtcgacgacgctcagctggtgtcgatcatgaaatggttgcggcccggcgcggtcatcgcgatcaccaagtgacgctcagtccgccccggcgatggcccggcccggcttgagcgtgaagttcagcccctccaacgacatggtggcgtcataggtgcggtcgtagccggtgccgctgatcttccacccccgctcggtgcgccggtaggtgtcgcggtagaaggccgcgccgatcagcatgaaattgagctcggcgaccatcacccggtcctgcagataccaactgcccgtggcggtgtcgccgtcgacgacgatgtcgggatgggtgacccggtgttcggtgatgacgttcgcgggcagcgaggttcgcatgtactcgaccagctcggcgcggttggtgaagtgcagttcgttgccgatcgaggggccgtagtcggccgtgatgtcctcggcgagggtgtcggcgaaatcgtcccagtgcttggtgtccagcgcgcgcagatagcggtatttgacttgcttgatggcttcgatgtcggccaggtcgtcgagggtcatcggatcattgcagcacacgggtgaccatgtcgatcagggcacgccgttccaggctccagtcgacggtcgtcccgatcaccatctgcgccagcacaaccccgcgcagcgtcgcccaaatcacctcggccacaccggcattcgccggatccgtggtgatcagccggccgagctggccgatagcggcgttcatgtccagcaggtggcggcgcgacgagtcgcccagcgcgccccgggtggcgtgcaggatctcgaacgccgccatcgacgtggggctgctgtagcagctccacgcggtgtcgatgacgacctcgacgcgctgccgcagcggcaactcgctgacgtcggccgacgacaggctttccaccagccgggccaccccgtcgtccaccgcggccatcagcaggccgttgcggtcgccgaagtggtactggatgacgccccaggtcacgcccgcccgctcggccacgtgcttggcggtggcggcggcgaacccctcctcgatgatgcagcggaccgtctcgtcgatgatcctggcccgcgtgtcgtcgccgcgcttgcgcggcgcggtcgttcgcctggtgggccccgcggggcgaccgggctgctggcctgcggcaatggacattgttgactttataacatagccgagtctatttttgggccgtggcccaatctccgtatgcccgcctgtccaggtccgagctggccgtcctggtccccgaactgctgctgatcggccagatgatggaccgctccggcatggcctggtgcatcagctccttcggccgcgacgagatggtgcagatcgccatcgaggagtgggccggcgccagcccgatctacacccggcgcatgcagcgggcgctgggctacgagggcgacgacgtcatcacgatcttcaaggggctgcagctcgacatcggcgcgccgccgcaattcatggatttccgctacaccgtgcacgaccgctggcacggcgagttccagctcgaccattgcggggcgctgctcgacgtcgaaccgatgggcccggactacgtgttcgggatgtgccacaccatcgaggacccgaccttcgacgccaccgcggtggccaccaatccgcgcgctcaggtgcggcccatccaccgcccgccccgcgaacccgcggaccggcatccgcactgcgcgtggaccgtgatcatcgacgagtcctacccggaggcccagcccatcccggcgctgcacatcgtgcgccaaacccgcgctgccggttgggaactcgacccgatcgatgcgtcggacgagggcatggccgactattccgggccgctgctgtccgacctggacttcggcgcgttctcgcactcggcgctggtgcgcatcgccgacgaggtctgtttgcaaatgcacttgctgtacctgtctttcgccatcgcggtgcgaaagcgcgctgccgacgatgccgaggcggtgtccgtgtgcacccgcggcctgaccggcgtcgccgggctggccgccgagcgaatccatcgcgccgtcggatccggtggcgggatcgacgcggtgctgcgcgtgctcgaattgcatccgctgctcaaccccgccggctacgtcgtctccgaaatcgccggcaaccggctgctcgtgcaccggtcaccggcgcacgaggacgccgcctggatatccctgtgctcgccgggttcggtgcaaccgctgcaggcgatcgccaccgcggtgaatccgcggatcggggtgcgggtcagcggcaccgacaccgactggaccgccgaattcgtcgaaaccgacaccgacgccgatgagctgccggaggtttcggtgaccaaggtcagcggcggttccaccttccaattcgagccgagacgatcgctgccgctcaccgtggtctgagtccaacgggagtttgtcaagggatccgcggtaccacttcggtgacacaaccgcatcgaccatataccgatgacgttgcaacccatcggctttgggcgtgtccacggatatggttgacgctggccaccgacccctatagacgaaggttttcgctctatgtacgacccgctcgggttgtcgatcgggaccaccaacctggtcgctgcgcgtaatggaagcccaccggttagtcgccgctgtgtgctgaccctttacccgcactgcgcaccgaaaatcggtgcgcccgaagagaatccgcttctggccgagcctggcgtgccgatgaagggctttgtggagcgcatcggcgattcggtcgcgctggtgtcgccggacggttccgcgcacgatccggagctgttgacggtggaggcgctggacgcgatggtgctcgccgccggtgcggatgcggcgtcttcggagatttccatcgcggtcccggcgcactggaaacccggtaccgtgcaggcgctgcgcgacgcgttgcgcacccacctgggcttcgtccgcagcggcatggcgccgcggctggtcagcgacgccatcgccgcgctgaccgcggtgaagtccgaactgggtctgcccgacgagggcgtggtcgggctgctcgacttcggcggcagcggcacctcggccaccctggtgaacgtcgccggcgacttcgaactcgtcagcgccacaatgcgatacaccgcgctatccggcgacgagatcgaccaggagctgcagctgcgggcgttcgaggagctcgggcacggcagcggcctcgacccggccagcaccgccggggtgggacagctcgcggcgctgcgggagcagtgccgcgccgccaaggaacggctttccaccgacgtcgtcaccgagatcaccgccgaactcggcgggcgcagttgcagcctgacgttgacgcaggacgatctcgaagagctgatgcaggatcggctgaccggcttcatctatgccttcgacgacctgctggtgcgctaccgcaagagctggtcggacctggcggcggtggtgacagtcggtggcggtgcacgcattccgcttgtcacggaacgactttcgatgcacggccggacaccgatcctgacaccgtcgcagccggcgttcgcggccgcggccggggcgctgctgctggcctcgcgcggcggcgaactggacatgcgcacgcgcacctcgatcggcctgctggcggcggccgacgccgccggcgacgtcgtcgacctgggcgccggcgatgtgctggtgatcgacgacgaggcgctgaccgaccgcgaattagcttggtcgcaaaccgaataccccggtgacctgcggatgcggttcggcggcgaaacctatgacgaggacggcccggccggctggtcgatgcggctcaacgtcatcgacccgcccaaaccgcggcggccctggcggcgacttcgcttctcccagttgatcatcgggatgtccgccgcggtcgccatgaccgcgatcggcggggtggcctacacgctgaccgggatcgaaaaccgccaggccccgccggcgccgtccgtcgccccgctgccgccggtcagccgggtggtgccgccgtcggccgtcgcgccgcccaccgcggtgcccccgccgccaccgcccagcgcgcaaccggtccccagcccggcgccgccaccgccgcagccgcccccgccgccaccgtcgccgccgccggcaccgccgcctccggtcgtggtaaccacggcaccgccggcgccgacctacacgccgcggcacaccgcgccgcccacggccccgccggcgctcaccaccacggcgccgacgccgagtccgacgcccaccaccacaccgccgccaccgacgacgacgcaggagccgaccaccaccagcaccaccaccacggtgccgatgaccaccgagtggatccacgttccgctgctgccggttccgatcccggtgccggtgccgcagaagcaggctcccgcgacgccgcagtatccgtcgaacgagtatccgcagtacccgcaatatccgggcaacgaatatccgcaatacccggggaactcccaaaacccctactacggcccggggtattagcgtccgtcctgctcaggcagtccatctgcgcgccgagtcgcgcgcgggtagcgtggtgtcaccaagttcatgcgggatttacccgccatgccctcgcccggcccggtccgggtcgcgcggggcagtgcaagaccttggaggcgttacgtggacatcgtgcttggggtgtcgatggctcccgggacggtccgcctggtagcgatcgaaggacagaatgccgacggcgtgaccgtcgaacaggaagagttcgcggtcggagccgctgagaattcggcgaattcggcggccgaccaggtgatcgacgcgatcatcggcacccgcgagggagttttcgagggcggccaccggctgacctcgacgggggttacctggaccgaccccaccggggccgcggcgttgcgggatgcgatcgcctcccacgagctgggcaacgtgatgttggtctcgccgctgctggccgcggccgcgctggcgcagacggtcgggtatgcgctcggctacgggcacatcgggatgctgttcgtcgagccgcgcagcgcgacgctggcggtcgtcgacgtgagcgacggttcgatcgtcgatctgcaccgccaccagatcccgcacggccccggcgcgccggtggcggccgagctggcggcgatggtcgccggcctggatgcgcgcgacacccgcgccgacggcgtgttcgtggtcggctgcggaaccgacatcgtcgcggtgaaaccggcgctggaggcggccagccccgttccggtcaccggccccgaggagccggacatggcgctggcccgcggcgcggccctggcctcggcgaacgcgccgctgttcgcgtcgtcgacggcggcgctggcctacgcgctggacccgggcaccggggagatggatccacccgcgttcaaccccacctatctggatgtgtggggcgacaccggtgcgggcaccggcgtgcgcgcctacagcgccgtccccgacgaggaggagccggccccgcgccggccgtggtcgatgctgctggccggcggcgcgctggccggcatcgccgcggtgatcggcggcgtggtgctggtgacgctgacctcggacggtcacggctcgaacacccggcacaaccagggcgtcagcgtcgccaccccggggatccagctgccggcgccgccgccgagcaacccgccggcggcgcagccgcccgcgccgagcacgcccgcccccgccccgacccccaccgaggtggccgccccggcgccggagcccgtccagcaggcggcgccgcagaccccggtcacccccgcacccccggcgccggtctaccgcgccccggcccgggcccacaccgcagtaccagccgcggcccgtcgagcagccggcgccgccgccggccgccgcgcccgccccggccgccccacctccggtgcccgcgccgccgccggccgccccgccggtgccccaccagccaccggtgacgatgtacctgcacttcccgttcgtcacggtgccgatcccgatcaccccgccggcgccgccgcccggcccatagcacctggcacacccggccggccgggcgcacactggcaggtacggcacgagcggcaaggaggtcgcgtgggcgagcagggtgggttcggattctaccccgacgagttcgatcggatgatccgcgaaggcagcgaagggctgcgcgaggtgttcgagcgggtcagcaagttcgtcgccgctccgggcgcccggaccggctggtcctcccttttcgaggacctgtcgcggcggggtcgccccgcgccggagaccgccggggaagccggcgacggggtgtgggccatctacaccgtggacgccggcggcggcgcgcacgtcgaacaggtcttcgccaccgagctcgacgcgctgcgggccaacaaggacaacgtcgaccccaaacgcaaggtgcgcttcctgccgtacggcatcgcggtcagcgtcctcgacgacgatcccgaacagcccggctgaccgtcagccccggccgaccacgttcgagccacccgagttgctgatgctcggtgtgcccgagtggtaggtgaccttgttgttgaagcccgaggcgtcgatgcgctcgaccgcctcgacggtgaccgtgttctgcacgcccgacaccgacaggctggtgcaatgcccggtgatcaccacggtgttggacacgccgctgacgctgaccgggttgtcgtcacaggccagcgtgcggttctcgttgatcccggcgacgctgagctcggtgcccggcggcgcggccggtgacgtcggcgtccggcgggacgtcgagggggccggcgtcgtcgagatgcccggcggcgggccgaacgtcctggagatggtgggcggcgagttgatgatcgacttcacccccgaaagctggtgtgccgcaaaggctgcgatgccgccggtcagggccagcacgccgacggcgatgagggtgcccaccacccaccacactcggttgcccgacgggcgttgcccgggcgggccggggacgggcccgccgtaggaccacggcgccggcgcaggagggtagcccgggccggtgggcggcgcgctgccctgctcggaggcccgcgccgagtcggcgagcggacgctcgagttcccggatccgctcctccgggtcgtcgtttgctgccatggattgaatatgccattcccttctgcggtttcggcccgttcggtagtttttaggaccgtgcccgatttgccgaaccgccagatcctgctgcgtcgccgcccctccggactggtccggccggacgacaccgaactggtcaccacccccgcgccggaacccgccgagggggaggcgctgctgcggaccacctacgtcggcatcgacgccgcggcccgcacctggctcgacgaccagcccagctacctgccgccggtgcagttgggtgaggtcattcgcgcggccgggatcggcgaggtggtggcctcgcgctgtgacgcgttcgccgtcggcgacgtggtcaccacgctgaccggattccaggagtacgcgatcatccgcgacgacctgttcagcacgccgattcccggcgagcacgaccagctggcgatcatgtcggtgtacggaccgaccggcgccaccgcctatttcgggatgaccgacatcggccgcccgcagcccggcgagacggtggtggtgtcggcggccgcgggcgccaccgggtcgatcgccgggcagatcgccaagatcgccggcgcccgggtggtgggcatcgccggaggaccggagaaatgccgtgcggtggtggcggacttcgggttcgacgcgtgcatcgactacaagaacgacgacgtcgcggcggcgctcaaacagcactgcccgcgccgcgtcgacgtctacttcgacaacgtgggcgggcccatcctggacgccgtgctgggacggctggccccccaagcccgggtggtgctgtgcggcgtcatctccagctacctgaccggggaccatcccggcccggccaactacgtgaacctgctgtccaagaccgcgctgatgcaggggttcaacgcgctcgaccagtggggccgcttcgacgaggcgttcgccgcgctgcggaagtgggaggccgagggccgacttcaccaccggcagaccatctttgagggcatcgaatcctgcgtcgacgccctcaacgggctgttcaccggcgtcaacatcggcaagacgctggtcaagctcagcgaacccggcgccggctgaccgggcgcgggatgcggcccaaccccggcgcgtggtttcataacaccgtttgcgagagttgcttggggagatcgcgccgcgcatgacgggccggcatcgaacgattggtggttactagatggatcgtcgcagcatgatgttgatgtcgggaatcggcatgctgggagctgcgatgcgcctgcccggcgcctgggccaccccgccggcgcccgaagcgccgccgtcggccgggggcgggccctacatcttcgccgacgagttcgacggtcccgccggctcgccgcccgatccgggcaagtggaccatccagacctggcaggacgacgtgttcccgccggtggccgggatctaccgcgacgaccgccgaaacgtgttccaggacggcaattccaacctggtgttgtgcgccacccaggagatgggcacctactacagcggcaagctgcgcggcaacttccgcagcatgatcaaccagacctgggaggcgcggatcaagctggactgcctgttccccgggctgtggccgtcgttctggggagtcaacgaggacccgctgcccgacggcgaggtggacatcttcgagtggtacggcaacggccagtggcccccgggcaccaccgtgcacgccgcctccaacggcaagacgtgggaaggcaaatcgattcccggtctggtcgacggcaactggcacacctggcgaatgcattggggcgaagagggattcgagttctcccgggacggggccgagtacttcaaggtgcccaacaagcccatccacgtcgccggcggcgcgcccgacgacttccgttggccgttcaacaaccccggctactggatgacgccgatgttcaccctcgccgtcggcggagtgggcgccggtgaccccgcggcgggcgtgttcccgtcgtcgatgctgatcgactacatccgcatctggtagcgctcacttcgtggcctcgaacacctgaaccaggttgaactgccagcgctcgaccagccggaagcccaggtcgtgcggcaccgcgaaggcgggtgtcgccccgtagacagggcccggcggcagcgccgggccctgctggtgcgccggctcggaggggtcggcctgggtgatgatccacagcacggcgcagtggctcaacggcccggccaccacctcggggatcaggttggtgtcgaagacgtcgttgcggtcgacggcccgctgccacagcgtgaggtcgatcagcttgcgatacgcgtccgggcgcgccgccagcagcgggcgcatcggggcgggcatgaacgtcaccgtgtcgttgaccagcaggcaatcgccgggtgcggccttcgcggtgatcagatcggcgacctggctgtagtccatcccatacttggcatacggattgcgctgtgctcgaacataattcggcaccgcagcgatagcgaaaacaccgaccacggcggtggtcacccagggcttggcggctatcgcggcgctgcagacgcccaggatcagcgccatcgccggcgcggtgaagcacaggtagcggggcgtgtagatcggatgcaccagcgccgagtaggccacgatcgccgcggtcggtatcccgacccagcacgtcgccagcaccagcagttgccgctccgagggccccggcggcgcggaccggctgagccacaacgcgattgccgcgcagatcagcagcgccgacagcacggcgaacggcgggctgcgttcgaaatactgctgcatcaccacgtcttcgacggtgcggtgcccgatcgacgccacccagctgatctggtgcgcctgcccggccaccgtcagcaggaacggcagcagcacgcccaccgccaccgccgagctgatgccgaagcgccacaacaccgttcgggtgcgacagcagacgccgacgaagacggcgtacgctgcgagcagcagcgcgatgtacgcgtcgagcagcaccgagcacaccagggcgaggccgaaacacagccacggccaacgggattggcggcgggcggcgaaaaccagcagcacgctcagccacaccgcggccatcatcgacagggcatacggccgggcctcgacgccggcccaggtggtgcgcggcaacaccgcgcagaaaacaccggagaccaccgcgaccgtgcgcgacgagaactgcctgcccagcacgacgacgccggccgcggcggcccccaccgccagcccgctgggggcgcgcgaccagaactcggtgggcgggacgagccggaaccagccgtgcatgagcaggtagtacaggccgtgcacggcgtcgacattgcccagcatgtgccacatctgggtcagcgaccggctgtaggaggccgagatggtcgcggcctcgtcgtaccagaaggacggccgcgcggccccggccaggctcaccgcggcggccagcgccgcgacgatccacgggtccagcgcggccggtaccgccggacgggtcgggctggacacaccgccatgttgccagacgcccgtcgggccacccggcggactcggacaccccgggattcgaacgtatgatcgatcgatggatccgctcgcgtcgatcggatacaacggccaaccggtgcgcagcccgtttcgggtggtgcgcccgccgatcgccgtgctggtcgatctgaccgtgctgttcccgcgccagccgcaccgctcggggcggtatcagcccaacggtctgcaactgcacaaggtggtggaggggcggctgagttgctgggcgctgtgcgagcagggcgactggtggggcctggtcacctatccggtggcctacggcgccaaatgccggaccgtgacgcactgggtgccggcctggacgctgcgccgcaagggctgacggcgcagccatgcgccggcgtcgcgccgatgcgatgatggctgcccgtggaaccaagttgggcatcggtgctgagcaagctggtcgcgctggcggcggtcatcgcgctctcgccgatcacggtcattcccgcggtgctggtgttgcacgcgccccgcccgcgcccggccagcctcgccttcctcggcggctgggtgctgggcctggtcgggctcaccgccgcgttcgtcggtggttcggagctgctcagcggcttgcacgcgaccccgccgaaatgggcgtcgtgggtgcggctggtcttcggggtcgcgctcctcgcgttggccgcttaccactggttcacccggcaccggcagcgcagcatgccgcgctggatgcgctcgttcgccacgctgtcgccggtgcgggccggggtggtgggggcggtgctggtgccgctgcggcccgaggtgctcatcctgtgtgcggcagccggtttggccgtcggcaacagcagcctgagcgcgggcgcccagctggtcgccgccgcgatcttcgtcgtgctggccgcgtcgacggtggccgtcccgatcctggcctacgccggtgccggggaccgcttcgacgatgcgctggagcgcctcaaagcgtggatggaagccaaccacgacgcgatgctggcggtcatcctgctgctgatcgggttgatcgtgctctacaacgggattcgcgcgctggcctgacccggcgcgtttcggcgtcacatcggcgccgcggtggcaggattgccgctcatggcaggaagctggggcaccgtgctgaccgggctggtgccgctggggctggtcatctcgttgtcgccgctcaccgtcatcccggcggtgctggtgctgcaggcgccgcggccgcggccgagcagcctggcgttcctgggcggctggctgctgagcctggccgcgctgaccgcgctcgccgtcgcggcctcgcacctgctcggcggcctggacaggtcgccgccgcggtggtcgtcgtggctgcgggtggtgttgggggcggggctgatcggctacggcattttccggtggcacacccggcaccggcacagcgagtcgccggcctggatgcggtcattcgccagcatcaccccggcccgcgccggcatcaccggggcggtgctcgcggtggtgcgcccggatgtggcgctcatctgcgtcccggccggattggccatcggcagcagcggactcggcccgatcggcgactggatggccgcgctgttcttcgtcgcggtcgcggcgtccagcgtcgcgatcccgatactggcctatctggcggccggcagccgcctcgacgatgcgctggcccggctccgggactggatggaccgcaacaacgccgccctgctcgcggcggtcctggtggtgatcggcgcgatggtgctctaccacgggatcgacgccctgtagcccccgtcgcacaatcccgcgtcctcctcgaatcggttgaccacccgaaaaaccaactcgcggaacaactcccggccgtagccggtgagcatgccgaaataaccgcgggccgcccactgcgcggcgtgccgttcctcgtggtgcaacaagcggtccaggtcgaggtgggcggcgcgcgggacgccgtgcgcgtcccggccccaggcgcgtccggagcggatgatccggtgcagctggtcgaccgggtcggccagccggcccaggttgaccatgaagatgtcgccccaggtggtaccgccccgcgcgctgaacagccgttgaatcccgttgccgcccaatcccatcagcatgccgttgggggtggtgaccaggcgagctccgttgcggtgcacgaaccggacgtcgcggcgatagctccagtcgttggcgtgctggcgggcgatgatgcgcaccgcctccgcggcgctgtagggggtgggcggaaagtccgtgggcgccttgccaatcccgtaatcggtgccggcattgaggatgtaggtcatcagcaccgcctcccgggcgtgctcgccgggggtgtccgggcgcagcaggaaatacgatttgccgagcgggtcccggaactcggtcagggtctcgagcaccgcgaagcgcgccggggtgatgccgtggcgccggacgatctcgtcgaccacccgcgcggccacgcctcggcgatcggcgttctgccgccaccgcgcgcaatagccctgtgcgtccatgtctttggctgttccccgtccagcctaggtcaggccgcggggtccgtgcccgggtcgatgcccgcgaccaggctcacgacccgtcggccccgatcagcgcccgcaacgtcgcgcgcgcgccgcgccggtgcagcgagtccagggcccaccggtaggcctcgcggaagcgcggtgcgtcgatcaggtcgccgaacacggcacggttggccagaaacgcgtccggattctcgcgctgcgagcgggcgagcggcaccagggtgtcggcgagccggtccaccacctcgatcgggcggccctgttcgtcgacgccctcggcgtagcgagcccagctcgcgacgatcgccgcggacagctgcaccgggccgccggagcgcaggttgtcgtgcaccaccggcaacagccacttcgggatgtggtcggaggagtccgcgcacagccgggccacctggtcgcccacataggcgttggcgaagcgggggatgaggccgtcgcggaagtcttccaggccgggcatccgcggcagcgtcggcatcgcctccgaatccatgtagcgggcaaggaattccgcgatcaccggatcctgcgcggcctcgtgcacctcgcggtatccggccaggtaggcgaaatagcacaggccttgatggccggcgttgagcagccgcagcttgatcgcctcgtagggcgccacgtcgtcgaccagccgcacgccggccttgtccagcgggggccgcccgtcggcgaagtcgtcctcgagcacccacatggcgaacggctcggccaccaccggctcggcgtcctgcacgccgaactcggcggccaaccggtcgacgaggtctggtgtgggcgtcggggtgatccggtcgaccatcgagttggggaaggtggtgttctcccgtatccattgcgcgagttcgggattgacctgctcggcgtgggcagtgaaggcgcgccgggccacgtctccgtttttgatgatgttgtcgcaggagacgatcgtcggagagggcaggccacgctcccgtcgccgattcagcgcctcggccaccaactcgaacgccgcgctgagcggcggctggtagccgccctcggtgatggtgagcgagatgatccgggtggcgggatcggccagcagatcgacgacggaaccgggatcctcaggcgcgtaacggaagtcgacgatggatccgatgacgcgcggctcctgggtgccgtcgggatgttccaggatcagcgtgtagaggtagtcctggctgcgcagcgcgtcgcgcatgcgccggtcgtcgggcagcacgccgataccgcagatgccccagtcccgggcgagaccgtcgttcagcaagcggtccagatacatggcctggtgggcacgatgaaaacccccgacgccgaaatgcgctatgccgatgccgatttggctacggtcataggtcgggacggggattttgagaccggtcaggttatgtgcgttcagcttcactcgactgtcaccctagcctggaccggacgcctgggtcgcgaccgggccggtgctaggcgttggggcacagatcgcgcaacgcgaagatcaccacgtccgcggcctgccggccgttgatgccgccggtgccctggtcggcgtcggagcgctgcagcgcgagcccctccagctgctggggagatgccccccaggacagctgttggcacaaatccgcgcccatttgcaggagcgcgtcgtcgccgccgttgacggcatggatcccggcgttgtgcaggtcgttgaggaaggcggcctggtccgcccgcgccgggccggccgtcacggtcgccgtcagcatccccgccagcaccagtgggcccgccgtcagcgccgcgcccgttacccggccaaccagcctgcgtgccgccatccaaccttctccttcgtctgtgcccgatgcggatgatgcactttgacacagaagtgcgaaaaaccgccgcgcaaacacatccggaggatgaacagtcggcgaagaggagtgggcggtcgcggcacgcggcgaccgtccactcgggcctacctagcggggctaggcggtgctagctggggcacagatcgcgcatggcgtaaccgacgaggtcgtcggcctgctggggggtgagcccgccgggcccctgccggtcgtcggaacgctgcagctccaacccctcgagctgagcgggcggggcgccccactatatttgctggcagatgttcagacccgcctgcagcagcccgcgtcgccgccggtcacggcatggatgccgtcccggtgcatgtcgttgaggaagccggccgcgtcggcctgtgccgggccggcccagacgaccgcggcgagaagcgggccaccgagcagagctgagccgatcaaaccgccagctagacgacctggtgacataatcccttcccctcttcctgtcaaccgttcggatcacggtgttcacttctatgtaacctcgaaaccggccattgttcaccaaaaatttcctgtgaatggcctgcggaaaaatagattccctgcgattcgaagtcgcccggctggggtgcgccggcgccgggtggctccgtgacaccgttgtgacgtcaccatttggaaacggcgcggtgcggcgcggctcgtgtcgcgcgccggctaccgacaattagcccggtcgtgaaaaggccgggtacggcgaagcgggtctgctgcaccaaaacattgccgaactagcagagcgtggatgaagggaagttgacgctgatggcgatcgtcgatcggttcaacatgaaagtggttgcgagcgctgggttgtgcggagcggccatagcgttgagccccgatgcggcggccgccccgctgataacgggcggccacgcgtgcattcaggggcagtcgggcgaagtggcgcccgccgccggtggtccggtcgccggcggtgcgcccgcggccggtggtgcggtggccgcgggtgcgaccgacatgtgcgcggcccccctcaccgacatgtccggcgtgccgatggccgtgcccgggccggtgccgctcggcgctccggtgccggtgccgctgggcgctccgttgccgctgggtgcccccgtgccactcgcgcccccggtgccggtggtgccggccggcgcgccgctgatcgcgctcggcgggccggccgcggccggcgccccggtggaggcggccgctcccctcatcgacatgtcgggtgtgaaggacgcgccgaccggcccggcgcccaccggcggtccggtgcccggtcagccggtgcggcccggcccctcgggcgccagctgacgcttcgttcgcttacagcgggcccgccggtttgcatgccggtgggcccgctttcgttgtgggagtgggtatttcctgttccaggtgccgggacgccgcctgggtgacgcggtgtgccccgcgaattacattgtgctgcggttggttacggccggccgtcgttagtcttggacgatcaccgggtcgccgacgttgacgtggtcgtagtaccattcggcgtcgtcgggactcaggctgatgcacccgtggctgacgttttccagccccagtgagcggaccgcccacggcgccgaatgcacgaacaggccgcggttggtgatgcggacggcgtagttgacggtcagcaggtatccgtcgggatcgtcgacgggaattccgacgctgctcgaatccatcgtcaccgcacgctctttcgacaggacggtgtacgagcccaccggcgtcgggaattccggcctgcccatcgaggccggcatcaccccctgctcaccgaagtggggccggtggtgcggcgccggcagcgaggtcggcggaccggcttcgacgccgtcgatgctcacggtgaaggtgtgttcggagatgctggccaccccgatgaccgcgggacccgtcttgatctcggtggaaaccccgccgacggtcagcgcaatcgtgctgtgcgcgggccagtaccggtccggaacccattgcacgacacggttgtcgagccattcgaacttgccgctcatcgcgggtgtcgatttgacgtcaatggtctgttcggccgcgtgtcgcttggccggatcggtgatgggcgcgcggaacgtcacgaccacggggtgcgccacgccgaccatctcgccgctgctgggcagcaccgacgcgatcgcgaacgcgtgcgactgggtcgcagcggccaggctgacgccggccggcgtcaccaccacacacgcagcgacgccgaccgtcgcaagaacacaccgaacacccgtccgcatggccccaattccttttaactgacatagttgcaatagggatcgtaaatgggcgatgacctgcggaagcgcaagggcgcgttgatatttggccacgcatcggtcacgtttcggtgtcagcggtttagcgcgtcagcgcgagggcgttgagagtgaattttcagctgccagtcctcgccgcgaacgcaagaatcttcgcagcggagacggcggcaaggtggtgccggcattgatgtggcgcaggcggccaagctttcacaggaaagcgatctggacaagcttgaaaggtacttgctcaatcccgaccacgtaactggggaccgaaggcgaagtggttcgaacgaaacgggtgtcacccagtacggcataaagtacaaccaagtgatctcgatcgccggagcgaacggaagggtaatagatgtgacgttcgcctggatacgcggaaacgacggtgtggtgcgcttggtgacggcgatccctacgagcaaatgagagaacgtaaagcgttgagacctcgagagtatgacgtgatcaggctgctgcggccgctgccggaacacaacctgcctgccggttcacgcgggactatcgtcatggattacacgaaggattcggatagcactctcccgtccgcgtacgaggtggagttttcagatgtcgacggcgtaacccaggcgctggtcacgctttccggagatgacctggaagtcgtctggcggccggatccagatgcgtagcgactgtagttgcggcccgattcagggccacatggccatctcggtgtagttgcgcggcggccgcgtcatggccgttagtgctaggcggaagacgaccaggcacccggattactctgcgtggctagacgggcgggagttgagttcctaaggggagtcaagctacttcggtgggttttatgctggggtggacgggccggtgaattggagcgcttggcgactcctgtggttcccggcccgtcctgcctttctggcgctgggagtagcgcttggaggcggcgttgatgcgggtcttcttgtcgacggcgtggtgagcgcggacgattcggcgtccttcttcgaaggtgatgggccgtccgtcggtgtcgcgcagtacgtagtgtgctccggtgcgccagcaggtagcgatgcgggtgagcagggtggtggcaatgtggcagatcgccgaatcgtggtggcgctcggtggtcatgagccgcttgtattttgcggccagttgcgggtcggttttgcgggcttggtcggccgcggcgaagagggcttcgcgtagcagcgggtcaccggctttggtgagcccgtggcgctgttctgcttgtccggactggctgaccttggggacgaggccggagtaggcgcggatggcggccagggagtggaaccggtgcgggtcgccgatgcggccggcgatgaccgcacaggtgacgggcccgaggccgggtgctgaggcgatgatgccgcgcgggtcggcctcggcgtagaggttggcggcgcgctcgtcgaggtcgtcgatctgctcggtgagcatctgggcttgttcggcttcggtagcgatgtcggcggccagttcggcgaagtcgatgcgggcattagcgccagatccccacagctgcagcgactcttgggcggcggtcaacagcagggtggcgtgtggttcgcgccaggcgccgcgggagtggcggatcaggaagcgggtcaggcgggcatggccgagacggatcaggctgtgcgggtcggcgtagcgggccagcagtgccagtgcggccttgccatagctggatcccagcgcgtcgtaccaggctggaccgaggagctcgagctgggcgtcaaggcgctggaagactgcggtgcggcgcttgacgatcgaggagcggatcttgaccaggcgccgcagcggttcgccgggcccgtcgccgctgtggtcacgcagcccctctggatgcagcaagggcaaccgggccaacagcttggagtccagatggtcatttttggtgtgcttggagtagtaggcgcgcaggtctgctgactgggtggtgggcaccatcgagatccgggcgccgtgatgacgaaaccaggatgccagcgcaacccatgcgttgcgggtgggctccatcaccacccgcacggtgtcttgctcgctgagtccgattactttccagagcttttcgaggtcggcggtcagtccccgggtccgacgggcatggcccagacattccgcaagcagaagtccgctaacgcgcggctccaagttcccgaacagggacaccggtcggcacctgagacgcgccgcggacgaccactcaaaaaaacaggaatcaccacgtgttccggtcggtgggctcggcagtccgcgggcgcccactaaacctaaatgtcggtggccgtacctatcgtgtcggtcatgccggctcttgatcctcgggagcgtgtagagaggtttgttctgcgcgcgcgaaaagtaatggcgcattctctggtccgcgaccgctcggacctgttgaaagaattggcctcggggacgattaaggtgcagatccaagtcgacaccgtgaccggcgaggccacgcatcagttttcgatggagttgccgcctgaggaggcgttcgagtccttcgcggccagggtgcggccattcaccattcccaaggagccggtctactgggcggtggtgctagacgcgttggaagagcttgtgagcgaggacacgctggccaatatcatcgacatcgaagatttacgtgcgcattggaagaccgttgtagaaggcaagaaggttgcgcaagccttctacgtggtgaccgagaaaggccagctctctgacgtccaattggccgaaatgtggctgaactctgatgctctccacacacagctcattcagtcggaggtcggcaaggaactgagcttggaccagcgctaccgcgcggcgacgggtgtgtacgcccgtctgggctcctgcgtcaacgccacgcattacctggtgaagtatctggtcgaagaaggactgcttgaacttgatcccgaagtgtttacgctgccggtgttggccaagaccagtgtcgagatcaagggagcggtctacagcgcggaattgggcgctgagatgcccaccgatttgtcgaacctcgaccccgaggtatggcgaccaatccacaaagacattgatttgctagcgagctcagaacatgggtcacctgaagacggttcgtcccgcgagccagaggagtgagcatgtcggcgaccccatgagttcaaagttcggaggcatcccgtttgaagcggcgcccgaaccgagctggccctttggcctgccgaccgtagcggcccatagcagctactgggccgtgtcatcgccggaagagtcgatgtcaccacccaccttcaccccctgatcatcatgatgaaaccgacgacccgggccctgctttgcctgttggcaatcctgctcacgacaggactatttactgcgtgctcatcggggtcgtcgcccatggcccaaaaacacaccgcgtcgggcgcgccgtctggtgcaacgctaattccaggaggtccgatggaatcgacaccagccgccccgtctccgaaaatacctgcgagtcaaggagaagcgcagaagacagtgatccactacatccagcagaccgtcgatgccctgcccccgggaaccaacgccgacggaacccgctatgcgggcactggttcgggaatggcgtactgcgaggacgagccgaaggacgataattcgcctgttaactacgcttactggggtgatctgaaccttcccccgggcactgacgtcaacgccatgtacggtcaggtcgaaagcatttggaaagggtggggttggcaggtccttgagcgtcagggcttcgagaagcccaaccggttcggctacgctcccgacggttacgtcgtgcaaatcaaagccgcgtacccccccggctcgccgccgacaatcatcgggacatcgccctgcttcccaggcaatctccgaaaggagggggctcccattccgactgcgataaaccagacctcgcccgcaagataaaaccagtggatgccggtgtcaccgccagcgaccctcgctcagcggggcatcatgtacttccaccggacatcgcagtcgggaattagcacggcgctgggtcgaattcactagcgtcgccttctactcgtgctgcggatcgtccaccccattacctattgggtgaggaatggggtgaatcctagcgtgtgactttgcggcgcatctcggccgcatagcgcgcggaaatgcgcagcggcgggatgtgactgtagtcgatcttgcgcagttcggcgttgttggcctcttgctcagcccagatctccagaacatgcacagcaggaactgtggctgattgcgcttggacaccggaacaggcacatgtcgttggccactgcttgtagcgggtcgcatacccacatcgcgggcaagggaaatggaagtgggggacgctgtgtcccctaacgctcacaaccacatctgcctcccacgatctagctgtccccgcagcagtcgttccggtctctgcgctacacgtacgcgagcttgtgcctcgctgcgcgcatccggcctatcgacatcgcggagcttatggggcaccgggacgtcaagacgacgctgactgtctacgcgcacctgatcaacactgacgatcacaccggcaacatggccgcgctcgggtcgctagccgccccgttgcagaagcccaactacggcaatgtgatcccgctacacggctgaatcgggcggattgcggccccacacggcgcgccgatcaagcctcgtctgcagaggaacgaagggtcttcgacgcctgacgcctgtagaggcgaaccagcgccatgatcccagtgaggacaatggtgaataacgctgccgatgcgcctgattcgtacacgtcggcaagctggatggttttgccgccgcggaccgcgaagccgtcgggcggatggatcaggctggtgaagatctgggtggtggtggaaagccagaacaggcacggcagcagccagtaagtgcgggttcgggtgacagggcttccggggaatcgcggttcgacgagcgcgacgagctgaaagatcaaccagcccgtcagcagccagccgagaaagttgctcagcgggactcccagtgcgccggtcgggtggtcataggagtaccaatcgtgcgccgtcgccccgatggggtcatataccaggtcataacccccaaggatcaatgtcgccacgatgggcgtcgtaaagcgttcggcgccaccgacagccacaccgggaacgggccgcatgatcacccgggccagcgcccaggccagccagccgaagatgatccagctggcgatggccaccggggggacgcccagtggtttcgggccgggcaggtgatgggtgtaggaaccgaacgggaaaccggtcgcgacaccgattgcctccaatgcgaacgcaacaataccggcgatggccacgaacgcggccatgcctcgtgcggagtagcccagccaggcatggacgacgacaaacaaaatgagaaatcccatttgggcggccccggcttgcgcagccagcgacgggcgcaccgccatgaccaccgcggcgagcagcgtgaggacgagcaagacccaacaggatgccctgagaacctgccaccgtgcatccgtttggctaggcgatcgcgtcagcgtatcggttgccaccgctgtgtggtcttcactggtcatgtttgcgcaccctcagccatgctggtcggcgcgctcgacgcacgccgagttttctggcttacgttatcgcccgagggcgcggatctcagctattccggcgacatgaaataaggccgatgctcgtggtatttcacccccgaactaagggaccgttaggagacgacggcattgggtcagcaccacaattacggcaacgtcgtaccgctacacggctaattgctagcgacctccacgcgaggaacgtcttggccaggccgacttttgcggcaatctgagcatcgcgaatgcgcacacccgttacggttggtcagcatcgccatccctttggtcgggacatttacgtaggaaggtcgggctacgtgactgaagacgcaatcagcatcggtggtgtgaaccttgctgatccagacacgtatcgcgcgggtatgccttacggagctttccgcaagcttcgtgagcgtgcgccggtcgcgtggcacccgcagaaggatggctcggggttttgggccttgacgggttatgaggagatccacgccgtttccagggacagcgcaacgtggtcgtcccagataaatggggcaatgttcgatgctccgcctcccggcgaagttcccccggtgatgattttcatggatccgcctcagcacaccgcgttgcgtaagctgatcaacaagggcttcaccccgcgccaagtcacgcggctgaacgagcacatcgttgagatggcgaagcaaatcgtcgacgacgtgatcgaacgaggcgaatgcgaattcgccgacgatgtcgctggcgcactgccgtcctatgtgatcgccgaaatgctcggcattccgctcgaagatggtcggcggctctaccaaattaccgagatcttgcacacgggctccgtcggtgacagcgacgacgagcggcaacaagcgatggtcgagatgtttcagtacggcgtagaactcgccgtgcgcaagcgcgcggagccaggtgacgatatcgcgacttccttactccacgccgaggttgatggtcagagcctcagcgatttggaatttaacctgttctttatgttgctgatcgatgccggaggtgatacgacccgcaatcttgtagcagcgggaattcttgctctgcttgagcatccccaagaactgcagcggcttaaggcagacccttcactcatgccgaccgcgatcgaagaaatgctgcgctacacgtcgccggtgacggcattcctgcgcaccgcgaccaaagacactgagttgcgcggggtacccgtcaaggccggcgaacgggtggcaatgttctacccgtcgggcaaccgcgacgatagccacttcgccgaccccgaccgtctcgatgtcggccgggcgccgaatcctcatctcgccttcggcggaggcggaacacacttttgtctcggcgccaaccttgcacgcgtggaagcctcggcgatggttcccgaggtcctgtcacgcatgaacgaccttgaactcgctgggccggtcgaacgattacgttcagacctgataaacggcattcggtctatgcccgtccgcttcacccctggcaaacgtctcggcaccgcctgacaccgccggcgtaagggctgtctcctggcggtgagacgtgattcgcgcggcaagggaccgttaagggatcgccccggcccgcgagcgctacggcgtttgccgccctgttcgtcgtggagccgatgacgggaatcgaacccgcgttctcagcttgggaagctgatgttctgccattgaactacatcggcgcggtcgcgtcagaaggctagcatccggcgccgcggacgctcacctgcctgggtcgtcgcggccggccgccaatcgcccgtcgcattacgccttaaaccacgcatgcacaatatcggccggtcggcgaaatgcccgtgtttattatttcgtgattgcgccgtaatgtgctgggcgtgggtcgacacgcattagccaggaagcgacgcaaaccgtcggcgaccctggctgcggtgctcgcgcccgctgccgtcttcttcgcggtctcggccgatgttcatccattcgcggagcgcgagacagccaaacccgttatcaacgagcccgctccgtgttgcgcggaaatcgtgaccttggcatcgacgcggctcagtaagggattcggcgacggccagcccgtcgccgcctcgcgctatcacacccgctcccgcttcctgcccgccggcgtggcgccggaacggggcctgcaggtgcgcaccatcctgaccgcccgcagcatcagcgccgagttcccccagatccacgagatcgggggagtgcgaccggatccgctgccctggcaccccctcggcatggcgatcgacgtgatgattcccgacccggaaagcgcgcagggcatcgcgctggggaacgcgatcgtggcctacgtgctgcagaacgccgaccggttcggaatccaggacgcgatctggcgcggcgtctactacacccccaacggcgcccaaacgagccggctcggtcactacgaccacgtccacgtcacgaccatcggcggcggataccccaccggcgacgaggtctatctccgctgaacgcgctgcgcagcagttaggctcgcttggtgctgctctccgatcgcgacctcagggccgaaatcaccgccgggcggttgggcatcgagccgttcgatgacgcgctggtgcagccgtccagcgtcgacgtccgccttgactgcatgttccgggttttcaacaacactcgctacacccacatcgacccggccaagcagcaggacgagctcacctcgctggtcgaaccgcaagacggtgagccgttcgtgctgcaccccggcgagttcgtgctcggctcgacgctcgagctcatcaccctgcccgacgacctcgccggacgtttggagggcaaatcgtccctgggccgcctggggctgctgacgcactcgaccgccggcttcatcgatcccggcttcagcggccacatcacgctcgagctgtccaacgtcgccaacctgccgatcacgctgtggccgggcatgaagatcggtcagctgtgcattctgcggttgaccagtccggccgaacacccgtacggcagcactcgcgtaggttcgaagtaccagggccagcgaggaccgacaccgtcgcgctcgtaccagaacttcataacgtctacataggttctgcggggctctcacgccaccgttctgcgcgatacttagttagccgtggttttttcctccgcctggccgtggcgattgcgcaacacctttggaggggtttgtcttgaatatcgtgctcggggtgtcgatggcaccgtcttcgatccaaatggtcgttctggaaggcgaatacgccgatggcgcgacggtggaagaggacgcgatcgatgtcaccggcgccgatgacgcggccaccgcgagcgccccggatcgggtgatctcggccattctgggcacccgggagggcgccgccgacgccggcctgcagctctcctccatcggggtgacgtggaccgatcaactcgaagccgcggccctgcgcgacgcgttggcggctcgccggatcgacaatgtcatgctggtctcggcgtttctggcggctgcggcgctggcgcaaaacgtcggcggcgcaatgggttacgagcgcaccgcggtgctgctggtggaacccgataccgcgaccctggcggtcgtcgagacctccgacggttccatccccgatgtctacaagcagcagattcgcgccgagtcctacggcgacgcggccgggcagctcagcgcgatggtcgccgggctggagaagctggagtccctgccgggcgggctgttgctcgtcggctcgggcgtcgacgtcgctccgctcaagcaggtgctgcagaccacgacgttcctcgacgtgagtgtggccgaggagccggagaccgcgctggcccgcggggccgccctggccgcggcgaacgcgccgctgttcgcgtcgtcgacggcggcgctggcctacgcacaagaccccggcaccggcgctgtcgaccagtactcgctgcccgactacctctatgtccccgtcggtcccgagcccggcgacgacgaactcgcctacagcgcggtgggggacgaggacgccgagtcgccgaccgtcgtcatcgagaagctgttccttcccgaggacagtgagccgcgtcgacggccggtcctgctggtgggcagcgggctggcggtggtaggcatcagcgcggtgctggcgctggagatcgcgttggcgatcggcatccgtaccaccggaaccgtggcgttgcaacctactccgaatcaacatctgatcgttcccaccgagcaggcgccggcaccgccgccggtgcaggcgtcggcaccgcagcccaagatcagcgtgcccgagccggtggcggcgcccaagccgttgagcctgccggtcgccgcgccgttgccggccgccccgccgccggctgcgccgccgcttccggaggcgccgccgatccccgcggccccgccggtggtgccggtcccggtggtggtcccgccggtcccggttccggtgccggtccgcatcccggtgcccgatccggtcagcccgccgcagctgctggcgccgccgcggctgtcggttccacagccggtgcaaccgccggtgcgcgtcccgcagccgccgtcgcctccgcaggtcggcggcactgttccgcagtcaccgccgcagcaccagaccccgcccggcgaaggcacgccgcccaagccggacagccccggcaactacggcggcggtcacgcgcccacccccggcgccggcggttcgggtggctcgggcggcggtcacgttcccacgcccggtgccggtggctcgggcggcggtcatgttcccacgcccggtgccggtggctcgggcggcggtcacgttcccacgcccggtgccggtggcccgggcggcaccggtggatcgggtggcgggcacgttccgacgcccggggcgggtaccccgggtggctccggtggcggtcaccttcccatcccgggcgcgggcagcactccgggcggctcgggtggcggtcaccttcccactccaggtgccggtacgcccggcggcggcttgggcgggttcggcggtggccacgccccggcgcccgggggcggcctgggcgggttcggcggtggccacgccccggcgcccggcggcggcttgggcgggttcggcggtggccacgctccggcgcccggcggtggcctgggcgggttcggcgggggccacgccccggcgcccggcggcggcttgggtggctccggcggtggtcacagcggcggcggcctgggcggactcggcggcgggcacaaatagccccgcgccgaccactccgtcgacccgcgccacgacgcaggccgagatcacacgagtagggttgcggtattgaggctggcgaaaagacgccgcctcgtccgccagaatttcatcaacctagcaaacggcttgggttgtgagccgggctcagctacggcaaggaaattcgtggcgcacgcgcaatagggatgctgcccggagggcgcgtcgggcagcgcagcaaatggggcagggggctagaagcagtggcgggcatcgtgcttggcgtcgcgatgacgccgaccaaggtgcgcatggttctggtcgaaggcgaaagcgccgacggcgtcactgtcgacgaggacgacttcgacgtcgacacccgacgaaccgccctccccggcaccgcccccgaccaggtcatttcggcgatcctgggcacccgggagggtgccgccgacagcggctaccagctgctgtcgaccggcgttacctggaccgatcacgtcgaggcggccatgctgcgcgacgccttgatcgcgcacaaggtggaaaacgtcatgctggtctcggccttcatggccgccgcagcactgacccaggccgtcggcgacgccaccaactacgcgcggaccgcgatgctgttcgtcgagccctacagcgcgacgatggcggtggtcgacaccgccgacggttcggtctcggaggtccgccgtcggcccctgccggaggacgaggaccaggcggtggccgaactcgtcgacatggccgccagcgccgagtccctgccaacccgtccggagggcctggtcctggtcggctccggcgtcgacgtcccgctgatcaagccggcgctggaggctgcgacgtcgctggagctgtcggtgccggacgagccggagatggccctggccaggggcgccgcactggcgtcggcgaacgcgccgctgttcgcgtcgtccaccgcggcgctggcttacgcgctggatcccggcaccggagaggtcgacccgctcgccctggccgggcagtcccccggcctgctgcccggctatcagcccgagtaccacagccgcattgcggcgcaggccgccgacgccggcgagggcaaggccaacgtcgcctacagcgcggttcccgatgatgatgccgaggccaagacactgatcgacctcgacgaacgcgcccggcggcgcaagtcgctgctgctggtcagcagcaccctgccggtgattttcatcgccgccgtggtggcgctgggagatcgccctggcgatcagcatccggcccaccgtcgcgttgcggcccagccccaacgagaacatcatcgcccccgccccggcgccgcccccgcccgcgccaccggtccaggcgcagccgaagatcacgccgccgcggccgctggccgcgccgcacccgatcgcaccaccgcccccggccccgccgcccatcgccgtccccgttcccgtcctttcgccgccggtgttcgttccgccgccgcgcgtgccgctcgcccgcccacccgcgcccggtcacggccccttcggcggccacggcccgttcggtgggggccacggtcccttcggcgggcacggtccgttcggcggccacggtcccttcggcgggggtcacggcccgttcggcgggcatggtcccttcggcggcggccacgggttcggcggcgggcacgggttcggtggcggccacggccaccggtagcgcggattccggctcgcctgcgtgtctgacccggcgcgctagggtggcggactagggtatggccgcggccagaactctcagcaagtcccggctgaccctcaaatcgcgagccccgacgcggctacgcagccacccggcacagcaaccgactttcggacgatttggaggagcggtggacgtcgtactcggcgtgtcgatggcgcctgagacagtccgcatggtgctcgtcgaaggagaatcggccggcgggctgaccgtcgatcaggacggcttcgacgtcaccgccgacgcaacccccgcggccgccgccaaccacgtcgtcgcggccatcctggaaacccgggacagcgcgacccagggcggttaccggctcaaatcgagcggggtgagctggaccgacccggtcaaggcggccgcactccgcgacgcgttggcggcccgcaagatcgagaacgtgatgctggtctcggcggtcatggccgccgcggccctggcccaggccatgggcagcgccaccaactgggcccgcaccgcactcctgctcgtcgagccgaccagcgcgaccctggccgtcgtcgacacccgcaacggaacggtcaccgacgtgcaccgccacccgctgccgggccatgacgacgccgcgctggcaaagctcaccgcgatggtgtcgggtgccgaatcgatgcgatcgcgacccgacgggctctttttggtcgggtcggatgtggacatcccggcgatcaagcccaccctcgaggccgcgacgtcgctatcggtgaccacgcccgaggaaccggagatggccctggcccggggtgcctcgctggccgcggccaacgcgcggttgggcgcgccgcggacggtcgagatggcgccgacgcacctctcgtcgaccgcgaccgcgccgccggcggccgaactcgcctacagcgccgacacgcacgacgatccggcgtccgagcccacccgcgaagggcgcagccccaagtcggtggccacgatcgccgcggtggcggtgatcttcgtcggcggcatcgtggccctggcgtgggcgctggcgttcatccggccgcacgccgaccagcgccccgaggtgggcacccaggtcgtcgcccccgacaacccgccgccgccgagcgccgccccatcgccgccaccggctgcgcccgtaccggcggcgcccccgccccaggctccggtgtctccggccccctcgccgcactccggcgaccacgagcactgggacgactggctgcatcgccacctgggcccgggagtcccggtcccctagaccggccccgcggaccggtgccggccccctccggctcaccccccggccgtcgatggcgcgtaaaatcggggcattaggggaatatcgggtggggactcagcgatgtcttgcgccatcatgtcgtgcgacgagcacgccctcaccgcgaaggactagcaaccgactattggaggagctttggacaccgtactgggcgtgtcgatggcgccgacggcagtccgcatggtgctggtcgagggcgagaacggcgatggcgccaccgtcgatgaagacaacttcgacgtcgccacaagcgaggatgcagcaactgtcaccgcctccgaccaggtgctttcggcgatcctgggaacgcggcagggggcggccgagggcggctaccagctcgcctcgaccggcgtgacgttcaccgacccggtcgaggccgccgcgctgcgcgacaagctggccgcccacaaggtcgaaaatgtgatgctggtctcggccttcctggccgcggccgcgctggcccaagcggtcggccaccggaccaactacgcgcacaccgcgctgctgtacatcgagcccgacaccgcgacgctggcggtcgtcgacagcgcggacggctccatcgccgacgtgcggcgccagcccctccccgaagacgacgaggcggcggtggccgagctggcctcgatggtctccaacgccgagaacctggagacccgccccgacgccgtgttcgtcgtcggctcgggcatcgacatcccgctgatcaagccggccctggaggcggcgaccacgcttccgctgaccgcgcccgaggagccggacaccgcgctggcccgcggcgcggccctggcctcggcgcacgctccgctgttcgcgtcgtccaccgcggcgctggcctacgcgcaggacccgggcaccggtgccatcaatccgctcgcggtggcgcccggctacttcgagacccccgccgacgccggcgccgacggcctggcctacagcgcggtccccgacgacccggacgagttcttcaccggcacccaggccgcggccaccgagctggtcgacgccgactacgcggaccgcagctcattcaagctggtgggcagtgcggtggcggcgatcttcgtcatcggtgtggtggccctggtggtgtcgctggcgatcgccatccggccgacggccaacgtgcggcccagcccgaaccagaacgtcgtcgtcgcacccacccgacccgcgccggcggccccggccccggccccggttcaggtggcgcccgtgcccgtcccggaggcgcccgcgccggctccggcggccccgccacccccgccgccggcggtcgcgcccatcccggtgccgatcccgttgccgatccccggcctgggtggtcccggattcggcggaccgcccggccacggcggcggtgacggcggcgggcacggcggcggtggcttccccggcttcccgggcggcggcggccacggcggtggcggcttcccgggcttcggcggcggtcacggcggcttcggccaccactagtaccgggcccaccactagtaccgggcccaccgctagtgccgggcagtgtcggcgccatcggccagctgtcatccgccgtttgcctgacgcttagcccagcgatgcaatcagctcatcggggccacctacaccggttgtatgcgatgcaccgtgttcggcacgggttacctgggcgccacccacgcggtgggaatggcggagctgggacacgacgtgctcggggtcgacatcgacccgggcaaggtggccaagctcgccgggggtgacatccccttctacgagcccggcctgcgaaagctgttgaacgagaacctggccgcgggccggctgcgcttcaccaccgactacgacatggcggccggcttcgccgacgtgcacttcctgggtgtgggcaccccgcagaagaagggcgaatacggcgccgatctgcgccacgtgtacgccgtcatcgacgaattggtgccccggttgacgacgtcggcggtgctggtcggcaaatcgaccgtcccggtgggcaccgcggccgagctgaaccagcgggcggcggcgctggcgccgcgcggtgtcgacgtcgaaatcgcgtggaacccggagtttctgcgcgagggctatgccgtgcaggacaccctgcggccggaccggattgtgcttggaatcaaacaggattcaccgcgcgcccaggccgccgtccgggagctgtacgggccgctgttggacgccggggtgccgttcctggtgacggatctgcagaccgcggagttggtcaaggtgtccgccaatgcctttctggcgaccaagatttcgttcatcaacgcgatctccgaggtgtgcgaggccgccggcgccgacgtcagcctgctggccgatgcgctgggctacgacccgcgcatcgggcgccaattcctcaacgccggtttgggtttcggcgggggctgcctgcccaaggacatccgggcgttcatggcgcgcgccggcgagctgggcgccgatcaggcgctgacgttcctgcgcgaggtggacagcatcaacatgcgccgccgcacccggatggtggaactggccagcgcggcctgcggcggctcgctgctgggcgccaacgtcgcggtgctcggcgcggcgttcaagcccgaatccgacgacgtgcgcgactcgccggcgctcaatgtcgccggccagctgcagctcaacggcgccgcggtcaacgtgtacgacccgaaggccctggacaacgcgcagcggctgttccccacgctgaactacgccgtctcggtcgaggaggcctgcgagcgcgcggacgcggtgctggtgctcaccgagtggcgccagttcgtcgagatggaccccgacgacctggccgaccgggtgcgggcccgcgtcgtcgtcgacggccgcaactgcctggacgtcacccgttggcagcgggccggctggcgggtctaccgcctgggcgcgccgcgaccctgagcgcgccggccgagcgtcacgccagcgtggcgccggcccgcgagcgccacgctggcgtgacgctcggcgccgaacgggagcgtagcctgaccggcgtggactatgccggagcgttcctcgacgaaaaccgcgcgttcgcggagcttttccgggatgccgacgagtcgacgccggtgcccacctgcccggactggaccctgcggcaactgttccgccatgtcggccggggtgaccgctgggcggcgcagatcgtgcgcgacaggctcgacagctacctcgacccgcggatggtcgagggcggcaagccgccgcccgatcccgccgacgcgatctcctggctgcacggcggggcgcagcggctggtcgacgccgtcgagctgaccggcgtccaaacgccggtctggacgttcctcgggccgcgcccggccaattggtggatccggcgccgtctgcacgagacggccgtacatctggccgacgcggccatcgccctgggccgcgagttcaccctgcggcccgagctggcggccgatgcgatcaccgaatggctggagcgggtcgcggttcaggcgggcggccagggcgcgccgctgccgctcgacaacgccgacaccctgcatctgcacgccaccgatcccggcctcggcgatgccggcgagtggaccgtcgcggtcgagcagggccgcatcgcctggtcgcacgagcacggcaagggcagcgtcgcgctgcgcggtggcgcaaccgatctgctgctggcgatcctgcgccgccgcccactggccgacaccggcgccgaactgttcggcgacgacgccgtgtggcagcgctggttggaccgtacgcctctctagccgcgcgaccacacggtaacttgcacaccatgaccacatcggagatcgccaccgttctggcctggcacgacgcgctcaacgcgtcggacctggacaccctgatcgccctgtccagcgacgacatcgagatcggcgacgcgcacggggccgcacaaggccatgaggcgctgcgcaactgggccgccgcccgtcggggaaccgcggaactcggccggatgtacgtgcacgatggtgtcgtgtcgtcgaacagaaggtcaccagccccgacgacccgggcgccgtcagcacggccgcctcggcgttccgcgtcgtgcacgaccgggtcacgtcggtgttccggcacgacagcctggcctcggcgctggcggccaccgaactgaccgaggacgacgccgtcgactagggccgatcaaggcagtaggagccacccatgcgcggaatcatcttggccggcgggtcgggcacccgcctgcatccgatcaccaccggcatcagcaagcagttgctgccggtctacgacaagccgatggtctactacccgctgtccaccctgatgatggccggcatccgcgacatcctggtgatcaccaccccgcacgacgcggccggattcgtccggctgctgggcgatggctcgcaattcggcatcaacatcacctacgtgacgcaggagcggcccgacggcctggcccaggcgttcgtcctgggcgctgaccacatcggcaacgactcggtggcattggtgttgggagacaacatcttctacggccccgggctgggcaccagcctgaggcgcttccaaaccataaccggcggagcggttttcgcgtactgggtggccaacccgtcggcgtacggggtggtggagttcagcgacgacggcatggcgctgtcgctggaggagaaacccaagacgccgaaatccaattacgcggtgccgggtttgtatttctacgacaacgacgtgatcgaaatcgccaagggcctgaagaaatccgagcgcggcgagtacgagatcaccgaggtcaaccagatctatctcagccgcggccggctctcggtcgaggtgatggcccgcggcacggcctggctggacaccggcactttcgattcgctgctggacgccagcgacttcgtgcgcacgctggagcgtcgccaggggctcaaagtcagtgtgcccgaggaggtggcgtggcagcagggctggatcaccgacgagcagctgtccgagcgcgcccagagcctgctcaagtcgggctacggcggctatctgctggacctgttggagcgcagccgttttcactaggctgatggcggcggcccgccgcgcccggcttcgccgcgcttgcgaccgccgctagaccgatggcggcggcccgccgcgcccggcttcgccgcgcttgcgaccgccgctaggtttggccagcaccgcggcgatcgccgtggtcaacggcaccgacagggccagcgccatgccgccgaccgccgagcgggcgatctcgatggccacgctctcgccggtcagcacgtcggtcagcgagcggttggcgacgctgaacagcagcagcagcggcagcgaactgccggcataggccagcaccagcgtgtagacggtgctggcgatgtgatcgcggcccacccgcagggcgccggtgaagatcgcccgccgcgagccgcccaggcgggccagctcgaacaccgtcgaggactgggtcaccgtcacgtcgttgagcacacccagcgagccgatgatgaaaccggccagcagcagcccgccgatggacacgctgccgaggtacgcgctgaccgtgctgttctgttcatccgagagcccggtgagatgcgccaattgtattgctgcccaggataatccggcggcaagcagcaacgacgacagggtgcccagcagcgcggcgctggtgcgcaggctgacgccgtgggccaggtagatgaccgcgtagaggatcgccaccgccgccaccagcgccaccgggaccgcgggcgcgccgtcgcgcagcgccggcagcaggaacgtcaccagcaccacgaaggcgaccaggatgcccaccagcgccagcagtccgcgccagcgcgccaccgcgacgatcaccaccgcgaacgcgaccgccaaaccgaccagcgcccaaccccgttcgaagtcgtagaaggcgtagctggtagcgccctggtcgtcgacctgccggacgatccggatgcggtcgcccaccgcgaatttcggttggccgggccccggggaggactccagcagcgtggcggcgccggcgttgggcccggaatcgatcgccacctgggtcagcacgcagcgcccggcacccggcagcgccggctgcggcgggccggtgagcacctgactgaccgacgggctgccgcagtcgcccaacccgctggacagcacgtgcccggcctgcgtgctcaccgcgccgccggccgcgttctgcagcggcatcgggatgtcgacgtgctgccggctgggccacagcacgatcgcgccggcggcgaccgccacgccgattgcgatcagcagcccgacgacgatgcgggcgggcaaccgatcgacgggggccgggcccgacggcaggccgtgggagtgggagtgcgtcacgcgctccaccgtagaggcgcccggctgggtgcttactgtcgatagccgaccaggaagttgcccagccgctcgatcgcggcggccaggtcccgcgcccacggcagcgtcacgatgcgcaggtgatccggcgccggccagttgaagccggtgccgtgggtgaccaggatcttctcctgcagcagcaggtcgagcaccagctgctcgtcgtcggtgatgtcgtagacctcggggtccagccggggaaacgcgtacaaggcgccggcgggtttgacgcaggacaccccggggatctcgttgagcttgctccacgccacgtcgcgctgctcgagcagccgcccgcccggcagcaccaggtcctcgatgctctggtggccgcccagggccacctggatcgcatgctgcgccgggacgttcgggcacagccgcatgttggccagcaggttgatgccctcgatgaagctgccggcgtggtccttgggtccggtgatcgccagccagccggcccggtagccggccacccggtacgccttcgacaggccgttgaaggtcaggcacagcatgtccggcgccagcgacgccacgttgatgtgcttggcgtcgtcgtagaggatcttgtcgtagatctcgtcggccagcagcagcagctcgtgcttgcgcgccagatcgaccatctggctcaggatttcgccgctgtacaccgcgccggtcgggttgttcgggttgatcaccaccagcgccttggtgcgctcggtgatcttggattccagatcggcgatgtcgggctgccagccctgcgtctcgtcgcacaggtagtgcacgggggtgccgccggccagcgaggtcgacgccgtccacagcgggtagtccggcgacgggatcagcacctcgtcgccgttgtcgagcagcgcctgcagcgtcatcgtgatcagttcggacacgccgttgcccaggtagacatcgtcgacgtcgaagcgggggaacccgtcgaccaactcgtagcgggtgaccaccgcccggcgcgcgggcaggatgccctgcgagtcggagtagccctgggcgtacggcagggcctggatcatgtcgcgcatgatgacgtcgggcgcctcgaagccgaacggcgccgggttgccgatgttgagcttgaggatgcggtgtccctcggcctccagccgcgccgcgtgctgatgtaccgggccgcggatctcgtacaggacgtcctggagcttggacgactgggcgaaagtacgctgctggcgatggtgcgcggacgagtgcacaggcagctggtgggttgtcacaccaccaatggtgccatcactgtccactgaaatttgctgtcaagcccgaaattgccagctcagcgcttgcccggtggacgcgccccgcgggcgatgcccagtcccttgaccggtggctgcgacggtgcgtcgtcgccattggtctgctttgccggctccgctttcggggccggttcggcttcggccttggcggcttcagcttcggccttgggtgcctcggccttgggtgccgccttcttcgcgccgggccgcttggcgcccgcggcgatgcccagccccttcaccggtgcggccggcgccgccggagcctccgtcttggcctcactggctgcctcggtcttggcttcggtcttgggcgcttcggtcttgggtgcctgggcggccggggcggacttcttcgcgccgggccgcttggcgcccgcggcgatgcccagccccttggcgggcgccgccggggcctccgtcttggcctccgccggagcctcgttcttggcctcggcggccggcgcggacttcttggcgccgggccgcttggcgccgcctgcgatgcccaaccccttgaccggcgcggccggcgcggccggtgccgcctccgccttgggtgccgcctcggcgggctccttcgtcgtctccttggccggcgcctcgacggtggccgtggccttgggcgcctgggcggcccgcttctcggcttccttggcggccgtgcccttttcgggcagcgacgccttgtcgtactcgagcgagcccagcaggatctgggcgacgtcgagcacctcgacgccggagcggccggcctcctcctgccggtcgttgacgcggtcggtgaccatcacccggcagaacgggcaggcggtcgccacggtcgcggcgccggtggccagggcctcgtcgacgcgctcgtggttgatccgcttgccgatgtgctcttccatccacatccgggcgccgccggcgccgcagcagaagctgcgctcggcgtgccgcggcatctcggtcaggttcgcgcccgcggcgccgatcagctcacgcggcgcctcgtagaccttgttgtgccggcccaggtagcaggggtcgtggtaggtgatgtcctgggacaccggggtcaccggcaccagcttgttgtcccggatcagccggttcagcagctgggtgtggtgcaacaccgtgtagttggcgcccagctggcggtattcgcggcccagcgtgttgaagcagtgcgggcaggtcaccacgatcttgcggtcgaccgtctccacaccctcgaacaccccgtccagggtttcgacggcctgggcggccagctgctggaacaggaactcgttgcccgagcggcgggccgagtcgccgttgcaggtttcgccggcgccgagcaccaggtacttcaccccggcgacggccagcagctcggcgacggccttggtggtcttcttggccttgtcgtcgtaggcgccggcgcagcccacccagaacaggtattcgtagccgtcgaagctgtccacgtcctcgccgtagaccggcacgtcgaagtcgacctcgtcgatccagttggtgcggtcgctggcgttctggccccacgggttggccttggtctccaggttcttgaacagcaccgacagttccgacgggaactccgactccatcatcacctggtagcggcgcatgtcgacgatgtggtcgacgtgctcgatgtccaccgggcactgctcgacgcaggcgccgcaggtcacgcacgaccacagcacgtcggggtcgatgacaccgccctgctcctcggtgccgaccagcgggcgggtggcctgctccgggcccgagcccatcacccggccgaagcccgactcgggcacgtggtgcgcctcggcgtgcttctcaccggacagctcctcgccgaccccgccctcgggcgtgctctccagcggggactgcttgtcgcccaggatgtagggcgccttggccatccagtggtcccgcaggtccatgatgaccagcttgggcgagagcggcttgccggtgttccaggccgggcactgcgattggcagcggccgcactcggtacacgtggcgaagtccagcatcgccttccagctgaagtcctcgaccttgccgcggccgaaaaccgcgtcgtccggcgggttttcgaagtcgatgggcttgccgtcgtattcgatcggcagcagcgggcccagcccgttgggcagccgcttgaagacgacgttgatcggcgccgtgaagatgtgcatgtgcttggagtgcagcacgatgatcaggaacgccagcatcaccgcgatgtgcgccagcagggccgcggtctcgatgtactcgttggcgggctggcccagcggccgcaggatggcgccgaacagctgggacaagaacgcgcccttgccgtagggcaacgtgccgttgttcaccgccgaaccgcgcaccaggacataggtccagatgacgttgaagatcatgaacagcaccagccaggcgccgccggtgtgcgagccgtagaaccgtgacgagcggccgatctcacgcgggctgcgcatcaaccggatgacggcgaaggtggcgatgcccaggaacacggcggtggcgaagaagtcctgcaaaaagcccagcgcgtcccagcgcccaatgatcgggatgtggaagttgtcctggaacagcaggccgtaggcctcgatgtagaccgtcaacaggatgaaaaagccccacatggtgaagaagtgggccaggccggggatcgaccacttgagcaggcggcgctgcccgaagacctcggagacctccgcccagacccgcttgccggggtcgtcggtgtgccccggggccggcttgccggacgtgatcagcttgaacagccacagcacccggcgtgcggcgagcgcggccacgatcagcgtcatgcccatgcccacgaccagtctgatgagcatctgcgttgtcacagaaggtctccccaatgcatagaaaattcggcctgtgctttatttgcctgcttaagccccgctcatagttacatcttcgtggctttcggcgcgagaaaggctgccctaacttgccgctcgtcggcgcccctggcctgctgcgttggtacccgcccgcggccatgtgacgtttgtcggagtgatcgacgccaccggcttttcgccgaatgacctttaccgggcggtgttaacggccgaaaggtggttgaaagatcggcggaatcgggcgcacccgggtggtcgtcgacgccgcgctggtggtgctcggctgcgccgtcgtggtgggcgcggcgctggtcgtggtcgtgctgctcggcgggggcgtcgtagttgtcgtggtggtcgacggctccggcggcgctgtcgtggtggtggccgggggcggcggcgcctcgctggacggcggtggcggcgccggcacgacggtgacggtggtgctgtcgttcggcccggtgatcgtcacggtttgcggcggggcgggcgtgctgggcggcgacgtgggccggtcctgggtggacttggtgagcagcaggttaatcgccaacaccagggcgatcagcaccgccgcgccggccccggccacgctcaacaccagcgcggtgcgcttgtaccagggcagcccgcccgccgcggcgtcgtcgaatcgtcttgcctcactggcatattcgccggtggcgtcgcggccggtgtagggcaccggctcgtcggaggtgtcggcgtcctgcgaccacgccagggcgtcgtccacgtcggtggcctgggcggcccaggcggcctgggtcatgtcgagcccgccggcgccgaccatctcggtgggtgtctccaccgcggcggcggcggcggccgtcggagcggcccccgacgcgtattgcgcacccagcgtcgccgcgcccagcgcggcgctcaatcccggctgcgcggtgctgtgcaccggcaccccgaaccgtcccgacaaccgcgcggtgagcagcgggatgctcgccccgccgccgacgatcgccaccccacgcagagtggagttaccaatcccgttgcgccgcaacgcttcctggcaccaatccaggaaccggtccagcggtgtggagatcagttgctcgaactccgcgcgggtcagctgggcgccctgtccgggcgccccggccaccgtggccgccacggccgtcgacagctgctccttggcccgacggcaggcgccgagcagccggctctgcgacccgatccgcccggacccgcccagcatggcggtgctgacgtcggaggccagcaggtggtcgaggacgagctggtcgatcgcgtcgccggagaagtcggtgtaccgcagcgacgggccgaccggcgcgaagccggcccggccgtccatcagggtgacggtggtgccgccggcgccgaagtcacacagcgcaatcacgccgtcggacgggaatcccggcgtgccgcgcagcatcgcgagcgcggccgtggcgtcggaaaccagcatcggcgccaccccctcccgcgcgaggtcggactgggcgaagaactcctcgcgcagcgcggcgaactggtcgtcggaccagtaggcgggcaccgcgatggtgatcggcgccccgtagccgaccgcgcgggccatcgcctcgaccgcctcgaccgtcagcgccgcgcccaggtacttggtgccgtcggccgccaccagcggggcccggtcgccgacccgctcgacgaacccccgcaacaccagcccgggttcggtcaggttcgggttctcgtcgggcaggccgacttcggtgggccgctgctcgaacagcgtcagcaccgagctgcggatcaccgggacgctgccggcgcgggccgccaccaggttggccactccgatcgacagtccgagcggctcgctcatgtcccgcacccctgtgtcagtcgtcggttggattgcagcgagtgtagggcgccgccccgcggcctaacgcagacccggcggcaccgtgatgacggtcggcacctgcggaatggtgatcaccggcggcagctgcggcagccggtggtgatgcgacggctgctgggtctggcccccgccgggctgctggctgggctgctgcgccggcggctgttcggcgctgctgccgggcgaggtcgagctcggcgtggtggtggtggttgtcgtcgtcggtgtcgtggtcgtggtggtcgtggtggtcgtgctggtggtcgatttgggcacatggctgacgccctgttggccgccgatgagctcgatgacgccgaagacgatcaggccgatcaggacgacgacggagaccacccaggcgatcagcatcgcgggccggcgataccagggggtgggctcagcctgctggtcgaacgggtcgacgttgccgggttgctcgaacccctcgggccggtccggcgggaagccgggcggcggcagctcgccggtgggcggctgctggctcatgccgaagtcggcatgctgcgtgagctggttgtggaactcgtcgcgtgggccgttggatgccacggcaccgatggtactgaccgcacctgccaatccgctgatgccgatcggtaaccggggcgtcgggacgcgcaccgcacaccgtcgatcctgacccgtgtatcgggtcggctcacgtctgcgactgtggcgcccgacacacccgtccggcggttcgtgcgtcgaatctcgttctggtacaatataactggcttcgtcgcttgatgacttcaccaagtctgcgacgggcacgctttccgcgtcaatgcgcagcgagccgaccggaaccgctggtcatgcgagcaccttgaccgcgcccgcgaccactacacaaccgcctcccggtagcgccaccggtgatgacatcgggctgtcgagaccgtcggaaagcaacgccgagcaaccatccgagcacacgcccaaggagacgatgacgatgcccgggccgacccggcaaacgcctatgctccgcgatgaccaccagctctgctagtgcgcgacgacgactcggcaaaccggtggtcaggggtccgcgaggctccgaccgcgccgagtcggcaactgacgggtgccgtggtgatcatcgcgctggtcgccgcgatctcgggcatgctttacggctacgacaccggcgtcatctcctgggccctgctgcagctcacgcaggacttcaacatcaccgagggctggcagcaggtgatcgccgccagcatcctgctcggcgccgtcgccggggcgctgacgtgcagctggctctccgacctgcgcggccggcgcggcacgctgttgatgctggcggtggtgttcatcgtcggcgcgttgtggtgcgccgacgccgcagattccgtgatgctgtcgctgggccggctggtgctggggttcgcggtcgggggcgcgacgcagacggcaccgatgtatgtcgccgagctggcgccgccggcctaccggggacggttggtgctgtgcttccagatcgccattggggtgggcatcctcaccgccaccctggtcggggccggcggctcgatctcttggcgggggccgatcggcctcgcctgcgtgcccgcggcgatcatgctgtggctgctgctgcgcctcccggaaagtccgcgctggctggtcaaaaaggacaaccgagacgccgcccgcgccgtgctggaacacgtccggcccgagggctacgacgtggccgccgagctggatgaggccaccgaactcgcccgcgtagaacgcacggccgccacccgcgggtggcgcgggctgcgcgacgcctgggttcgcccggccctggtcctcggttgcggcatcgcggtgttcacccagctcagcggcatcgagatgatcatctactactcgccgaccatcctgaccgacgacggcgtgtaccggtccgtggcgctgcaggtgtcggtgtgtctgggcgcggcgtacctgatcgcccaactggtcgggctggccatcatcgaccgggtcggccggcgccggctcaccctcatcatggtgccgggcgcggcggtcagcctgttcgcgctgggcctgctgttcatcaccagcgacagcggtcgcgacgtgatcccctacatcatgatctgcctgatcgccttcatgctgttcaacggtggcggcctgcagttgatgggctggctgaccggctcggagacctatccgctggcggtgcgaccggcggccaccgccctgcagtcggccaccctgtgggggaccaacctggtgatcaccttgacgatgctgtcgctgatcaaggcgatcggggtcggccccttgatgtggctctacgcgttgttcaacgtggcggcctggatcttcgtgttcttccgcatgcccgacctcaccggcaaaacccttgaggagatcgaataccagctgtccgaggggaaattccggccgtcggacttcggccgctgacgaatcccgttgcgcggcaacctgatccgcggctcagaacgtgttgaccttctcgatgctgacgaacctatctggacgtttggtgaaccaaggtgtgttgagaacgttggctctgatggttgccatgaattgccgctaactctgctgcggacgattgctgatacttgaaccgccaaggtgcggatcccctcgcgaggaatctcgttgaattgggtggcttgaaagtgaagccgggtctgctcagcacccagggcgatcgcagcatggaacctcgaaaccgaggcaggacatcacgatgccgcgctcggggctggccatcccggagagggcggcagcgtgggaaagtcggtgcggggatattcgccgccacgctggaggtcggggtgttggggagctttggcgaggcaggtgtttctgtcttcgatggcatttggccattcgtccccgactccggactgggcgaagtagccgccttgatggctggtgatccgccagccgttgaagacgtcgacggacggtgagcgggccggtccccgctggggggattctggtcctggcttagcgggggctttcatcgtgatccgcagggggtcgatgcctgaatacggtggtggcttaccgatattgggttcgtaaccgttgcgggctggttgggctgtgccaaacgtgtattcgcaggccaccactgtcacgtcgcggtcggccgtcgtgacagacaggatgtgcacctggacggtgccgatccattgttgttggggggcgttggttttgggccacagagattgggtgccgatggggtggttgatggactggttgggatcgacagactgctggaagccgggatacaagtaccggttgtcacccatgatggaggcgagcaggtaggactcggtgtaggcacgcaccggcacagcgggtcccgcggtgacgtcaatgccgggctcggcggtccagacgaatgtgaagtcgttgagggccgccggccaaccggcaggaggggtagccggcgtcgaagacgcctcagaacggtgggcgcctgagtggcatccagctatcgagatcacggcgaataccacgcaggtggcaataccgccgaacttgcgtaacacattcgtcacttcgggcgtccctggtccgcgtgcggaacgccgacgacattgtcgtagcggatggccatccactcatccggagacattttttcctcgggcggcaatgcgattgcgtgcgatagcgcagggccaatcacgccgtcgtactgactagcagtaagcccggggaatttcgcccttgcttcgtcgagtgttgcgagtcgcccgtgcgggtgttgatcgtcgtacacgacgtacccgtccggaagctggacgttgtgcccggccgcgagcatcgcattggccattccttggtctgcgacgccgatgtccatcggttggatggggttctcgcctggtgcgctgggagccggcccgaggatgctgttttccagcccgtgtccgagcacgttgagtgcggggttggccacggtaccgacacctggcggtaacccggccacggtgcctagaccggtgagcccggcctcgtatgcctgtttcttcaactcgtattcggataactgttggtgatatccgtttacttcattcgcgtgataggcgttgtgagttccgacgtcgaccaggcccttcagagtcgcggcgtcgtaaagctgggtgtcgtaaccggaatgagtcggctcattgccgaaggcggcttcgtgagccacggcatgtgcataggcttgaccgttgaagtattggccggcggcttggtcgctattgaggactgagaagacgcccttggcgaccggcagcgcgccagatcgagtgtcgccctcgttgtctagggagtcgccgaatcctggcagtccgccggtcgtaccggcgatgttgtcgacgtaaggccccaaaccgtgggccatgccctgtacgagattggggttgacctgtccgagggtgtgattgccgggaaggttcaataggtcctgctggtggtgcccgatgtaggtgctgtaggcgtgtgcggtttgagcggcgatgcttgcttcgggtccttgggtcgcatcacccgtccaagaaaacagcgagctcaccgcctggccgtggtcttgccaggaatggtgtgtgaggttctgcaggaagcggtcatggtcgccggtggtcatggcgtcgtgcaccacttggtgatcaggtgatgccgccgataagacgttggaaaccgtggggtcgatgccggggttgaggtcgccaggaccgccttcaccggcacgccaaaacgggctattcatgagcgtcgatgcctgcttgaccatcccacggtccaagtcggtgttggcctggaaggtgtggttgccgtctttgacgatgtcagcgagctggttcaggtggcgaaggtccggtcgcggtgaattcagcagctgctgaacacttgtgggcaactggttggccccgcctttgaccatgtcggttccctgcttcgcgccaatgctcagcggggtctgagggaacatgagattcgggttgctcatcagctgcaacgaattgccgatcacgcctttctcgtcgcccaaacgctgttcggcggtcttgagcgcatccatagacatgccatgttcttgcgcctgtagttggctcaacaccgaagcctgctcggcggtcaacggcaccttcccggccagctggtcgggggtgatcgagttcaggacgccgttgacgcgggaagcggcccccttgtcacccgccagggcatcggtgacgtcttgtcttgcctggtcgggcgtttcggcttcatgggcgtcggcaccgaaggtcgatgtggggtcgtatccgtcgttggccaagttggtctgcgctttgcgaagggaactcgaatagctgtcgcgggtggcatgcagctggccgagcgcatccttggtgtcattaaccgcagccgttcggagagctttgataatcgcatgcagctcttgctggctcgccgcgtcggggtggtcccgcagatcctgctcggccaagtcgatcatgtggtcgagctgctccagctgaccttccaaggtggcgatctctgcagcaccgcttttttgcgcctcggacaatgcagcggcgatgttttccaagtcggcgccgatcttgggcaactgttcagactgcgcgccaagggatttgacggtccgctgcacttccgctgagctattgatcgggttggggccgccgtcctgatggttccaggcggcattgaaacgttgctgcgcctgcgcgaatgcatggtcggactcggcggtgtgacgccccgcgccgtggaaagcttctgccaaacgctcaatctgggccgggcggccggcctgcaaggtccggttgacctcccacggatcaccgccagccccggcaaccagctcggcgatggtgagatgctttagctgcatcgcatccccataccagttcgcggtgactggtcaaccactcccgttgcacatcggtcagggcagtaagccccggagcgccgccaacccctcccgacagcatcgccatcccttccgcgcacgggaaaaggctaccgccgcgagcttgttgaccaattcactttcggactgtgggcggcgcggtgctcaagccatctgctgcggacgcactgtggacgtcatctgcgaagtaagcccactacctcgtctttcaggcccctagaacgtgttgaccttctcgatgctgacgaacatgccgtgcttggtctggtcgttggtgaaccgggtgccgtcggcgttggcgacgatcgtccagccctgcgcgctgtaggtgcggtagtcgagcttgacggtcgggatggcgcccaggttgcccagcacccactgcaccttgccgccggcgttgatgctgacgccgttggcgtgttcaccgtcctgcagcggggagttggtgaacggcgcctcgcagccgacggtgtccttgttgatctggcagcgggtcgacccggatttggtctcgatgtagacgtagccgttctggtccggcggcagcgggatggcgccggcgggagccgagggactcgggggcggcagcgccgtcggcgcgggggcggcggtggccgacggcggggtggagcggggcgtggggaaggacggttcggtgggtccggcccccggggaggccaccggccggccgccgatcaccgtgctgcagccggacaccagcccggcgccgcccggcaggaccaccagcagcagtgcaccaccggccaggctccgccgggcattctccgataaccgcacctgccgctccccagacaattcagatcgcgggactcaggttacgcataccgcggcggtggtcgctgcggcgcggcgggcatcgatgcggcgccgatggtgaagttttatcgcggcgtgatcgacgcgtcgacgccgtcacaccacgccgtagccgagacgtttcgccgcaccggcgacccggccggccagatccggatgggcgaggggtagcgacaatctcggcctggccggcatcgcggatgcggccggcgggaacagcaccaggcatgggtcgccggcgaatcggctgttgtagcgcaggccgtcgagatgggggaatgcggctgtgatgtgttgcgcccattgctgagtcacggtgtgccgggccgtcgaaatggcgaacgtgccgccgacgcgggtggcccacgcccctcggctgtcagcggcgaggtcgaggacccgcagcgggcgggtgaaggacaagccggtcagataggggcggccgcgttcgcggtcaatggtccggtcgacttggtatgcctcgccgagtgcggcgcacggacttgacgctccgtaccaaacgccatgccgggcatgctcccccctggggagagggtgcgggtcgaaccgcagcaccggcccgaaggtgcgcaatgcattccacgccaagacgtgctcgcccgccgtgcgatggacacgccaccagatctcatcgacgccgatcgcgcgcatctcgtcgtcgccgatgccgagcgagcgcaatatgtgcggtgccggaggttccggcagcatggggtcgacggtcaagtcgcggtccaatcggcgatctcgatcagttcgagtaccggcccgacggattcaccgtgtaacagccagtcccgcaccgacttcggctgaccgtcgattcgtaaatcgggttgcgccgtcatgagaaagccggccaccgcggtgggatgcaggtccctagcgagcagagccggcagcaccgcgtccaggccgcggacctgtttgagcgtgaggggctcgtcgcggccgcggtcgacgatctcgaactggatcgcggggtacacccaggtgccgccgtcgtcgatagcccatagcgtgtgggcgaggcggcgttgcctcacgcgggagtcgttgacgccgagtcctttgctgacgtcggcggcgctgtaggccgtgccgtacagcctggccatatgggcggtgacgtcggctgcgatctccgcgtaggctccgggatcttcggtgaaaccggcgtcatcgagcagccgggcctcgtcggtggtcagcgtggccgcccacggccggtgcgcggagagcgttttaagcgccgcgatcaggtcggagcggcgcaagttgaaccgatcgagcaagagttggtcgagttcatcggtagacatcggcaagccttcgcgcgcgctaacggaaattaacagaattctatcaccgttagatggattctggctcgaacgatagcccccgggaacaagatgcgggcgcgcgccgttaccattctcgacaagttgagcgaaccggactcaatgctgggttgacagcccactgccctcacgggcaggcttgagcggggttcactcagcatagtgacaccacagcaggctctacataaccaggaggaatcactatggctcgtgcggtcggtatcgacctcgggaccaccaactccgtcgtcgcagtcctcgagggcggtgaccccgtcgtcgtcgccaactccgagggctcgcggaccaccccgtccatcgtcgcgttcgcccgcaacggcgaggtgctcgtcggccagcccgccaagaaccaggcggtgaccaacgtcgaccgcaccatccgttcggtcaagcggcacatgggcaccgactggtccatcgagatcgacggcaagaaatacaccgctcaggagatcagcgcccgcgtgctgatgaagctcaagcgcgacgccgaggcctatctgggtgaggacatcaccgacgcggtcatcaccgtaccggcgtacttcaacgacgcccagcgtcaggcgaccaaggaagccggccagatcgccggcctcaacgtgctgcgcatcgtcaacgagccgaccgcggccgcgctggcctacggcctggacaagggcgagaaggagcagaccatcctggtcttcgacctcggcggcggcacgttcgacgtttcgctgctcgagatcggcgagggtgtggtcgaggtccgcgccaccagcggtgacaaccaactcggtggcgacgactgggacgaccggatcgtcaactggctggtcgacaagttcaagggcaccagcggcatcgacctgaccaaggacaagatggccatgcagcggctgcgtgaggccgccgagaaggccaagatcgagctgtccagctcgcagagcacctcgatcaacctgccctacatcaccgtcgacgcggacaagaacccgctgttcctcgacgagcagctgacccgcgccgaattccagcgcatcacccaggatctgctggaccgcacccgtcagccgttcaagtcggtgatcgccgacgccggcatctcggtgtccgacatcgaccacgtggtgctggtgggtggttccacccggatgcccgcggtgaccgacctggtcaaggaactcaccggcggcaaggagcccaacaagggcgtcaaccccgacgaggttgtcgcggtgggtgccgccctgcaggccggtgtgcttaagggcgaggtgaaagacgttctgctgcttgacgttacgccgctgagcctgggtatcgagaccaagggtggcgtgatgaccaagctgatcgaacgcaacaccaccatcccgaccaagcggtccgagacgttcaccacggccgacgacaaccagccgtcggtgcagatccaggtgtatcagggtgagcgcgaaatcgccgcgcacaacaagctgctcggctccttcgagctgaccggaattccgccggcgccccgcggcgtgccgcagatcgaggtcaccttcgacatcgacgccaacggcatcgtgcacgtcaccgccaaggacaagggcaccggtaaggagaacacgatcaagatccaggagggctccggcctgtccaaggaggagatcgaccggatgatcaaggacgccgaggcgcacgccgaggaggaccgcaagaggcgcgaggaagccgacgtccgcaaccaagcggaatcgcttgtctaccagacggagaagttcgtcaaggaccagcgcgaggccgagggcggctcgaaggttcccgaggagacgctgtccaaggtcgacgccgcgatcgccgacgccaagacggccctgggcggcaccgacatcaccgcgatcaagtcggcgatggagaagctcggccaggagtcgcaagcgctgggacaggcaatctacgaggccacccaggccgagtccgcccaggctggcgggccggacggtgccgcggccggcggcgggtccggatccgccgacgatgttgtggacgcggaggtggtcgacgatgaccgggagtccaagtgacacaaggaaatcagaagacggaaggcaacccgccggaacaggtgacggttaccgacaagcggcggatcgatcccgagaccggtgaggtccggcacgtccctcccggcgacacgccgggagggacggcgccgcaagccgcgaccgccgagtcgggcggcgccgcgaccgacaaggtcgccgagctcaccgccgacctgcaacgcgtgcaggccgacttcgccaactaccgcaagcgggcgctgcgcgaccagcaggccgcggcggaccgggccaaggccgccgtggtcaaccaattgctgggcgtgctcgacgatttggagcgggcacgcaagcacggcgacctggagtcggggccgctgaagtcggtggccgacaagctggaaagcgcgctgacgggcctgggcctgaccgcattcggtgaggagggcgaagagttcgacccggtgctgcacgaagccgtgcagcacgagggtgacggctccaaacccgtcatcggcaccgtcatgcggcagggctacaagctcggcgatcaggtgctgcgccacgccttggtcggcgtcgtggacacggtcaccgaggaaggcgacggggaagccgcggccaccgacgagcccaccgccgcggccgccgaaacccgtccgcccgaatcggacgataacgccggcgcatccggtgactagatcacacaatcagcacattggaagacagaccaagagaaagtggtgagggggtgacgcggcatggcccagcgtgaatgggtcgaaaaagacttctacaaggagctgggcgtctcctctgacgccagtcccgaagagatcaaacgcgcctaccgcaagctggcgcgcgatctacacccggatgccaatcccgacaatcccgccgccggcgaacgattcaaggcggtgtccgaggcgcacaacgtgttgtcggacccggccaagcgcaaggaatacgacgaaacccgaaggcttttcgccggaggcggtttcggcgggcgccggttcgacaccggtgggttcggcggcttcaacgtcggcggggacggggcggagttcaacctcaacgatttgttcgacgccgccggccgcagcggcggcaccaacatcggcgacctgttcggcggcctgttcgggcgcgcttcgggcggccggcccagccggccgcgccgcggcaacgacctcgaaaccgagacccagctggatttcgtcgaggctgccaagggcgtggcgatgccgctgcggctgaccagcccggcgccgtgcaccaactgccacggcagtggcgcacgcccgggcaccagccccaaggtgtgccccacctgtaacggctccggcgtaatcagccgcaaccagggcgctttcggcttctccgagccctgcaccgattgccggggcagcggctcgatcatcgagcacccctgcgacgagtgcaagggcaccggggtcaccacccgcacccgcaccatcaacgtgcggatcccgcccggcgtcgaggacgggcagcgcatccggttgcccggtcagggcgaggccgggttgcgcggcgcgccgtcgggcgacctgtacgtgacggtacatgtgcggccgcacaaggtgttcggccgcgacggcgacgacctgaccgtgaccgttcccgtcagtttcaccgaattggctttgggctcaaccatatcggtgcccacactggacggcaaggtcggggttcgggtgcccaagggcaccgccgacggccgcatcctgcgggtgcgcggacgcggggtgcccaagcgcagcggcggccacggcgacctgctggtgacggtaaaggtcgcggtgccaccgaatttggacggcgccgctcaggaggcgctggaggcctacgcggccgccgagcgcgccagcggcttcgacccacgggcgggatgggcaggtaaccgctgatggccaagaaccggaaaggacacgagtcccggacgttcctgatctcggtggccgccgagctggccggcatgcacgcccagacgctgcgcacctacgaccggctcggcctggtcagcccgcagcgcacgtccggtgggggacggtggtattcggagcacgacgtggacctgctgcgcgaggtgcagcggctctcccaggacgagggcgtcaacctggccggcatcaagcggatcatcgagctgaccaatcaggtcgaggcgctgcaggcgcgggtcaaggagctgaccgaggagttggcgcaggtgcgcgccggccagcggcgcgacctggcggtgctgcccaagagcaccgcgctggtggtgtggcagccgcgcaagggcgggacccgcacctgatcggacccgcatcgccacgcggctgaattcactccgccgatttgccgagcctgcgttatagtcggccggtgaccagcggagaaccgctgagcgggcggggcagcaaattagccacagcgggcgccgtgccgtgacggctccggtgctcgaccttgatgaccgggtgaccgaccggcagcgggagctcgcccggctccgggccgccgtcgacgcggcggcgcgcggcggcggggaatgcgtcctgatcagcggggtgccgggcgtcggcaagtcggcactgatgaaggccttcggcgtcgaggtggccgggcgcggctgtgtcttcgcctacggcaggtgccgggacggcgcgccggcgccgtacgccgcggtgcgcgacgcgctgggatcgctggtccgcaccatggcggcgacggccccggccgaacgtgaccgctggcgcgcggatctggccggcggggtgtcgccgatcgccggcgtgctcggggaactggtccccgacctgccgcgggtgctgggcgagaccgcgtcccacccggaactcgacgccacggattcccgccggcagctgcaccgcgccgccacccggctgctgtccgccaccgcgtcctaccggaccgtggtgctggcgatcgacgatctgcagtgggccgatcgggacaccctgctgctgctcgccgagctgttgacggtgtcgctgcgcgacgtgctggtcgtcggcgcgcaccgcgcgggcgggttcgaccccgccgcggcggggatcgcagcggagaacctcaccacgatcgagctcgaaccgctggcccgcgacgacgtcgaggagctgctcgccaccgtgtgcggcaaaagcggggagctgcccgaggtggccgccgagttccaccaccgcaccgggggcaacccgctgcaggtccgtcagctgctgtaccgggcgcagcgcgaaggcgcgctgctcccggtcggctccggcgggcccccgcgctgggacctgcgggtgctcacctcgatcgaggtttcggccaccgccgccgagttcctcggccgctacctcgaccagctccgctccgccgaccgggaggtgctaagcgcgctgtcgtgcatcggcggcgaattcgacctcgacgacgccgcggcagcggccgcgcggacgcccgacgtcgtggcccacgcgctgtgggcctgcctcgagctgcgcctgctcgaagccctcgacatgaccggccagcggatcagcaacgccatcagccgcgacgcccgctaccggttcagccacgaccgggtggccgaggcggcgcgcgcgggactgtcccccgacgagatgcgcgccgtgcacctgcgcatcggccggcggctgatcaccctcggggacgatcgcctgttcgaggccgcccgccacgtcggcgtcggcggcctcgccgtggccgacgaggccgaacgcacccggttcgtcgaggtgctgcggcgggccgcgcaccaggcccgggcgcaggcctcctttcccctggcgctcggatactgccgcgacgcgctggacctgctcggcgagcaacgctgggccgggcagttcgcgctgacccgggagcttgcgctcgacgccgccgatgccgcgctgcgggtcggtgacgtgccggtgctcaacgccctgctcgaggaggccgaggagttcctgcgcgagcccccggaccgcgcgcgactggcctacctgcggatgaagggcagggtagccgaaaaccgtctgcaggaggcgctcgagatcggccttgcggccctcgacgagctcggcgaacgggtggcgacccaggcgggcaagccacgcatgggcaacgcgatcgtgcggatgcggctcacgatggcccgctggagcaccgaacggctgctgcagctgccgcactgcaccgaccagcgggtcatcgcactgcacccgatcctcgccgaactgtgcaacatggcggtcctggtgcggcccaacctgttacccctgctggtgcgtaagcaactggagctcacgttggcccacggccacacgtcgtcctcgccgctggtcatcaccggctacgggatcatcctggtgttgctcggcgaccacgcgggcagccagcgcttcggcgaggtcggcatgctgctggcccagcgaccggaactccgcgaggcccgcccgcagacggtgttcatgtacctcgactacatccaccactggcgccacccgatccgcgacggcctgggcgagctgcgcgacgccgtcgaggaggcgctcgaccggggcgaccaggaaaacgccggattcctgaccgcggtcctgctctcccagtcgttctgggtcggccggccgctcccggagatcgatgcgctcgccagctccctcatcccgcacatccgttcccagccggtgcccagcgcgctgtgccaggccgtgcaacagctttgcctgaacctgatggggcgcagcgccgatcccttcctgctggccggcgagagcgcctacgacgagcggcaggtgttaccggcggcccggcagcagggcgacgaggtggccctgggcgcggccgccgccataaagcagggcctgcacttctggtgcggcgaccacgccggcgcggccgaggccaccacggaggcgatcgagcatctcggcgggttggccggcgtcgcggcctcacaactcgtccacctgatcggcgcgctcagcatgatccattgtgcgccaagggattctgcaaccatccggttcgtccgccaggcgctggcgtcgcaccgcaaatgggcagccggcgcaccggagaactacgcggcgccctacgcgctgatccagggcgcgtgggcgcgggcacgcgggcagcacggcaaggccgaacgtcacctgcaccaggcgatcgagctcgccgaggagcaccggctgccggcgatcggtgcgcgcgcccacgaggaggccgccgccctctacgccgagaccgggcggcagaccctgcgcgaacacatgctgcgctcggcctaccagcgctggctgaatctgggtttcgcggtgcgtgccgattggctggcccgggaacacccgtggctgctgcgccgcgatcttcggacgggctcggccggcatcgacccgatcggcgcccaccagctggtgcacgcgctgtcgggggcgcgcaccccggacgccttggccaacatcatcctgggctcggtcgccgacaccaccggcgcgggccgcgtcctgttcatcaccggcgaggcggacaaccagtcggtgcgggccatccacgatcacggagaggtcttgatcgtcgaagggccgtggacggaggtcccctaccgccgcgacatcgtgcgccgagtgatcgacggcggcgcgccggtgagcgtcgccgccgaccgtgcggcggcgaccaactccgtcctcgccgctccaatcacgttgcacgacaggacacttggcgtgatctatgccgagcagggcgaaccggggaggaatttcggcgccgatcacgaggaggcgattgccttcctgtgcgcccaggccgccgcgccgctgtggagcttccagctcgaagcgcgactgcgcgccgccgacgagtaccggcagtccctcatcgacgtgcaatccagattcgtgcccaacgaattgctgcgcatcctcgacatcgacgaccttcgccgtgtccgcaacggacaccgggtggaacgcgagatgaccgtgctcatcagcgacatccgcagctacacggccatgatcgaggacatgaacgtcgccgaggcgggcaacctggcgatgggctttttgcgggcggtcgaactcccgatcatcagctaccacggcatgattcaagacgtgcgcggcgacgagatcgtcgccgtcttcgagtccgaggccgacgcggtgcgagcgggactgggcatgctgcgctccctgcacgagcacaaccaggagcgcagggcgctgggctccgaggaactgcgggcgggcatcggcatcaacaccggcgcggtggcggtcgggctcgtcggcggggtgaaccgcatggtgctcaccatcattggcgacgcggtcaatctcgccgcgcgcatcgagagcaccaacaagcgctacggctccgccttgctcatctccgatcgcacctatcagcggatcgccggctccgaggagttcgacgtccgaaggatggagcgggtgatggtggtcaaccggcgccggccggtgacgatttacgaggtctacaacggggattcgggtccgctgcgcgccgcgaagcgggccgcgcaacccgcgttcgacgaagcgttcgcactcttcgacgcgggcgacgtcgacgcggcgcgtgccgccttccagcgctgccgcgacatgctgcccgacgacccgatcgcgccgctgcacctggcgcactgcgatgcggtggcccgcggcgagatgctgccgggccaggagatcgcgctgcagaacaagtagcgcgctactccatttccggggtagtgcggcaaagccctacgcgtttgctgggctgtctgccatgatttgggcgacaggcaggagggccgcacccatgtacctgaacgctgagcggttggccctcgccaaccaaacggtcaaagagacgttcgagcagtgcagcgtggcctggcaggccatcccgcactgggacaccggcgaccccagccagacgacggtgcccaacgacaacgtcaacccgccgaacaacttcctgccgctcacctcgctgcccaagccgttcgaggtgacgctggccgcggccatcgccccgactcccgacgaactgctggccaccgtcgtctactacaccgccaagctggccgccgatttcgacgccgcggtgatcccggggctcctgacggcgacgacgccgtcgcagctggtgcccgggatcagccccgcccagctgttgaccgcgctcatcgaggcccgagcgaaggtcgagaagggcggataccgggccccgtcatgtctgatcaccgacaccatcggcgtggagacactggccgcgagcaccatcgccaacgggtatgccggcaccgacgtgctgttgcctccggccaacatcaattcgctgcaacgcgtcgacacgctggccaccgatccacaggtccggggatggttgctcggacggcgtcagcgcatcgcaccgggagccgcggcggaggcctcgccgggcgaggaggcggtggaccttgccgtgagcgtcccgcccagtctggaggtcgtcggcgacacatccaacaacgccatcaagctcgacgtccgcctcagctacgccctcaggatcaaggacgaagccgggctcgtcgtcttccgcgcgtgatgacgtcgaccctgcctgacgcgcggcccgccgttgccgcgctgaacccgctcgaggactacctcgccgcgtgcaaacaagcctgcgaccgggagatcgtccggctgtacggttcgggtgagcgcgggtcgaacgggctgtaccagctcatcctcgactacccgctgcgcggcgggaaggcgctccggccggcgctgagcatcgccacctgcctcgggctcggcggccacctcgaggcgatactgccgaccgccgcaacgctcgagctctaccacaacgcgtttctcatccacgacgacatcgaggacgaatcatggtggcggcgaggcaaacccacgctgcacatcgactacggcgtgccggtcgcggtcaacgtcggcgacgccatgctgtcgctttcgctgcaacccctgctcgacaacgtcgagcgggtggggctggggcccgcgctgcgcatcctgcgtgccgtggccacgatgacccgcaagaccgtcgacggccaggcgctcgagctggactgggtgcactccaacacctggcggctcgatgacgccgactacctcgagatggtggaactcaagaccagctggtactccttcatcacgccgttgcaggccggcaccgtcgcggccggggcaacacccgaccggatggccccgttggagtcgctcgggcggcatctcggggcggccttccagatcaccgacgacctgctcaacctgcgcgccgacccgcaggagtacggcaaggagatcggcggcgacctgtgggagggcaagcgcaccctgatgctgctgcacaccctgcggcatgccgaacccggcgaccagcagcgcgcggtgcagatcctgtcccggcgccgcccgagccccgacgccgagttcgacctgaccgagctgctggaccggctcaccgccggcgggcaactgtccgtctcgggccgcaccgagatcgacgcccggctgcggcggcaccaccactcggaagtcaagagcctcaacgacattcgctggctctacgaattgatgcaccgggtgggctcgctcaaccacgcccgcgacgtcgccgtccggcaggcccgccaggccgccgccgtgctcgccggcctggactggtttccccgcagccggcaccgcgacatgctggccgccctggtcgattacgtgcacgggcgggcgcgatgaaccccgaggcactgatcggcatgctggccgaactcgagcggatccgcgagctcaccctcgacctcgtcgagcggcaggcccccgggttgaaccccgccccgccggccgacgccgacggcgcggagcgcgccgtgttcggcctgctgctcggcgcgcgccgtgcggtcctgggtaacccggcggccgcccgccgggtgcacgacctgctcgtcgccgagggccgccggtacgcgaacacgccgcgcggggcgcggctacgcgacgggttggtcgcctccgaagcggtggagaacctgcggcgggtctgggagatggtgagcctcaacgttctcggcggtcccgccgcgccgcacgccagcccggacgcctgggcggacctgctggcggacgcgttcatcgggcacgggctggacgatgctgtgctggctcggctgcggcccgaggggtacgcatgacgctcaccgatccccgcgacgcgctcgccgaccagagcgacttcatcggctatctggtcggcctcgcagggctggccgacgtggtgcacaccctggccggcgacggcccccgcgccgccgcggatccccgcgcccccgacgacttcgtgcacctgctgctcggcgtggcgagcgtcggtgcggggatcgcgcggctggccgatagtactgtggcacagtcttttccggccgccgggatggcatcgaccgcgcggtggttgcgatgagcacggtcctggcccgcagcgacttcctgcgcgccccgatgttggccaccgcccggcctgcgggtttcaaggagtggcatcacttcgtggtgcacggccggggcgtgcgactgttgatcaacttcagcttcaacaatgaagccttcggcgcggacggggcgcggctcaccccgcgggtgatcgtgatcgcgcgcgacgagcgctggaccggggcggtggcgcggttcgacgagcgcgctgtgcacgtctcggccgacctgggtgaactgtccgtcggtggcaaccggatgacgatcgtgcccgacggctaccgggtggcaatcgacttgccggacaaggacattcacggcgaattgcacttcacctcgaccagccggccgttcgtggtgcgcaacgagccggcgggcgagggacgggtcagctggctcttcgtgcccaggctgcgcgccgacggctggctgcggatcggcggcgcggaccaccgggtgtgtgacgacctggcctaccacgaccacaactggggccggttccggtggggcgacgacttcggctggacgtggggcaccatcttgccggccgagccggacgacccgtggtcgatggtgttcgcccagatcaccgaccggagccggctgcgctgtgtgtcccggtcgctgtacgtgtggcatcgcgacgagccggcggcgatattccggcacgcggcggtgcgggcgcgcaccgagggcccgctcgaccggccggccgactgcaccctgcccccgccgatgcggctgctgctggacggcgaggtgcccggtgtgccggaacggatcgagatcaccgcgacacgggccgccgataccgtgcgcgccgaattccgttcgcgctcctatgttcgcctggcgcaaccgagcgaaacccgcctcgaccgatcgaccgtgctgtgcgagacggacggcaccgtggcggcgagcggcacggtgcggggcgagaaattcgacttcgccggcacgggtgtattcgagttcctccatggctgaacgggtttcgtcgctgctgcggcgttcggtcgagcacctgcacgacgaggtgccggcaagctaccgcgtgttggtcgccgagctcggcgagatggtggtcgggctcgacgtggacggcgaggcgttcaccctgtgcggcggtgatcggctggacgtgtcggacggggcgccgcgcgaggccgccgtgcgcatcgtcacctcgcggaacaccatcctggcgctgctcgacgcggaggtcgggctcggcgaggcggtgcaggccggcgccgtgagcgtgcggggttcgctcgacgacgtccagcgcgcgcacgacgcgctgcgggcctacgtgcacgcggccgtccgggcctccacccagcccgcgctgctgtccgaactgcgtgcgggcgcatgagcgagcacatccggaccccggcgtcgctggcacgacgtcccaccgtcgcggtgctcggcgccggcatcgccggactcaccgccgcccacgaactcgccgagcgcggcttcgtcgtgacggtgtacgaggcgcagcaggacgaacgcaacgggttgggatccgagccggccggagcctacccgcccgtcaagctgggaggccttgccgcgtcgcaatattcgaccgtgggcacccacgacgggagccacgccgaactgcgtcccttcccgggccggcccagccggcccaccgacctggggcgcgccgtcgccggcgaacacggcttccgcttcttcccggcctactacctgcacatctgggacctgttccagcgcatcccggtctacgagctcaggaacccgggcggctgggcgccgaccgcgcgcaccgtctacgacaacgtccggcgggtgatcacccagggcgtcaccatcgacggcaagccgtcgctggtcttcccgcgcgaactgccgcgcagcggcgccgaattcctcggcatcctcggccaactcgcgacggtgggtctcaccttcggcgatgtcgcgacctttcagggcagaatgctgcgctacctggtcaccagtccgctgcgccgggcgcgcgagttgcagaacatgtcggcctacgacttcttcgtcggccacgatcgccgcaccgggttgaaccagtactcctacacgccgcgttgcgacgcgctgttgcggcagatgccaaaggttttggtggccttcgactcccgttggggtgacgcccgcaccaacatcagcacctatctgcagctgtacctgaacatggaccgccgcgacgacaaggccgacggcgtgctcaacggtcccaccaccgagtcgtggttcgaccactggtaccgccacctcgtcgcgctcggcgtccgcttcgtccgcgccgcggcgacccgcctcgacccggtgcccgtcgacccgagccggccgccgcatctgcggccccgggtgcagatcacgctgaccgacggaacgcgggtgacaccggattacatcgtggtcgccgtcgacgccccgggcgccgaattcctcaccgccccaatgcgtgccgcgggcacgggcggcaccgtggccgggctggacggcttcgccacctccgtcccgccgcccgacggcccgctgcagccgcaatcgacgcggccccggcagcgccgcgatccctactcgatggacgagttggggcgggtgccctgggatcgtttccaaacgctgtgcggcatccagtactacttcgacaccgagttccagttgctgcgcggacacctgctctacgccggcaccgaatgggcgctgtcgtcgatcaaccagaccggaatgtgggagaggccaccgattctcgatcgggacggccacgtctcggtgctctcggtcgacatcggcgatttcaacgccgcgtcctcgcacctggtcgacgagtccggccgcggcaaggcggcccgcgactgcacgcccgacgagatcgccacggaagtctggcggcagatcgttgccgcgctcaccagcagcaccgggccggcgggggaggagttcatgccccggcccgtgtggtacgcgctcgaccgcggcctgatcatggaatccgggcccggtcagggccggggccgggcggtgcgcaacgcgacaccgtatctggttcccatcgtgggggattgggacaaccggccgagcagcgacccgtggaacccgcacggcacgtcgtggagcagcgtgccgcccgaggactggtggctcgaggatctgtggcggcgcaacgtctggcaggctcgccacggcggctatcaggtgcacaacaatgcggtggtcttcgccggcacgtggaacaagacgttcacccggttgacgtcgatggaggcggcgtgcgagtcggggcgccacgccgtcaacgccattctcgaccactacatctgggtccaatccggcggcctggaccgccgcgagaagaccacgctctcatgggagttccccttcggcttcctcgaccagggtctgtcgagcccgatccggatgcccaccccggccggcgactattgctatgtgttcgatatcgaaaaccgcgagccggccgacacccgggcgctgcgcatcctcgactccagattctgcgaatggtcgctgccgcacccgttggacgtcggcgcccccacgtccttcatcccaccacccgcgggaggtcaggaaatgttcggtcccacaacggattacaaccagcagttgctcgcctatctgcaggcgtggcgcgagctgctggagcggtggacggccatgagcgccgccacgccgtcccccgccgcgccgttcacgccgcccgccgcgccgttcacgccgccgttcatgccgcccgcggctgcgccggcgccgatgccaccggcaccggcggactacacccagcagctgttcggctacctgcaggcttggcggcaatacctcgaacagatggcgggcgcatcctccggatcggcgcagcagccgaccgcaccaccgaccgcgccaccgacaatgccaccgacaatgccaccgccgccgccgccgccctccacgccatcgaccggcggtcaagccttcggcgccgccccgccgggtcagcccggcacgtcgggcgaccccacgccgggcggcagcacgccggtcagcgcgaccgccaagggatcgaccctgacctggccgcccccgctgctgggtttggaacccagcagctacgtcggcacccaggacccgccggtcagccgcttcctgccgccgaatctggtcaaccgcgcagaggaccgccaggaggtgctgctgcggcccaatgacgagtacgggtatctgcacgacctcttcagcctgaaccccggcctggcgcgcgccatctcgtcgaccgggccggccccggtcgcgtccggttcgtcgttcctgggcgccatgaaccgggtcgggcccgacgtgtcggcacgggtcgcgccgcgctcgctgttctccagtcgcgccgcgcgcgccccatcggccggggcgatcacacccggatcgagaaccgggtagccgcccgccggccggggtgtgcgcggcggtagccgccgcggcgcagggcgtcggtcggcgcggtcatcggctcgaagcagatgaccgcctcctcgccgggtttggccggcggcgtgaagatctgcgcggcgggatagccgtgctcgaagcatacctcgagccggcgcccgccgccggacaccgcgaacaccgcgccctcgtcgacccggtcgtaggcatcatcgaacgtcttgtcccgcagcggttctcgccgtgccggctgtagttcggactccccggtgggcagcccgtggtcgtccaaccccagatgccgcagcggcggggtctcgatgacccactcggcgcgcggcacgccaggcagctgcaggtaggggtgaaagccgaagcacaccggcaccgcggtgtcaccggtcgcggtgaccgtggtggtcagcgtcagcgtgcgcccggccaggcgcaccgccacctgcagcagatgcggaaacgggaagccggccaacagctttggatcggcgccgaaatcgagctgggcggtcagctcgttcgccgtctgcgccgtcacccgccagccgggatagccggccagcacgccgtgcagcggcaacccgttggggtcggcgcgcacgccgttgcgtccgggcgtcagggtcaccgccgcgccctcggcggcataagtgttgccgcccaaccggttcgcccacggatacagaatcgggatgcccatcgtcttgccgtcggcgacgtaggcgtccaggccgcggcgctggcccagcagctccacctcgccgtcgcgcagcgacgtgccgatcatgcccgcccgcgggacgaagcgggcgacgaccgacgacacgggatcgcgcagcgcgacgacatccatggctagctcacctcgacaaggggtcatgctgaatacgttgggctgcagcgcctttggcgatcagcgcggccttggtggcggcgaccatcctgggcccgccgcagatcaggacctgccggtcgccccagcccccgtacttggtcaccacctcgggtagccgtccggtctggtgcacgtgcagcccccgcggcggtgtgacgtcgggatagtcggcggcccacggcgggtcggcccggtactccgacaccggcgacaccgacagccacggattgtgggatgcgatctgccacaaggtcggcaggtcgtagagctcgcagcggtagcgcgcaccgaagaacaggtgcacccgcgggttcaccgcaaaccgggacaggtccatgatcagcgcccgcagcggcgccaggccggtgctgccggcgaccatcaacacgtcgccgccgtcgcggtcgacccgcaggccgccgtgcggactggacagccgccagcggtcgccgggccgggtttcgttgacgatcgcggtgctgaccaggccgccggggaccaggcggacgtgaaactcgatcccgcagcccgggtcggccggaatggccgggctcagataccgccagcggcgcgggcattgcggcacctggacgttgacgtactggccggggtgatagggcatcggctgatcgagccgcagccggaccaccgccagatcccgggacacccgcaggtgctcgatgacggtgccgtcccaccaggccggcccctcgtcggcgtccgcggccccgctcatcaccccggtgatcaggttgagcgatgtgcgggccgcgtcctcgacggcgtcggtccaggccgcgtccagatgcgagcgcagcgtggccagcagcgcgcgactcagggtttggtaatgccggggcagcacaccgtatttgcgatgatcccgcccgagttgggccagaaacgccaccggctcctgcgcccgccgcgccaccagctcgccgtacacccagtgcagcgcgtggccgaaagccacgcgctgggcgcccatttcgggcgggaacagatcgcgcaccgaggggtcgagggcgaaccaatgcgtatagaagcggtgcaccagatcaccggaatcgcccgggcggcccgcatcgcagggcgcgaaggcgtcgcgcagcacccgcagcgcttcggcgtcctcgaggctcacggggcccgattctaggctcgcgaaccgccggctcagccctgtcgaacgacgttgccggaaccggcgttgacgaccttgggtgaaccccagtggtacacaacgacattgccggcgcccgcggcgctcacggcgtcgctgctgtcgaccgcgatgcggttgccgttgcccgagacgctgacgctggtgcagtgcccggtcagggtgaccgtgttgtcttttccgctcaccgagaggtagccggcatggcagggcagcgacttcgtggtgccggcgccactgacctgcaacgtcccggcttccggcacgaccggcgccgggctgccgccgccgaggccggtgcgcgcgccggtcgccgccaacccggccgcggccagacagcagaccgctatcgccagccagcacaccgcccccgcccgcagccgggccacccgtttgccgccgcggcgcgcccgcgcgggatcgcgctcggagtctgggatatcggcccgcacctgggtgcgcatcaggggttgtgtcgtctgcgtcatcgctctccgggtaccccgtacgccggggcgcccaaaactcgatagagttgagcggaacagactcaaccttgacggcgttgaacaacccgacaagcatttttgccactacccgaacggaggtcgtcgtggactctttcaacccgaccaccaagacgcaagcggcgttgaccgcggcgctgcaggcggcctcggccgccggcaaccccgagatccggcccgcccacctgctgatggccctgctgacgcaggcggacgggatcgccgcgccgttattggaggccgtgggtgtcgagcccgccaccattcgcgccgaggccgagcgcatgctggcccggctgccgcaggccagcggcgccagctcgcaaccgcagctgtcccgcgagtcgctggccgccattaccaccgcccagcacctggccaccgagctggacgacgaatacgtctccaccgagcacctgatggtgggcctggccaccggcgactccgacgtcgccaagctgctcaccgggcacggcgcgtccccgcaggccctgcgggaggccttcgtcaaggtgcgcggcagcgcccgggtcaccagccccgaccccgaggccacttaccaggcgctggagaagtactccaccgacctcaccgcgcgggcccgcgagggcaagctcgacccggtcatcggccgtgacaacgagatccgccgcgtcgtgcaggtgctctcccgtcgcaccaagaacaacccggtgctcatcggtgagcccggcgtcggcaagaccgcgatcgtcgagggcctggcccagcgcatcgtggccggcgacgtgccggaaagcctgcgcgacaagaccgtcatcgcgctggacctcggctcgatggtggccggcgccaaataccgcggcgagttcgaggaacggctcaaggccgtcctcgacgacatcaagaactccgccgggcagatcatcacgttcatcgacgagctgcacaccatcgtcggcgccggcgcgaccggcgagggcgcgatggacgccggcaacatgatcaagccgatgctggcccgcggggagctgcgcctggtcggcgccaccacgctcgacgagtaccgcaaatacatcgagaaggacgccgcgctggagcgccgcttccagcaggtgttcgtcggcgagccgtcggtggaggacaccgtcggcatcctgcgcgggctcaaggaccgctacgaggtgcaccacggggtgcgcatcaccgactcggcgctggtcgccgccgccacgctgtccgaccgctacatcaccgcccgcttcctgcccgacaaggccatcgacctggtcgacgaggccgccagccggctgaagatggagatcgactcgcggcccgtcgagatcgacgaggtcgagcggctggtgcgccgcctcgagatcgaggagatggccctggccaaggaggaggacgaggcgtccaaggagcggctggaaaagctgcgctccgagctggccgaccagaaggaaaagctggccgaactgaccacccgctggcagaacgagaagaacgccatcgacgtcgtccgcgagctcaaggagcagctggaaacgctgcgcggcgagtccgaccgcgccgagcgcgacggcgacctggccaaggccgccgagctgcgctacggccggatcccggaggtggagaagaagctcgaggccgcgctgccccaggccgaggcccgcgagaacgtgatgctcaaggaggaggtcgggcccgacgacatcgccgaggtggtgtcggcgtggaccgggatcccggccgggcggatgctcgagggcgagaccgcgaagctgctgcgcatggaggacgagctgggcaagcgcgtcgtcgggcagaagcgggccgtgcaggcggtgtccgacgcggtgcggcgcgcccgggccggcgtggccgacccgaaccggccgaccgggtcgttcatgttcctgggacccaccggtgtcggtaagaccgagctggccaaggcgctggccgacttcctgttcgacgacaagcgggcgatggtccgtatcgacatgagcgaatacggcgagaagcactcggtggcccgcctggtcggcgcgccgccgggctacatcggctacgaccagggcggtcagctgaccgaggcggtgcgccggcgtccctacacggtgatcctgttcgacgagatcgagaaggcgcacccggacgtgttcgacgtgctgctgcaggtgctcgacgagggccggctcaccgacgggcagggccgcaccgtcgacttccgcaacaccatcctgatcctgacctccaacctggggtcgggtggcagcgaggagcaggtgatggccgcggtgcgctcggcgttcaagcccgagttcatcaaccggctcgacgacgtcatcatcttccacggcctcgagcccggcgagctggtgcagatcgtcgacatccagctggcccagctgcagaagcggctggcgcagcgccggctcacgctggaggtgtcgctgccggccaagcagtggctggcccaccgcggcttcgacccggtctacggcgcccggccgctgcgccggctggtgcagcaggccatcggcgaccagctggccaagcagttgctggccggtcaggtgcacgacggcgacaccgtcccggtcaacgtcagcccggacggcgactcgctgatcctgggctagtcggtcgcgcgcgaacgtcgacttgttgcggggatttccctcttaccttctagcgctggatgcaacagcctctagctgaggggttgttgatgaggtcgtcgcggtatgccgttgtgggtcgtcggttctgggaattggtgcgggccggaatgtctgcggatgacgctggggtggctgtcggcgtgtcgatggccgcagggcggctctggtttgctgatgctggcggagtgagaccacgattcgtcgaccagtccatcccgcgacggcgtcctcggttgacggtggaggaacgcgaggagatccaagacggtgtggctcgcagcgagtccatccgtgtgatcgctcgccgactgggccggcatccgtcgacggtgatgcgtgagatcgagcgcaacgcgatctgtcgtggccggtatcgggcgcggtatcgattcggggtgcgctggcgtggtggtcacgatccccggccgcgatatcgcgccagcttggcgcacacgcgtgcgcacgttaaggcgcgccgttcgcggcccggcaagctggcgaccaatcagctgctccacgacgaggtacagacgcggttgaatgagcagcacagcccgcagcagatcgcttggcggctgcggcgcgactttcccgacgatgcggagatgtgggtgtctcaagagacgatctatcaagcgatttacgttcagggcaaagggaatttgcgacgtgagttgcacacctgcttgcgtaccgggcgggccctgcgcaagcctcggcgtcgtcctggtgagcgtcgcggacacctgcgcgacatggtcaacatcagcgagcgcccccctgaggtcgccgaccgcgccgtgcccggacactgggaaggcgatctcatcctgggtagcaccgcgtcgggttcggcgatcggcacggtggtcgaacgaacgacgcggttcgtgatgctgctacacctgcccgacgggcatggcgccgaggcggtgcaggaggccatcgtcgccaagatggccggactgccggcgaccctgcgccagaccctgacgtgggaccagggcaaggagatggccaaccacgccgcgatcgcagcggccaccgaactggacatctacttctgcgatccacactcgccgtggcagcgtggcaccaacgagaacaccaacgggctgcttcgccagtactttgccaagggcaccgacctctcggcgttcccggccgactatctcgactacgtggcatccaaactcaaccgcaggccacgacagacactcgactggaaaacaccagccgaagccctcgatgaattactctgcaaaccgttcacaccaccggctgttgcttagagcgctagaaagcgcccctcgaaatcgcccaacaagtcgacgttcggcgcatttagtaattttgttgtgacctggtcgccttctgtgttcccgcccaatagcagatacgctgttttggatggtccccctctggttcacgctgtccgcactgtgctttgtcggtgcgggcgtgctgctgtacgtcgacatcgaccggcggcgcgggcgcagcaggcgccgcaagtcgtgggcgcggtcgcacgggttcgactacgagcgtgaatcgaccgacatcctcaaacgctggaagcgcggggtgatgtcgacggtgggcgatgtggccgcccagaacgtcgtgctcggtcagatccgcggcgaggcggtctacatcttcgacctcgaagaagtcgccacggtgatcgcgctgcaccgcaaggtcggcaccaacgtcgtcgtcgacctgcgcctcaaggggctcaaagagcctcgggagagcgacatttggctgttgggcgcgatcgggccgcggatggtctactcgaccaacctggacgcggcgcggcgggcctgcgaccggcgcatggtgacgttcgcccacaccgcgcccgactgcgccgagatcatgtggaacgagcagaactggacgctggtggccatgccgatcaccagcacccgcacccagtgggacgaggggctgcgcaccgtgcgccagttcaacgacctgctgcgggtgctgccgccgctgccggaggagactccgcaggaggcgccggccgcgccgcgcaactcctcgcccagccgcccgctggcccccgccggccgcgcggagctgccgccgcgccgcgcgcagcaggacgtggccgggctgctcggcccggacgtccagcccggccgccgcgccgccgagccggtgcgccgcgaccagccgcggcccgaggcgcgcccggacacgctgcgccgcccacccccgggtgggcgtaacggccatcaggccaccaactatcagcgctgacggcggccccgggcgtccgcgaggccgggcgccccgccgtcattaagatgtcgctcatgcctcgccccgtcgccctgatcaccgggccgacctccgggatcggcgccggatacgcgcggcgctacgcgagcgacggctacgacctggtgctggtcgcccgcgacgtggaccggctgaccgcgctggccggcgaactgcgcgaccgggcgggcaacatcgagatcctgcctgccgacctgggcgatgccgccgaccggcaacgggtcgctgagcgcctggccgccggagtgcgggtgctggtcaacaacgccggcttcgccacctccggcgacttctggcacaccgaccctgcgctgctgcagtcccagctcgacgtcaacgtcaccgccgtcatgcacctcacccgggcggcgctgccggccatgctcgacgccggcgccgggaccgtcatcaacatcgccagcatcgccgggttgctgccggggcgggggtcgacgtactcggcgtccaaggcgtgggtgatctcgttcagtgagggcctgtccgtcgggctgcagggcaccggcgtctccgtgcacgcggtgtgcccgggctacgtgcgcaccgagttccacgcgcgcgccgggatcgacatgtccaagtcgccgtcgtttctgtggctgcaggtcgacgacgtggtcgaccagagcctggccgacatcgcccgcggcaaggtgatcagcattccgggcttgcagtacaaggcgatcgtcgccgccgagcggctgatcccgcgcaccctgatgcgggcgatcaccaaacgagtcggtggtggccgtggccgaacctgagctcgaggagctggccgagctggtgcgccggctgtcggtggtgcacggccgggtcacgctgtcgtccggcaaggaggccgactactacgtcgacctgcgccgggccaccctgcatcatcgcgcctcggcgttgatcggcaggctgatgcgcgagctgaccaccgactgggactacgcggtggtcggcggcctgaccctgggcgccgacccggtggccaccgccatcatgcacgcgccgggccgcccgatcgacgccttcgtggtccgcaagtcggcgaaaacccatgggctgcaacgccttatcgaaggctcggaggtcgcgggcaagcgggtgctggtggtcgaggacaccagcaccaccggcaactctgcgctcaccgcggtgcgcgccgtccagcaggccggcggtcatgtgctgggggtggccaccgtggtggaccgcgccaccggcgccgccgaggccatcgaggccgaggggctgccctaccgcagcgtgctcggtctcgccgatctggggctgggctaattgcattgctgcgcaaggcttctcgcgatagtggcctgcctgctggcctgcgtgacggcctgctcgaacccccaccccgcggcgcgcccgtacggcgcccaaggggcgcggctcggcgagtcgctggcgctgctgggctggaacatgtcggtgtcgaacctgcgctgggacggcgactacgtcctggtcgacgtcgacgccagcccggcctcggccaagggcccgcacgccaaacccgaggacatccggttcgggctgtacggcgccctggcccacccgatggaggcgaccggcctgggcagctgcgacagcaccacgaccagcctgcacgacgtccccgcgccgctgtccgcgccgcccgaccggctcaccggcacggtttgccttgggccgctgaaggatcgcagtcaggttcgcggtgtctacggctactcgccgcgcgaccgcatccccaacagctcgtcggcctacccggtcgccttcccggtgggactgctgccgacgaaccccaacgacagcggcggcctggcggtcaagacggccagcctgtccgcgtggcgggccgacggcacgccggtgaccaaggcgcagctcggcgatccgggagcgttcaccggcaacggctacatgctgctggggttggaggccaccgccgtggcggcccgctatcgcgacgagtcggtccagcgcggcggcccgatgatgctgctggcctcgccgacgctgcccggccggggcctgaacccggcctgcgcggcgtacgggtcgtcggtgctgatcctgcccgacgcctcgctggacgcggtgcacgtgaacgcgtcgctgtgcacgcagggcgagatcaacgacgcgctgctgtatgcgacgctggccatcgacggcacccacgccggggtgtggacgcagcgatgagcgaaccggggcccaccgaatggtccgcgacgccgtccgccggcgtcgggccgtggcgcggcgagcttcccgacgacccgcgctatgacccaatcctgttgcgcgacggcgacactcgcaacgtcgtcgacgcctaccggtactggagccgcgaggcgatcatcgccgacatcgaccggcgccgccatccgctgcacgtggcgatcgagaacttcggccacgacgccaacatcggctcggtggtgcgcaccgcgaacgccttcgccgtgcacaccgtgcacatcgtggggcggcggcggtggaatcgccgcggcgccatggtgaccgaccgctatcagcggctgtgccaccacgacagcaccgccgagctgctcgacttcgcggccgccgcggggttgaccgtcgtcgccgtcgacaacgtcccgggcgcggcgcggctggaagagaccacgctgccgcgggagtgcctgctggtgttcggtcaggagggcccgggcatcaccgacgacacccgcaccggcgccacgctgacggtgtcgatcgcccagttcggctcgacgcgcagcatcaacgccggcgtggccgccggcatcgcgatgcacgcctggatccagcagcacgccgatttgtcgcaggcctggtgaagccggcgcacccgtcgagtgtgtactcacggcggccccggccggcgtgtcgtcgccaacgatgcacactcgacgccgctgggcggccgggcgtgaggcaggatcgtcaggtatggatcagctctgggccaatcgggcggccagctgcgaagccgctgtcacgcaacgacacctgaggcggctgtggggactgcccgccacccagctcggcgtggtggcctggccgccggcgcggcgcgagcggttgttcggcacctggcactactggtggcaggcgcatctgctggactgcctcgtcgacgcgcagcagcgcgacccgcagccgcagcggcgggcccggatcaaccggcaggtccgctcgcaccggctgcgcaacaacctctcctggaccaacagctactacgacgacatggcctggctggcgctggcgctggaacgcgccgcccgcatcgccggcgtgcaccggcgaaaggccctgcccaagctcgcgaaccagttcctccgcgcctgggtgcccgaggacggcggcggcatcccgtggcgcaagtccgaccagttcttcaacgcgcccgccaacggccccgcggggatcttcctggcccgctacggcgatcacctgaaacgcgctgagcagatggcgaattggatcgacgagaccctgatcgatcccgagacgcacctggtgttcgacggcatcaaggccggttcgctggtgcgcgcccagtacacctactgccagggcgtggtgctggggctggagaccgagctggccgcgcgcaccgacgggccggcccggcagcggcacgccgcgcgggtgcgccggctggtcgcggccgtcgccgaacacatggcgccggcgggcgtgctggccggcgccggcggcggcgacggcgggctgttcgccggtgtcacggcccgctacctggcgctggtcgccaccacgctgccggggtctgtcgccgaggacgtcgcggcccgcgacaccgcccggcggatcgtgctggccagcgcgaagtcggcctgggactaccggcaaaccgtggacgggctgccggtgttcggcccgttctgggaccgcgacgcccagttacccacggccggcggcaaacaggcggagttcgtcgagggcgcggtgacggcatccgagatcgccgagcgggacctgtcggtgcagctgtcggggtggatgctcatggaggccgcatgtaacgtctccgccgaatcgtcgcacgagaacaggagcgccctgtgagtaaagtccaccccgacgcggaatcggctctgcacggcctgctgaaggacggcatcaccgtcgccgccggcggtttcggtctgtgcggcatcccggagaagctgatccaggcgctggtggacagcggcatcaaggacctcaccatcgtcggaaacaacgccggcgtagacgatttcgggatggggctgctgctcaagggccggcaggtgaagaaggtgatcgcctcctacgtcggggagaacaaggagttcgagcgccaggtgctctccggcgagctggacctggtgctcaccccgcagggcacgctggccgagaaactgcgcgccggcggcgcgggcattcccggcttctacacccgcaccggctacggcaccacgctggccgagggcaaggacacccgggtcttcgacggcgtcgaatacgtactggaagaaggcattcgggccgacctggcgatcgtcaaggcgtggaagggcgacaaggccggcaacctcgtctaccgcaagaccgcgcgcaacttcaacccgatgatcgccacctgcgccgcggtgacggtggccgaggtcgaggagctggtcgaggtcggcgatctggaccccgacctgatccacacccccggcatctacgtggaccgcatcatccagggcatcggctacgagaagcgcatcgagttccgcaccaccagcggcggcgccgcgctgaagaacgacagcccgatccgcgagcggatggcccagcgcgccgccaaggaactgcgcgacggctactacgtcaacctgggcatcggcatcccgaccctggtggccaatttcatcccggacgatatccaggtcacgctgcaatcggagaacggcctgctgggcatcggcgcctatcccagcgaggacaccgtcgaccccgacctcatcaacgcgggcaagcagaccatcaccagcctgcccgggtccagcttcttctccagcgccgattccttcgcgatgatccgcggcggccacatcgacctgtccatcctgggcgcgttggaggtggcctccaacggcgacctggccaactggatggtgcccggcaagatggtcaaagggcctggcggcgcaatggatttggtgtccggtgtgaagcgggtgatcgtgctgatggaccacaccgccaaagacggcagcccgaaggtcctcgagcagtgcacgttgccgctgaccggcaagggcgtggtcgacatgatcatcaccaccctgtgcgtcttcgacgtcgagccgggccgggggctgctgctcaccgagctgcatccgggggtgacggtcgaggaggtgcgcgccaagaccggctgcgacttcaccgtcgcgctctaaagcccggctactcggacgccggcagccgctcggattcccgctcgggcgtgcgcgtggggcgtcgccgcccccgatagccccgccaggcggcgacgaacgccggcatcagcgagacgaccaggatgcccaggatgatcttctccaggttgtggtgcacgaacggcacgttgcccaggaagtagccggccagcgtcgcgccgccaccccaggcgatgccgccgacgatgtcgaaacccaggaacacgggatagcgcatgtaggacaccccggcgatgaccgggacgaaggtgcgcacgaacggcgcgaaccgggccaggatgaccgcccaggacccgtacttctcgaagaaggcgtgcgactcggtcacgtagtgcttcttgaagaaccgggaatcttccttcttgaacagcgccggaccgatccggcgcccgatgaagtacccggtctgatcgcccagcaccgcgacgatcgcgacggccggggccagcacccagatgctggccggcgggttggggtgcgcggccagcagcccgccggtgaacagcagcgactcgccgggcagcagcgggaacagcaggccggtctcgatgaagacgatgaccaggatgccgggcagcaccgcggagccgaagacgccgtcggcgcccaaccaatacatcgggtcgaggatgtcgggcagggccgtcacggcggtgctcatgatgcctcaaacataccggtcgcaccggcaatcatggctatccgctggcggactggcagatcttccactggtcgtcgcggtactgcaggtccaggctgcgggtggagcgcacctgcgggtcgtaggccatgaaggtggtgacgttcgcctcggcgtgctggccgttgaccaccacctggtcgatgctggcgatcaccgggtactgcttggccgccgagacccggcgataggtctccgcccaggcgtgttcgtcgtagtcggcgtagccgtcgcgggtggtgccgcaggtgatgctgcgcagcgtggtcaggtcaccgcgctggatggcggcgtcgaagttgccgatggtgtgccggacctgatcctcctgcgagacgttggtgtgcctgccgcgggtgagcagcacggtgcccaggatcgcgatcgccgccagcgccagcacgatcaccaccagcgccagtatccagccccagttgatttgccgggaggtgcgcagtttcccgccgagccgaggtggaatcgattgtgggacagcggctttgggtggaaccccgaactgggtggtgttgtcctgcccgggcggaacgaacgcctcggtggccggctccggggtggtggcgatgatcgtggtttccttcgcgtcgaagcccggcgcggtgaaccggcgttcgcgctgcgggccgtccggcgtctcctgcgggccgctgggcggatcgggtttgttgatcaccacggtctcggtttcggcgtcgctcgggaccatcgggacgctctcggtggcgtcttcgctgctgtcgaagccgccgtcgggctcctcgccggtctcgggcgtccactcgtcgctcgcgcgagacgcgcgtgggtcgaacccgggccgtttcggcgggccgccgcggccgggttcgggtgggttgggcatgagtactactgtcctcccgctgtcgagtggggtagttgcagagcttagcgaccgagtaccccgctcggggcgatggtagaggtgcgtcccgcgggcgagacgagtgagctgcagaatagagccatgacgccgatgggagatctgctggggcccgacccgatcctgctgcccggagatgccgacgccgaggcggaactggccgcgggggagaacccgggcatcgtcgccgccgcgcatccgacggcctcggtggcctgggcggcgctcgccgagcaggcgctggccgacgaccgggccatcaccgcctatgcctacgcccgcaccggctaccaccgcggcctggaccagctgcgccgcaacggctggaagggcttcggcccggtgccgtactcgcacgaacccaaccgcggcttcctgcgctgcgtggcggcgctggcccgcgcggccgacacgatcggcgagaccgacgagtacctgcgctgcctggacctgctcgacgattgcgaccccgcagcacgcaaagagcttgggctgtaaggcttttcagaagctgtcggagcactcggtgtcgtccgggcagtcgatctgcacggtggcgtgggcgagcccgcgggccgagagcacggcgcgggcgtcgcgcagcacccgggcggagtcgccggtgctgatcaggtgcgcggtgcacatgtccttgcccggcgacagcgtccacacgtgcaggtcgtgcacgccggtcacgccgtcaacggcgcccagcgcggcgcgcagctcctcgacgtcgatgtgggtgggtgaggattcggacaggatccgcagtgcgtcgcgggccagcgagatggcccggggcagcacccacagcgccaccagcacggccaccaccacgtcggcgtagggccagcgcgtggtcaccgtgaccaccccggcgatcagcacgcccaggctgccgacggtgtcggcgatgacctccaggtaggcgcccttgacggccaggctgcccgacgagtgcgagcgcagcagcagcgcgacgacgaagttggcggccagcccggccagtgccaccgcgatcatcggcacgcccggcacggcgggagcctcgcgcagccgctggatcgcctcgtagaggatgaacaccgagacgccgatcagcagcccggcgttggcgacggcggtgaacacctcggcgcggtgccagccataggtgcgcgccggcgacgagctgccccggcgggccagcgtgacggcggccaaccccatgaacaccgcgacgacgtcggtcagcatgtggcccgcgtcggccaacagcgcgatcgagttgatcagcaacgaggtgaccagctcgacgacgaagaacgccgccaggatcgccgcggccatcaccatccgcgggatcagccgggcgtcacccgtctcggcgggggtgtggttgtggccggcgcccatgccgggcaatatatgcatggcaacgcatatattgcaagggtcagacccagcggctccagaagcgggtcagcacgttgcccgcgccggccagccagtgcggcacgccggagaagtcgaacagccagtagacgatcccgaagaaccaccggttgagccccggcgccaacagcaggaacagcagggtgaagaacccccactgcttggccggcgccagcgcccgctgcgtctcggggctcaggtgcggttccagggcgtcgtagccgtccagccccgggatcggcagcaggttcagcagcaccgcggtgagctgcaggaaccccaggaaggccacgcccgcccacagcaccgcgtggtcggcggtgaagaacgcccgggtcagcgccagcagcaccgccgccagcaccaggttggccgccgggccggccaggctgaccagggtgcggcgggccggggtcatgaaccaggtctgcacgtagaccgccgcaccgggcagaccgatgccgcccagcgcgatgatcaccatcggcagcaccagcgacagcgcgggatggctgtagcggcgcgggtccagcgtcaggtagccgcgcaccgccgcgtcccggtcgccgaagcgccaggcgatcaccgcgtgcccgaattcgtgcaggcacagcgacaccagccagccggcgatgacgaagacgaacacgccgaggtaggccagcggccgcgggctggatccggtcagccaggccagcgcgccgcccagcgcggtcaaccccagcagggccagaaagatcgggctgggccgcaccgactcgtgttggggggcgcggaagctcaccggtcgaaactagcggaccagcagccagccctcgatgttgcggtagaaggccgaccgccgcgcggggcgggcggccggcacgccgtcgcgcagcactgtcgccccggtgctgcccagctgcgccgcccggccggtgacccagcgccgccacggccggcccgcgaccgccgcccgcaggcccggcatcgccgccgtcggctcgatccacacggcggtgacgtcgccgtcgaacaacgtggtgtcgtcgacgacggcctcgccgtgcagccaccgctgcccgccgggcgccgcccagcaggcccgcccgacgatcgccgagcccgtctcgtcgcggatcagcggcacccgccgcgccgcaccccgcgcggcccgccgcgccgcccggaatccggtgggcagccggtagttccgggtggcccgggtgcgccggcgcggcacgtaggccacctcgacgtccagccgctcggcgcgcagcagccgggtcagcaccaatgccagctcggcgtcgccgccgagcacgatcagccgccggtacgggccgatcgcggcgtcgacatcggtgtcaccggcgacccgatgggtgggcatgccgcgcaacggccggtagccgtgtcgccggccgaactgaagaaccgcggcggcccgatcctgttgcgtcacagcccatccaatcggggaacatccaatgtccttgtctcccaacatctctgagcggacatgaaccgcgacgccgaaagggcgcaccataacgacacggtcacaacatggcgtcggactgcgaaagttgttgccacgcttccgggaaacaaccggatactttactcctgccacagggctgacgttgcgcggaatcccgccacgagtggtttagcggaacggagcaccaccattcctcgaccaaccgccatcttgtcgatcgcgccgaccgcgtcgggcgccggccccacccgcgtccgttgctgaggacgccgctgtgccgcgccggcgccgtgctggcgtcggtcgtgctgctgtgcagcgcttcggcgaccgcctcggccgacgagtcgatcgtgatcgacctggtgcgccacgggcagtcggtggccaacgcggcgggactgatcgacacggcggtgcccggcgcatccctcacccagctcggtcagcaacaggcgcagaccgtcgccggcgttctggcggcgcggggcccggtcgccgcgatcttcgcctcgcagctgatcaggacgcagcagaccgcggcgccgctggccaccgcattgggcatgaacgtccaagtgctgccggggctcaacgagatcgacgccggcatcttcaacggccagccgcagttcagcctcggcgggctggcctacctcttggcgccgatcgcgtggatgctcgggctgcgcatcgtgccgatgctggctcccggctccgcggacgccaacgggtacgagttccgccggcgcttcgacggcgcgctgcaaaccgtgtacggcagcgccgcggccaacgccggcggcttcggtgacgtgcttcaggcggtgtacgccggggcggtgacgaacccggtccgcgccgccaacggccggatcaccggggtggcgttctccagcgagttcgccatcggcgtcgggacgatgatgaccgtcaagaaccccgatccgttgctgctgctcttcgacccgctgcccaacacgggcatcgtggtcatccagggcagcccccgcgacggctggacgctgatcagctggaacggcaaacccgtgcatccggggtggtcggccacccggaatggtcgcggcgccaatggcctgtgcctgatgctggacccgtccaccccgaccggcgtgtgcgcggccaaaccgcccgggccggcgagcgccccggtcacggcgcgtcctggcttaagctgatttgcccggctcctgcgccggccatcggcggcccgcctcgccgccaggctagggtgggtcaccggctggaccacaatacgcaggcgagatcagggttggagcgtgtcatgccggcaatcgtcctcatcggcgcccagtggggcgacgagggcaagggtaaggccactgacctgctcggtgggcgcgtgcagtgggtggtgcgctaccagggcggcaacaacgccgggcacaccgtcgtcttgccgaccggggagaacttcgccctgcacctgatcccgtccggggtgctcactcccggcgtcaccaacgtcatcggcaacggtgtggtggtcgaccccggggtgctgctcgacgagctcaaggggctcgaagaccgcggcgtggacacctcgcggttgctgatctcggccgacgcgcacctgttgctgccgtatcacgtggccatcgacaaggtcaccgagcgctacatgggcaacaagaagatcggcaccaccggccgcggcatcggcccgtgctaccaggacaagatcgcccggatcggaatccgggtggccgacgtgctcgaccgcgaggtgctgacccacaagatcgaggcggcgctggagctgaagaaccagatcctggtcaagatctacaaccgcaaggcgctcgatccgcatcaggtggtcgaatgcctgctggagcaggccgagggtttccggcaccgcatcgccgacacccggctgctgctcaacaccgcgctggaggccggcgagacggtgctgttggaaggctcgcagggcaccctgctcgacgtcgaccacggcacgtatccctatgtgacgtcgtcgaatccgacggccggcggggccgccgtgggctcggggatcggcccgacccggatcaccgcggtgctgggtatcctcaaggcctacaccacccgggtggggtccggcccgttccccaccgagctgttcgacgagaacggcgaatacctgtccaagaccggcggcgaattcggggtcaccaccggccggcgccgtcggtgcggctggttcgacgctgtgatcgcccgctacgccacccgggtcaacggcatcaccgacttcttcctgaccaagctcgacgtgctgtccagcctggagacggtgccggtgtgcgtcggctaccgcatcgacggggcgcgcgtcaacgagatgccgatgacccagagcgatctgcaccgcgccgagccgatctatgaggagctgcccggctggtgggaggacatctcggcggcccgcgagttcgacgacctgcccgccaaggcgcgcgactacgtgctgcggctggaagagcttgccggagcgcatgtttcgtgcatcggggtggggcccggtcgggaacaggccatcgtgcgccgcgacatcctggcggcgcgcccgtgacggaacccgacccgaccgaactagatcccgaatacgaacaccacggcggcttcccggagtacggcccggccagccccgggccggggttcgcccggttcgtggagtccatgcgccggctgcaggacctcgcggtgtccgccgaccccggtgacgacgtctgggacgacgcggccgagcgggtggccgccttggtcgagctgctggatccgttcgaggccgacgagggcgcggcgcccgcgggccgcacccccggcctgcccggcatgggcagcctgctgctgccgccgtgggtgctgacccgctacggccccgacggtgtcgagatgaccgggcatttcagccggttccacgtcggcggcaaccacgcggtgcacggcggcgtgctgccgctgctgttcgaccacatgttcggcatgatctcgcacgccgcgggccggccgatcagccggacggccttcctgcacgtcgactaccgcaagatcaccccgatcgacgtgccgctgctggtgcgcggccgggtcaccgggaccgagggccgcaaggcgttcgtggccgccgaactggtcgacggcgaccagacggtgctggccgagggccacggcctgatggtgcggctgctgcccggccagccctgaggccggccccgaggcgggacgggcactcagcggacccacctatccttggacccgtgactgacggcgtgaccgacggacgggacgacgagacgacggcgctcgccgtgcccaggcccgctcccgccgaccgcggcccggctcccgccgacggcagcccggctcccgccgacggcaggccggcggtgatgctgctgggctccggcgacatcagccgcgagctggcgatcgcgctggggcggctgggcgcgcgggtgatcgccgtcgacgcgcacccgcaggcgcccgcgcacgcggtggccgaccaggcgctggtgctgccgtcgaccgacgccggcgagctgtcggcggcgattcaccggctgcgacccgacgtcgtggtaagtaccaccgacgccgtcgcggtgccggccctcgaggcgctggacggcacgggcgccgagcccgtgcccagcgcccgcgccgtgcggctggccgccgaccgggaagggctgcgccggctggccgccgacgagctggggctgcccaccgcgccgttctggttcgccggatcgctgggtgaactcgaggcggtgggcgcgcacgccggatacccgttgctggtcaagccggtggtcggggcggtcgggccgcggcagtcggtggtggcgggccgtgaggacatcgcggccgcctggcaccgcgcggtggacggtcagcccggcgcccgggtgctggccgaaaccgtggtcgaggtgcagttccacgtcacgctgctggcggtgcgcagcgagggcgccgcgggtccggcgatcgaattctgctcaccgatcgggcatcgcggcgccggcgggcgggtgctggaatcctggcagccgcagaagatgagcccggccgcgatggacgccgcgaagtcgatcgcggcgcgaatcgtcaaggcgctgggcgggcgtggcgtgttcggcgtcgagttgatggtcaacgacgacgaggtgtatttcgccgacgtcaccgcccacccgggcgacagcgcctgggtgacggtgcgcagccagcggctctcggcgttcgaactgcaggcccgcaccatcctgggcctgccggtggacaccatgatggtgtcgccggccgccgcccgggtggtcgactccgccgaccccggcgaccgagcggccctgtccggcgcgctcggcgtgccggagagcgacctgcgggtgtgcgggggcggtttccgggccctggcgaccgcgccggaggtggccgccgcccgggagcgcgccggccaggtcgccgcccggctgaccgcgggcgcgggcggcgtggtcggcgcgggcggctgagccgcggcggcgccggcgcgacggcctcgatacgatcgcaggtcagggtggccggcaatgcgtaccgagacgaggggacaccaacatgagcaccgagcgcgcacactcctacgcgggggacgtttcgccgctggaagcatggaaactgctcagcgacaatccgaacgccgtgctggtcgacgtgcgcaccgacgccgaatggcgcttcgtcggggtgcccgatctgtccagcctgggccgcgaggtggtcttcctggagtggaacacctccgacggcaggcacaacccggacttcgccgaccagctgcgccggcagatcgagccggcgccggccggccaggagcgcccggtgctgttcctgtgccgctcgggtaaccgctccatcggcgccgccgaggtggcgacccagctgggcatcacgccggcctacaacgtgctggacggcttcgagggtcatctcgacgccaacggccaccgcggtgaaacaggttggcgggcaatcggtttgccctggaagcagggatagcccggatgagtcaggccggcgacgattcggtccgcacgccccccgcgctgcccgacggcgtcagccaggcgaccatcggcgtgcgcggcggactactgcgttcggaattcgacgagaccgccgaggcgctgtatctgacctccggctacgtctacgagtcggccgccgttgccgagcagtcgttcaccggcgaactggaccatttcgtctactcccgctacggcaaccccaccgtgaccatgttcgaggagcggctgcgcctgctcgaaggcgcgccggcggcgttcgccaccgcgagcggcatggcggcggtgttcacctcgctgggcgcgctgctggccgcgggcgaccggctggtcgccgcgcgcagcctgttcggctcctgcttcgtggtgtgcaacgagatcctgccgcgctggggcgtgcagaccgtgttcgtcgacggcgacgacctcgcgcagtgggaggaggcgttgtcggtgccgacggcggcggtgttcttcgagacgccgtcgaacccgatgcagtcgctggtggacatcgccgcggtcaccgagctcgcccacgccgcgggcgcaaaggtggtgctggacaacgttttcgccaccccgttgctgcagcagggcattccgctcggggtggacgtggtggtgtactcgggtaccaaacacatcgacggccagggccgggtgctgggcggggccatcctcggggacagggactacatcgacgggccggtgcagaagctgatgcggcacaccggtccggcgatgagcgcgttcaacgcctgggtgctgctgaaaggccttgagaccatggccatccgggtggaacacagcaattcctcggcgcaccggatcgccgaattcctggagacccatcccgcggtgcgctgggtccgctacccgtatctgccgtcccacccgcagtacgacctggccaagcgccagatgtccggcggcggaacggtgatcaccttcgcgctggactgccccgacgacaaggccaagcagcgggccttcgaggtgctggacaagctgacgctgatcgacatctccaacaacctcggtgacgccaaatcccttgtcacacatcccgctaccaccacccaccgggcgatgggcccggagggccgtgcggcgatcgggctgggcgacggcgtggtccgcatctcggtcgggctggaaggcaccgacgacttgatcgccgacatcgaccgggcgctgggttagccgggtcagccggcctgcttttcggccgagtcgacgtgctcggcggccgccagcgtcccgtcctgggcctggcgctccagccactccaccaccggccgcgcgtagatcatctggctggtgatggccatctggccgcgggtgcggcccaaaaacgagatgccccaggcgaacatggcggccagccggttgcggtggccgatcaggtagtacaggtgcagcagcagccacgccagccaggcgatgaagccggcgaactccaccctgccgacctgcgcgacggcgctgtaccgcgagatcagcgccatgctgcccttgttgacgtaccggaacggcttgcgctcggccgggttgtcctggcccttgaccgcctgcttgatgatgccggccgcgtacttcgcgccctggatcgcgccttgggccatcccggggacaccgggcaccgacatcagatcgccgacgacgaagacgtacggatgccccttgacggtgaggtcgggctcgacgatcacccttccggcacggtcggtttcggtgccgtcggactgctcggcgatcatcgcgcccagcgcgctggcctgcacccccgccgcccacaccttgcacgcgcattcgatgcggcgctcggcgccgtccttctccttgaccgtgatgcccatgtagtccaccgcggtcaccatcgcgttgagctggacctcgacgtccatcttctgcaaccgccgctgcgccttgaggcccagcttggggcccatcggcggcagcaccgcgggcgcggcgtcgagcaggatgacccggcattcgctgggggtgatggtccgaaacgccccggccagggtgcgctcggcgagctggacgatctcgccggccagctcgacgccggtggggccggccccgaccaccacgaaggtcagccggcgtctgcgttcggccggatcggtggccacctcggcggcctcgaaggcgcccaggatgcggccgcgcagctccagcgcgtcgtcgacgctcttcattcccggcgcgaacgcggcgtactcgtcgtggccgaaataggactgctgggccccggcggccacgatcaggctgtcgtagggcgtgacggtgtccatgcccatcaggtgcgacgtcaccgtcctggcggtgaggtcgatggccgagacgtcaccccagagcacccgaacgttcttctgcttgcgcaggatcagtcgggtggtcggggcgatgtcgccctcggacaggatgccggtggccacctggtagagcagcggctggaacagatgcgtggtggttttcgagatcagggtgatgtcgacctgggttccctcgggcacgcgtttgagcgccttggccgcagtcagtccgccgaagccgcttccgatgatgacgacacgatggcgcgacatgcccgtcccttctgccgtgccgggcggccggtctgcccagcgcaactccaccgtacgacgccacacccgcgaaaggcgaggcatccgggcagaccgatgcgccgcgcggcccagccgtcgaccggccgaaggaaccgctcaaggcgaaagcggttgggagcgcgcggttctcggcaatgcccgaacaccgaggcgccgccgctcccacgccgtgaaccgaagcgaacagcgaagttccttgtgcggcagcaggtcccggccgaagccgcggtgagccgacgaccccaggccgcggctccggccggttacctaactcatcttcgcttttgcgaagcgtgaaacgactgaaaaagcccgaatcacactgtgggcttgttcggttgatgcactactacggagtgcaggtcaaaccgggtccgcagtcgataactaacggaaccgtgcacgccgaggtcattggtgccgccagggcgaggaccacggcgacgacgattttgctggtgcgacgagacataagaacccccttcgtctgggagacgatattctgatgcccgatgtgggcgagtttacgtcgtcagcacttcgcagataagggatttcgcgaagatcgccgaccgattcgccaaacggatgatcggcgaccaccggcgcggcccggcccccggatgggcattgcaatcgcagcaaaattcgctgccgggaggaattcgaattatcctgcgcgcggccgtgaccgcggctatattggatcgctatttaccggccgccgattggtgccggtgcgtaaaccggacatggattcaaaaatccggcaatcggtttcggtcgcattcagctccgaccggcggcggggctagaacggccacccggtggcgtcgctcttgtacttggcgttgaggtcactgcagaagtcggcggcggtgccggcgagcaggatgtaataggtctcgccgcggcggctttcgtaggaggtgggggtggtccagccgctgttgcacatcgcggtttcgccgccggcggtggcccgtcgccagttggtcttcgcgcacgcggccaggttgtccgggctcggcgtggcactcttggccgcgacgagcatggccccaccccactggccgtcgttgcgccggtaggcgcgcgccccgaacccggcgttgttgtcctggcacgtcaacgcgcggcgcaacagcgaaaagggcgccgccagctgctggttggccgcccccgccgccgcggtgatgaactgcgccgcgtccgagccgtcgacctcctgcaccacgccggggttgccaaagctgaacagctgctgggagattgcctgcgcggcggccgagccgccgccgatgatcgggccgctgccgccggaagtcatcggcggcagccccgggggcgggtcggcggccgccggcgccgtgccggcgcacagggtcgccagcgcagtcagggcgccgatccggcgggccgtggcactcatgcccctatttcagcacgtccgcgtagtcggcgcggcgctcatcggaaatcagcccgttgagcaggtgccgggtctgcaacgcgaagtactcgtcgagggtgtagatcggcccgaagtgccaatgcttgagcgcccagccgtgggcgagcagcatgatgtcgaacacggcaaggtcgacgtcgacgctgcggaagacgccttgggcgatgccggtttcgatcaccgcgcgcagcggcgcggcggtggcgatttccagatccttgatctgggcgcggccggccgccccgagggtccggctctcccgataggtcagcaccaccccgtcgaggttctcgtcgacgatctggatgtagcggcggatccccgcgctcaactggtcgacgacgtcgtcgccggcgccgtcgatgaccggtgccagttgatcgcggaacacgtcgaggatgcgcacgatggtggccagcagcaggtcctgtttgccgccgaagtacttgtacagcaggccgacgctgacgtcggcctcggcggccaggtcgtgcatggacatgcggtgaaaaccgttgcggcccatcaccttgaccgcggcgtcgagcacctggcggcgccgcgcgccggcccgtgcggcgcgcacggcctcctcggcgggcagttcgctgtagtcgacggccatgccgctagaggcccaggtccttggcgatgatggtcttcatgatctcgttggtgccgccgtagatggtctggatgcgggcgtcgacgaacgcccgcgccacgccgtactcgcgcatgtagccgtatccgccgtgcaactgcaggcagcggtcggcggtgcggacctgcagatcggtggtccaccatttcagccgggcggcccgcgccgcggtcagctcgccggccaggtgcgcggccaggcagtcgtcgagataagtgcgggcaacgtcgatttcggtggccagttcggcgagcacgaattgactgttctggaaggcggcgatgggcgcgccgaaggcgtgccactgcttgacgtagtccagcgtctcggcgaatactgcctcggcggcggcgaccgcgcccacggccagcgaaagccgttcctggggaaggtttttcatcagctggtagaagccccggccttccgcctcgagcaggttctcggccggcacccgcatgtcggtgaagctcagctcgctggtgtcctgggcgtgcaggccgatcttctccaggttgcggccccggccgaagcccggcgtgtccgcgtccacgaccagcagcgaaagccccttgtgccggtccggtgcggtgcgcaccgcgaccacgaacaggtcgcccacctgcccgttggagatgaacgtcttggcgccgttgaccaggtagtgatcgccgtctcgcaccgcggtggtgcggatcccggccaggtcgctgccggtgccgggctcggtcatggcgatcccgagcaccgtctcgccggtcaccacgccgggcagccagcgccgttgttgctcgggtgtggtcagctcgacgaggtagggcagcacgatgtcgttctgcagcgagaaggcgatggcctcggcggccgcgccggcccgctgcaactcgtcgaccacgatcgcgttgtagcgaaagtcgtcgacccccgggccgcccaaccgctcgggcaccgaaaagcccagcagccccagtttgcctgcctcgacgaacagcgaccggtcccactggccgtcgcgttcccacttctcgtgattgggcacgaccgtccgttgcacgaaatcgcggaccagctcccggaactggtgatgctcggaggtgtactgcaggtgtgcggccatcgggtgctgctctgggtcagcggaaggcgtcggcgccggtgaatgcctggccgaggacgagctgatgcatctccggcgtgccctcgtaggtcagcaccgattccaggttcaccatgtgccggatgacggggtattccagcgatatcccgttgccgcccaggatggttcgcgcggtccggcagatctcgatcgcctcccgggtgttgttgagcttgccgaagctgacctgctcgggccgcagcccggtgctgtccttgaggcggcccagatgcagcgacaacagctggcccttgtgcagctcgacggccatgtcgacgagcttggcctgggtcagctggaatccggcgatggggcggccgaactgggtgcgctgggtggcgtaatccagggcggcctgccaggccgagcgcgccgcgccccttgcgccccagatgatcccgtagcgggcctcggacagacacgacagcgggccgcgcagcccggtggctccgggcagcatcgcctcgccgggcagccgcacgtcgtcgagcaccagctcgctggtgatcgaggcacgcagcgacagcttgtggtgaatcgtgttggcggtgaaacccggcgtgtcggtgggcaccaggaagccgcggatgccgtcgtcggtgccggcccacaccacggcgacgtcggccaccgacccgttggtgatccacagcttgcggccatcgagcacccagtccgaaccatcccgtcgcgcacgggttttcatcgccgcggggtcggagccgacgtcgggctcggtcagcccgaagcagccgagcagttcgccggtggccatgcccggcagccattggcgtttttgctcctcggagccgaagttccagatcgcgaacatcgccagcgagccctgcaccgagaccatcgaacgcagaccggagtcggcggcctccagctccacgcaggccagcccgtagtgcacggccgacgcgccgccgcagccgtagccgtgcaggtgcatgcccagcaggccgagccggccgaactccctggccagttcgcggaccggcaggtcgccgatctcgaaccactccgccacgtgcggcagcacgtgctcggcgcagaaaccccgcacggtgtcgcgcaccgcgcgttcgtcgtcggacagcaaggcgtccaggcccagcgggtcgtagcggtcgaaggacggtggggtcttggtgctcgtctcggtgctcatagcagtcagcctgccatcgttaagccgccgctgacactgatcacctgtccggtgacgaacgaggctgcctgcgaggcgaagaacagcaccgccgcggcgacctcctcgggccgggccagccggcgcagcggaatcgctttgaccagtgcttctttcagcttctcgggctgggcgtgaaacagcggggtgtcggtcgggcccgggcacacgcagttcaccgtgatctggtggcgcgccatctcgcgggccagcgacttggtcagcgcgatcaccccgcccttggcgccggcgtagatgctctcaccggcgctgccgacccggccggcgtcgctggcgacgttcaccacgcgtccgccgccgtgcgtctcgatcatcccgggcaggaacgccgaacacacatgcaccggccccaggtagttgatggccaccaccttctgtgcgaattccggtgtggcgttgaggaattggtcggttcggtcccagccggcggcgttgacgacgacgccgggcaccccgatgtcggcgtggatgcggtcccgcagcgcggcgacccgtgccgggtcggcgacgtccaccggcgccgcggtgatcaggtcgggttgctcggcggcggtggccgcggccgacgcctcgtccaggtcggcggcgacgacgcggtcacccccggcggccagcccgagcgcgatcgcccggccgatgcccgaacccgcgccggtcaccaccgcgaggcggcggtgtgaatgagtattcattgcagacgaatctaggttcacctcggttgccgggtcaaggatcggcgcggccgagcgggtagtctcgctgcatgcttaggctccggcggctggcctggttcgcggtcgatgtcctcggcgtgctggtgttctgcgccgtggggcggcgcagtcacgacgagggcctcagtgccaccggcgtcgccgtgacggcgtggccgtttctgaccggcaccgcgctcggctggctggtctcccggggatggcggcagcccaccgcggtgctgcccaccggcgtcgtcgtctggctgtgcaccgtgatcgtcggcatgttgctgcgcaaggccagctccgccggtgtggcggccagtttcgtggtggtggcctcgacggtcaccgcgctggtgttgctcggctggcgggtggccgccgggctgaccctgcggcgccgctccgacgcctgagacgacgcccgggacgacgatggcagcgacagccgaggtgggggtgaccgcaaccttgggcgccgccgcccgggccgtcgccacccggcaggggttgctcaacgacccgtacgccgagccgctgctgggagccgtcggcatcgactacctcacccgcgcgatcgccgaccacacgttcgcggccgatgaatcgccggtcggcgacgacccggcggtgacgtcgctgctggatgcgctggccgcccacacccggttcgtggacgaattcctcgccgaggcgggccgcgcgggcattcgccaggtggtgatcctggcatcgggcctggacacccggccgtaccggctgtggtggccgcgcgggaccacggtctacgagatcgaccggccgcgggtgctcgatttcaaggccggggtgctgcgcgggctggacgcccggctggccaccaaccggtgcgcggtcggcatcgacctgcgcgacgactggccggcggcgttgcggcgggtgggtttcgacgcggcccagcccacggcgtgggtcgccgagcagctgctggtcggctacctgaagcccgccgaacagaaccggctgctgcgccggctcaccgcggccagcgccgcgggcagccggttggccgccgaccacctgcccacctgggatccgctgcagctggaggccgagcgggccttcgtggagggctggcggcgccgcggcctggacatcgacctggccagcctcacccacctgggcgaataccattacgtccctgagtatttggcgacccacggctgggagccggcggcgcggtccatcgccgatctgctgggcggcctggggttggggccgcggcggggcgccggatccggcggcgcgcagttcattccggaatacgtcaccgcgacccgcgtttgagtgtgtcgatgacccccgaatccagcccgccggccgacggccgactgcggttcgtgccggccacgcacgacgacccgctggcccggccgctgctggccgaactggccgtcgagtacgcccagcgctacggcggcacgccgagcgcgcacctgagctggttgccggtgccgcgcgacgaactggcaccgccggacggcgggctgctgatcggcgtcgtcgacggcgtgcccgtcaccggcggcgcgtttcgccgctacgacgccgagaccgccgagctcaagcggatctggaccgacgcggcccaccggcgccgcggctacgcgcgggcgctgctggcggcgctggaggagcggacccgggcgtgcgggtatcggcggctctacctgatcaccggcaaccggcaacccgaggccgaggcgctctacgacgcgaccggatacacccgggtgccccccgacccgctgccggattggggtccgttccgcccgatcgcgttcgagaagtggctggttcccgacgaacggtgaattgccctgggccgcaacagcctactggcgccgagcgtgggccgtatggacgaattcccggcggttggcgtacgtggggcccacgctcgggcgccggcctagcgacccgtggcgagcgcgagcgccgcgtcggtggcctccttgatcggcccgcgccacacgtcgccgtggccgggcagcagcacctcggtgtcgagcagggcgagcgcggacagcgtgcggatgcagtcgcgctggctgtaactgaaaatcgccgggagcagctgaggtccgcggtggcgcagcaggggatgtccggtgatcagcgcgtcgccactgaccaggacgccgtcgatcaggtacgagcaatggccgttggtgtgcccggggctgaagaccggcgtcggccggcccggcagcccggcggccacctccgcggtcaacggccgggcggtggggatgccgtcgcggatcaggccgccgctgcggaccacatgcgcggtccacttcgcccatcggggccgccaaatgcgaagcgccacatcaacaatcgacacctgctccaggtactcgcgtttggcgtggcccacctcgtcggcgtggcagtaaaccgggatgccgtgctcgctcgccaaccagatcgcggtgcccaggtggtcgatgtgcgcgtgcgtcaacacgatggcgcgcacgtcgcccgggccgtagccgagctcggccagcgagcccagcacgtcctcgcggtccccgggatagccggcgtcgaccagcatcaccccggtgtcgtcggcgaccagcgtccagttgaccgcgtccccccgggcgaggtgcaccgcgtcggtgacctgaactagctccgccatgcccgcgagtgtaagcggaggagtagaaatgacccgtggctgaactcaaactcggatacaaagcgtccgccgaacaatttgcaccacgcgagctggtcgaactcgccgtcgccgccgaagcccacggcatggacagcgccactgtcagcgaccacttccagccgtggcgacacgagggcggccacgccccgttctcgctggcctggatgaccgccgtcggggaacgcaccacgcggatcacactgggcacctcggtgctcacgccgaccttccgctacaacccggccgtcgtcgcacaggccttcgccaccatggcctgcctgtacccgggccgcatcttcctcggggtgggcaccggcgaggcgctgaacgagatcgccaccggataccagggcgagtggccggagttcaaggagcgcttcgcccggctgcgcgaatcggtgcggttgatgcgcgagctgtggcgcggcgaccgcgtcgacttcgacggcgagtactaccggctcaagggcgcctcgatctacgacgtgcccgacggcggcgtcccgatctatatcgccgccggcggccccgcggtggccaaatacgccggccgggccggcgacggcttcatctgcacctccggcaagggcgaggagctgtacaaggacaagctgatccccgcggtcaaggagggcgcggcgatcaacgaccgcaatgtcgacgacatcgacaagatgatcgagatcaagatctcctacgaccccgacccggaactggcgctggagaacacccggttctgggcgccgctgtcgctgaccgccgagcagaagcacagcatcgacgacccgatcgaaatggagaaggcggccgacgcgctgcccatcgagcaggtggccaagcgctggatcgtggcctcggaccccgacgaggcggtggccaaggtcaaggactacgtcgactggggcctcaaccacctggtgttccacgcgcccggccacgaccagcgccggttcctggagctcttcgaaaaggacctggcgcccaggcttcggcgacttggctgacatttcggcgatctacgttgccgctcccgaaccggagaccggcaagtccaccgtcgcgctgggcctgctgcaccggctgaccgcgacggtcgccaaagtcggtgtgtttaggccgattacgcgtgacgggcaggaccgcgactacatcttggagctgctgctgtcgcgcaccaccgcggggctgtcctaccagcagtgcgtcggcgtcacctaccaacagctgcacgccgacggcgacgcggcgatcgccacgatcgtcgacgcctaccacgcgatggccgagctgtgcgacgtggtggtcatcgtcggcagcgactattccgaactgggacaggcgatccggcccgcggagctgtccaccaacgcccggatcgcggtcaacctcggtgcgccgatcctgctgacggtcagcggcaaggggcgcaccgccgccgaggtcgccaccgtcgtgcaggtctgcctggccgagctggacgcccagcacgcgcacaccgcggcggtggtggtcaaccggtgcgagccggccgagctggacgcggtggccgaagcgttgcgcggctttccccagcgctgctacgtgctgcccgacgagccgctgctgtcggcgccgacggtggccgaactggaaaaggcggtcgccggttcgccggtcagcggcgaggagtcgctgcgcgagcgcgaggtcaccggcatcctggtcgccgggatgaccgccgaccacgtgctggagcgcctcgcggacggcatggccgtcatcacccccggcgaccgctccgacgtggtgctcgccgtggccagcgcccatgccgccgaaggctttccgtcgctgtcgtgcatcgtgctcaacggcgggttcgcgctgcatccgtccatcgcggcgctggtggccgggctgcggctgcggctgcccatcgtcgccaccgcgctgggcacctacgacaccgccagtgcggcggccgcggcccgcggcagggtgacggccacctcacagcgcaagatcgacaccgcgctggagctgatggaccggcacgtcgacatcgcggatctgcttgaacagcttgccattccgattcccaccgtgaccacgccgcagatgttcatccatcagctgaccctgcaggcgcgcgcggaccgcaagcacatcgtgctgcccgagggcgacgacgaccgcatcctgcgcgccgccggcagggtgctgcagcgccgcgtcgccgacctgaccatcctgggcgacgaggcccggatccggcagcgctcgggggaactcggggtggacctgagcgacgtgaaggtcatcgacccgcgcaccagcgcgctgcgccccgagttcgcgcagcagtacgcgcagctgcgcaaggccaagggcgtcaccgtcgagcaggcccgcgaaatcatgcgcgacgcaacgtacttcggcaccatgctggtgtacacctcccaggtcgacgggatggtgtccggcgccgcccacaccaccgcacacaccgtgcgcccggccttcgagatcatcaagacggtgccggacgtctccaccgtgtccagcatcttcctgatgtgtctgcccgaccgggtacttgcctacggcgactgcgcgatcatccccaacccgacaccggagcagctggccgacatcgcgatctcctcggcgcgcaccgccgcccagttcggcatcgaaccgcgggtggccatgctgtcctactcgacgggtgactccggcaccggagccgacgtcgaaaaggtaagaacggcaacgcaattggtgcggcagcgcaaccccgacctgccggtcgagggccccatccaatacgacgccgccatcgaaccgtcggtcgccgccaccaagctgcgggattcgccggtggccggtcgggccaccgtgttgatctttcccgacctcaacaccggcaacaacacctacaaggcggtacagcgcagcgccggcgcgctggccatcgggccggtactgcagggcctgcgcaagccggtcaacgacctgtcgcggggtgcgctggtcgaagacatcgtgaacaccattgccatcaccgcgattcaggcgcaggggttgcccggtggacggtagcgacggcgcgcgccgggtgctggtgatcaactccggctcgtcgtcgctgaagttccagctggtcgatcccgagttcggggtggccgcctcgacgggcatcgtggaacgcatcggcgaggaatcctcgccggtccccgaccacgacgccgcgctgcgccgagcgttcgacatgctggccggcgacggcgtcgacctgaacaccgccgggctggtcgcggtgggtcatcgggtggtgcacggcggcaacaccttctaccggcccaccgtgctggacgacgcggtgatcgcccggctgcacgagctgtcggagttggccccgctgcacaatccgccggcgctccagggaatcgaagtggcccgccggctgttgcccgacatcgcgcacgtggccgtcttcgacaccgggttcttccacgacctgccgcccgcggcggcgacctacgccatcgaccgcgaattggccgatcgctggcagatccgccggtacgggttccacggcacctcgcaccgctacgtcagcgagcaggccgcggccttcctggatcggccgctgcgcggcctgaaacagatcgtgctgcacctgggcaacggctgctcggcgtcggcgatcgccggcacccggcccctcgacacctcgatggggttgacgccgctggagggactggtgatgggaacccgcagcggtgacatcgatcccagcatcgtcagctatctgtgccacacggccgggatgggggtggacgacgtcgagtcgatgctcaaccaccgctcgggggtggtggggctgtccggcgtgcgggacttccgccggctgcgcgaactcatcgaatccggtgacggcgcagcgcaattggcctacagcgtgttcacgcaccggctgcgcaagtacatcggagcctacctggcggtgctgggccacaccgacgtcatcagcttcaccgccggcatcggtgagaacgacgccgcggtgcgccgcgacgcggtgtccggcatggaggagctgggcatcgtgctcgacgagcgccgcaacctcgccgggggcaaaggggcacgccagatctcggccgacgactcgccgatcacggtgctggtggtccccaccaacgaagagctggccatcgcccgtgactgcgtgcgggtgctaggcggataggaagccgaggtcgcggcggccggcgccgaccgagggcgcgggatcggtgccgacggtgcgtgccagcagctcgtggtagatgtcgcgaaaatcggtggtgtacttcaggtctccgttgtcgaggtcggtgaggctgggttgctcgccgtagaatccgccgttgaccggtgcgcccgcgatcaacaccggtccggccgtgccgtggtcggtgccctgtgaggcgttggcccgcacccgccgcccgaactccgaatacgccatcagcaccacgttgcgcccggccatctgcgcgacgaatccggtgaccgcctcgtcgaaggtctgcagcagccgctgctgggtgccgcgttccccggcgtgggtgtcgaaaccgcccagttgcacggtgtagacgcgggccggcacccgggccttgacggcctgggcgaccacgtccagctgggctgccagcgaattgttctgcttggcaggcggtttcaccgaggcgaaggtggcgtcggcggtgcgcgcggcacggtaggccttgcacaccgcggccatcgccggggtgtcgtcggggtcgtcgtcgcccagcgcggtcgtcacggcgtcgaactgcccggccttgccggcgccgccgcccgggctcagcgccgcggccgtgcacttggcgccgaccgccagcggcggcagcacggccccgatgttgaccgcgcgcaacgggtcgtcgccggtggcgtcgagccagcggccgatccagcccgtcgacaccggctcgtccggggaggcggtctgccagatgtccatggagcggaagtgactgtggtcgtgtttcgggtagcccgcgccgcgcacgacggccagcttccgctggttccacagcccggccatgcccttgagcgccgggttgagccccagctgctgatccaggtgcaggacgtcttgcggggcgtaggcgagttcgggccgggcgtcgtgataggcgttgtccgcgtacgggatcagcgtgttgatcccgtcgttgccgccgtagagggtggcgatcaccagcacgccggcgccaggtgccagcggccggtcccgggccgcgcgcatcaggtcgggccaaccgaccgccaccgccgacgacagcagcccggccgccgacacgcccgcgctggcgatcaggaatctgcgacggttcatctcggtcatgacgtcaggtactccggggtgttgacggccgcggcgaccagccggggcggttggcccaccaggggttgcagcgcgcgggcggtgcggtcggaccaggcgccgacgccgatcaggtagccgaccgcgtcgatgcggtcggtgggcggggtgttctcgatgccggacaggtcgccggcgtgcgccagctcggtcgcggcgcgcagccgggccccggcgctggcggtggacagccagacctgcccgctgggccagccgccgacgctgggcggatagaacggccgctgccccagcgtgcgcaacgtcgcgtcgatcatcttgagtcgcttgggatcatcgacgggcacccgcagcgagcggatcacgccgatcagccattcgatcggggtgttgaccatgctggcccgggcgccggtgaactccgggtcggtgaggatggcccgggtcagggcgcgcaggtcgcggccggggccgtaggcggcgaccagccggtcgagcgcgggcggcgacggcgggtcgtcgccggccaactgctgccacagccgccccgccacgtacccggccgatttcggctgggcgagcaccgcgtcgcagaacccggcggcatcgaagttcgcgctgcggccgaacagcgtcttggccgtcgcgtcatggcgtttgggcagcaccgacgtcgcgccgccggcgccgatgacccagccggtcagggcgcgtgccccgttgcggacgtcgctctcggtatagccgttgccgtggcccagcgcgaacagctccatgaattcgcgggccaggttttcgttgggcgccttggcggtgctggtctgcccgtccagccagcgcagcatggcggcgtcggtcagcatggcgtaggccagggtgcggaaatcgcccagcgacagcgtgcgcagcttctggttctgcgcggccatctgcgccgccacccgcaccttctgcgccgaggtggcaaagtggttgtgccacaacaaggtcagcttctcgtggaacggttggcgcacgacgaccatgcggcggatccaccaatccgacagcacgccctgctgttcggtgagctgctggttgtactgcttgcgggccgcgggggtggcgcgtttgccgggcggctggggcgccggcagggcgggcatcggggtggccagcgcgccggggtcggcgtcgggatcggcggccagcatcgcgtccaggtggccgggccagccgcgggcgacggcggcgtcgacctcggggccggtcacgccgaaaccggcccggcgcagcatgcgcgccgtgccgacccacagggtggactgccccgccatggaataactgtgcggtgtgcagctgaaaattcgctgagggttcttgcgattttcttgaggttccacgggcggcgcgatgcggcgcgatccgacgctgccgcgcggccgccgttcgcgtgctgtacagtgaccgagggccggttcacggaaccggagttccgtttagggttgggcttcgcgggcgttgcgcgctagtcggcggcggcgcttgtctcgccccgcgaaaaatgaagggaggcagcggattttgcgcatcttgcgtagggcgtggatgcccctgctgctggtggtcgtgatttcgctgggcgcctacgcggtggtccgtatccgcgacacgttcggcacccacggcggtgtgacgagcggggagggcgccggcgacaacaccaagccgttccaccccaagcacatcacgtacgagatcaccggcgccccggccggcacggtgaacgcgaactatctggacgagaacggccagccgcacctggtcgaatcggcgccgttgccgtggtcgttcaccatcgtgaccacattgccgtcgatgtcggccaacatcgtcgcccaggccagcgagcaggtgcatgcactgcggtgccgggtcatcgtcgacgaccaggtccgcgacgaccgcaacaccaacgactaccaaccgttcatctactgcttggtgaaatccgtatgagtaacccgcacgcgcagtcccgactcccggtcattcccaggctcattcgcgtgctgtcgctgccgatcaccctgggctgggtgttcgtcgcggtcgccctgggggtgctgtcgccgtcgctcgacgacgtcgcgtcccagcactcggtgccgatgaccccgcgggacgcgccggcgttcaagtcgatgatgcacatcggcgacaagttcaacgagttccacaccgattccacggcgatggtggtcctggaggggaaggacaaactcggcgacagcgcgcacgagttctacgaccgcatcgtgcgcaaactgcgggacgaccatcagcacgtccagaacatccaggacttctggagtgatccgctgaccgccgccggctcgcagagccccgacggcaagtccgcctacgtgcaggtcttcctcaacggcgcccagggaaccacgcccagctacgagtcggtcgccgcggtgcgcaagatcgtcgacagcacacccgcaccgcccggcgtcaaggcgtacgtggccggcaacaccgtgctgaacgccgacaccagcatcgtcggccataagagcatggcgacgatggcgctggtctccatcgtggtcatcttcgtgatgctgctggtggtgtaccggtcgatcgtcaccaccgtgctgagcctggtgatcatcggcatagaactcttcgcggcccagggcattacggcgacggcaggcaatctcaacatcatcggcctgacgccctacgcggtcagcatgatcaccatgctcagcatcgccgcgggaaccgactacgtcatcttcctgctgggccgctatcacgaagcgcgctccttcggccaggacagggaggaggccttctacaccgcctatcacggtgtctcgcacgtcatcctgggctcgggcctgaccatcgcgggcgcctgcctgtgcctgacggcggcccggctgccgtatttccagaccatggggttgccctgcgcgatagcgatggtggtcatcgtgttggcggcgctgaccctggcgccggcgatcctggcggtcggctcgcggttcggcctgttcgatcccaaacgcgcgatcgacgtgcggggctggcgcaaggtgggcaccgccgtggtgcgctggcccaagccgatcatcgtggtgaccgcggcgatcgcggtgatcgggttcatcagcctgctgacatacgtgccgaactacgacgaccagaaattcacgccgaaggacatgcccgccaacgccgcgatgacggccgccgaacggcacttctcccaggcccggatgaacccggaattgctgatggtggaggccgaccacgatctgcgcgacccggccgacatgctcgtcgtcgaccgaatcgccaagagcgtctttcatcttcgcggcatcgagcgggtccagaccatcacccggccgctgggggcgccgatcgagcacagctcgatcccgttccagatcgccatgcagaactcgggcacgctgcagacggccaagttcatgaacgacaccatggcgaacatgctcgagcaggccgacgagctggacaagacgatcgccgtgatggagcacatgtacggcgtcatgaaggaactcaccgccaccacgcacagcatggtcggccgcacccacgagatggtggacaccaccaacgaattacgggatcgcatcgccgatttcgacgacttcttccggcccatcagaagctacttctactgggagaaacactgtttcgacatcccggtgtgctggtcgatgcgctcgctgttcgacgcgctcgacggcatcgacgagctctccgaccagatatcggggctcaccatcgatctcgatcacatggatcggttgatgccgcaactgctggccgatttcccgaaaaccatcgactcgatgaagacgatgcgcgacttcatgctgtccacccattccacgatggccggcatccaggcccaccagcaggaggccgccgagggctcgaccctgatggggcaatacttcgacgaggccaagaacgacgactcgttctacctgccgccggaagtcttcaaaaaccccgacttcaaacgcgggctgaagatgttcgtctcacccgacggcaccgcggtgcggttcatcatcacccaccagggcgatccggcctcggtcgagggaatcaaacacgtcgccggtgtcaaggacgcggtcgccgacgccatcaagggcaccccgctggagagctccaaggtgtacctggccgggaccgcgtcgatgtactccgacatgcaagaaggcgtcatcatcgacctcctggtcgccggaatctcctgtctcatcctgattttcacgatcatgttgatcatcacccgcagtgtggtcgcggcgttggtcatcgtcggcaccgtcgccgcctcgctgggcaccgcctgcggcctgtcggtgctgatgtggcaggacctcatcgggctcggcgtgcaatggatcgtactgccgctgtccatcgtgatcctgctggcggtgggatcggactacaacctgctgctggtgtcgcgactcaaggaggagatccccgcgggcctcaacaccggcatcatccgcggcatgggcgcctcgggccgggtcgtcaccgccgccgggctggtgttcgccttcaccatggcgtcgatgatcgtcagccagctgcgggtgatcggcgagctcggcaccaccatcgcgctgggcctgctcgtcgacaccctgatcgtgcggtccttcatgacgccttcgatcgccgccgcgctcgggcactggttctggtggccgatcaacaccatccgcatgacccgacgcacacaccacgacgaggaggcacacacggcgccgatccggcagccggctctaaggtgaactgcgtggggcagccgcaatcgcagatggagccggaatccaagcttcgccagcgcaccgaggggcgactcgatcgctcgcgcgaccccgcgatcctcgatgccgcgttggcggcgctggccgaacacggctatgacgcgacgaacatgaacgacatcgccgcgcgggccggcgtcggcaaggcagcgatctaccggcggtggtcgtcgaaggccgcgttgatgaccgacgccctgatctactggcggcccgagctcctcaacgacgacgcgcccgacaccgggagcctggccggcgacctcgacgcgatcgtcaagcgcgccaagcgcaacgacaacgcgttgatctccaacgacctcgtgttgcgggtcgccttggaggccgcgcacgatcccgagctcgccaccgcgctgaacgacctgatcctgttcaagggccgacgggtgctgtcggccgttctggcgcaggccgccgaccgcggggaaatcgacccgaaccgcgactggtcgttggtcgccgacgtgttgaccgcgatgggcctgctgcgcgccatcagcgggcagcgcgtcgacggcaagttcgtgcggcgggtcatcgacaccctgatcctgcccgccgtgcgggcggcacccgaatagctatcgcggcctgtgcacagccgcagtcgcggtcgccgccggcgtgccagggtttctcgtatgggggagacgccggtcgtcggcagcgaggaactggcgtccgggcggctgaaccgtcaccggctgcgggtggcctaccgtccggtgttcccgaatgtctacctgcccgcgcaggtcgagccgacgctgccgcttcgcatccgcgcggcctggctgtggtcggggcggacggcggtcatcgccggcgcggccgcggcggcggtgcacggcgccgcgtggatccccgatgctgtcccgatcgagttgatccaccacaacactcgtgcccccgacggggtgctgatccggcgcgacggcctgtgccccggcgaaacgcagatctgcgacgggctcgccgtcaccacaccggagcgaaccgccttcgacatcgggcgacggggtgccgtccgctcggccgtggtccggctcgactcgctggcgcgcgcaacgggtttcaaggccgacgacgtgttgcgggtggccggggcgcacccgcgctcgcccgggctgcggcgcctggaggcggcgctgggcctcgtcgaccccggtgcgcagtcaccgcgggagagctacctgcggctgctgctcatcgacgcgggtctgccccggccgcagacccaggtcccggtgccgggcgccgacggcatgcccgtcgcgtacctggacatgggctggcccgagtggatggtcgccgtcgaatacgacggcgaccaccatcgcaccgaccggcgccagtacgtcaaggacattcgccggctggagatgctcgagcagctgggctgggtcatcgtccgggtggtcgcagaggaccggccggcggacatcgtccgccgcgtccgcgcggcactggcgaaatccggtgttgcgcctcggctttcagtgtgaggtgtcggctttcggtgttgcggtacggctttcggtgttgcgctacggctttcggtgttgcaccagggcgcggatcgtcggcgtgtcgccgccctgtgtacacactcgacgcccaggatgcacactcgggccgagacgccgagacgccgagacgccgagacgccgagacgccgggacgccgaggcgccgaggcgccgggacgactcagaacgtgctggtgggtcgcaccttgttggccatgtccaccagcgcgtagcggtgccgctgggtgggggcgacgcgggccaggttgcgcagcgccgcctcgacgcccagccgcagcccgtgctcggtgaacgggaagcccaggatgtggttggtgctggccttgttgtcctccagccagtccatcgcgcagccgagcaccagcgcgcggatctgcaacacccgcggctcggtcggcggcagcgcctccacccgccgggccgcgtcccggatttcctcttcggtgatctcgctcttggaccgcccggacaacagcgtcaccgcgctggtcagccgcgcggtggtgaagtgccgcgaggtggccggcacctcgtcgagggtgcgcaccgcggcggcccgatcaccctcggcggacagggttctggccaatccgaaggccgccgagatcacgccgtcgttggtcttccacaccgtctcgtagaaccggtgctcgtcgacgtcgccggccagctcggcggtcgcggccaacgccaacttgggcgccagctcgcccgggaaggtgtccagcacctcggtgaaatgcgttgtggccgaatcgtagtcgccggtcagcagctcggccaccgccttgtaccagaccagccgccactgccagccgacccgctcggccaggtcgtcgagcttgcgggtggccttggccacgtcgccgaggtccagcagcgcgcgcacctccatcagcggcagctcgatcgactcggacagctcgaccccgtcggcgtccagcgtcccgtgccgggccgcgcgcagcgagtccagcgtctgcaccggctgcgacaacaccgtcgcctgcagcaccggggcggcgacgtcggccggatcgaccagcggcacctgcagcgcggtcacgatctcgcgggcggtcagcttctccgaatgcacctggccgtccaggtacacgtcggtgtgcgcgaccagcaggtcgaccccgaacgtcgagcggctgggcgagaagatggtcgacaggccgggccgcggcaccccggtgtcgtgcgcgaccacctcgcgcagcacccccatcagctgggccgacatctcctcggtgctggagaaccggcgccgcgggtcggggtcggtggcgcggcgcagcaaccggcggaaggagtcgtaggtgcccagcaccgggtcgttgtcggggatgccgtcgacgtagcggccgttgcgggtgggcaggttcagcgtgagcgcggccagcgtgcgccccaccgtgtagatgtcggtggccaccgtcgggccggtccgcacgatctccggcgcctggaaacccggtgtgccgtaaaggtatccgaacgagttgatccgcgacaccgcgcccaggtcgatcagcttgagctgctcctcggtgagcatgatgttctccggcttgaggtcgttgtagaccaggccgatcgagtgcaggtaacccagcgccggcagtatctccagcacgtaggcgatggcctcggagacgggcagcttctcgcccttgccgtgccgcagcggctgcccgccgacgtactccatgacgatgtagccgaccggattcccgtgccggtccacatgctcgacgaagttgaagatctgcacgatctgcgggtgcaccacctcggcgaggaactgccgttcggccatcgcgatggcctgcgcctcggcgtcaccggagtgcaccaggcccttgagcaccaccggccggtcgttgacgttgtggtccaccgccaggtagacccagcccagcccgccgtgcgcgatgcagcccttgacctcgtactggttggcgacgatgtcgcccggattcagttgcggcagaaacgaatacgcgctgccgcagtgcgggcaccagccctcggaggtgcccttgctcttcttggtggaccgccccaccggtttgccgcagttccagcagaagcgcttggactccggcaccaccgggttggtcatcagcgcctcgcgcgggtcgatgtcgcggccgcgcggaatctcgaccagcccaccgccgagctgacggaccggcggcagcgcctgcgtcgccaccgtcatgcggtcggcgctgtcggtgtccagggcacccagcgagatgtgcgggaagtcgtcgtcgtcatcgtcgaagtcgggccggaacagcgcctgggtggcctgcagccgcccggttgccgcgccggcctgggcgtcgtcgcccacctcggccggctgggtgcccgggcccatctgctcggcccccggttccggctgctcgctcttgttgtccggctcggccatcagtccagatacctcggcgtgggcggggccggcgcggggcccagcacggtcaaccacttgcggtacaacgtgttccaggtgccgtcccggcggatccgctccagcgttccgttgacgaagcgcaccaacccggtgttgttcaggttgatcccgatgccgtagggctgggtggccatgttcggcccgacgatgtgcaggtacgggtcctcttcgaccaacccggccaggatcgagtcgtcggtgctgacggcgtcgatctcgcgctgctgcatggcgaccaggcaatcggcccagttgaccaccgacaccacgatcggcgggggatcgatctgccggatccggtgcagcgacgtggtgcccttggccacgcagacgcgtttgccggacaggtcggagaccttggtgatcggcgagtcgcgtggggccaggatgcgctggttggcatcgaggtacacggtggagaagttcacctgcttgcgccggtcgcaggtgatggtcatggtcttgaccacgacgtcgacctcgccgcgctgcagcgcggtgacccgctcgtccgacgacaggatccggtactcgacgtgcgagggcgcgccgaagatgtcgcgggcgatctcgccggcgatgtcgacgtcgaagccggtgatctcgccggtgatcgggtcgcggaagctgaacaggttgctgccgatgtcgagcccgacgatcagccggccgcgggcgcggatgtcggccaccgcggcgtcggcctccgccttggtggggaagggtcgcaggctggccgtcaggtcgcagttctggtccgggccgtcgggcggcagcggcggctgcggcggcagctgctccatgccgaccggggtgggcggcggcaacgtcggcacgctggccacccgcagcgactcggtgtggccgcaccccgccgcgaccagcaccgcggccagtgcggtgcacgcccgtcgcagcaggggcagcccggccgtcatcggtactctttcagcctcggccacaggcccagcgccaccgcgatggcggcgcccagcgacagcaccacgccgccgacctgggcgccggacagcccgctgcgcgcgttgatgacgtcgttgcgcaggtggatgcggccctggtccatcgccttcatcagctcgtcctgcagcttgtcgaacgcgggggtggagtcctcctcgctgctgcccagcgcgacctgggtggcggcccgatagttgcccaccgagatgtaggaggtgatccggtcgttggcttggcgccagcgcaggagcagctggtcggcgccctccaggtcgggcttgtccaccgcatcgctgcgcgacatgtactcgtcgagctggcggtgcatcgagtccaggcgctggtagaacgactgcttgcgcttctcttcgtcgccgcggcggatcagcgacagcgtctcgtcggcgcgggcctgctgcgcggtgatggcgacgttggtgacggtcttgagcgactcggcggcagtgtccttggcgctacggctggccgtcgtagaaatggtcaacgctgtcccgacccacaccaccatgacgagaatagcgagcgcgcccaccaccagccccggattgatccggcgccgggtgcgccgggccagccagcgatgggcgaacgccccgaagaccacggtggcgccgaccaccatgatgaccggcgccgggatctgggtggacgcggtggtctcctcgtccacccgcttggaggtggcctggtacagccgggccgcgtcgggcaggatcgtcgactgcatcagccccgacgcctccgacaggtacgacgagccgaccgggttgccctgccggttgttggtgcgggcggtctcgatcagcccagtgtagacggccagctcggcgttgatccggcccagcagctgcaccatcggctcgtcggtgagcccgctggaggcccgggtcaccgccaccgcggcgtcggtgatggcctgctcgtagcgctgccgcaccggcggcggctcggcctcggcgatgaaggcggtggccgcggcggcgtcggccaccgacagcgtggtgtacagccgcccggccgcgaacgacagcggctcggtgtggttgagcaccgtggtgagcacctgctggcggtggttgatggtggtcgaggtggcgaacgcgctcaggccgcccagcgccgccagcacgatgccgatggtcaggatgcggccgggcgtcgtcgagatgaaccaccagcggggatgggctggttcggccggtgaccgcgagccctgcggctcggtcgacgggtgcgccagctcaaccgtcacgtctgatcagccctcatctctcggccactggatttcgctgcacggacctgtataagcgaagtctaagagcatgttcgggtggatgggtggaggcgaagcaattgacgacgtgccagggaacaaagaactaagtctgcctatcctgaactcgtgcacggcgacggtgacgggtgggtgatctccgagcgcggcgcccactactggggtcggtacggcgccgccggtttgctgctgcgcgccccgcaacccgacggtacgcccgccgtgctgctgcagcaccgcgcggtgtggagccatcagggcggcacctggggactgcccggcggcgcccgggacagccacgagacacccgaggagaccgcggtccgcgaagcgaacgaggaggccggcctgctggtcgaccggctcgccgtgcgcgccagcgtggtgacggccgaggtcgccggggtgggcggcacccggtggagctacaccaccgtgatcgcggacgccgacgaactgctgcacaccgtgcccaaccgggaaagcgccgagatgcgctgggtcgccgaggacgaggtggccgacctgccgctgcaccccggcttcgcggccagctggcaccggctgcgcaccgagcccgcccggctgccgctgagccacggcgacgaacgccggcagtacctgccccgcaccatcgagctggaggacggcgtcttcgtctggtgcatgcccggcgacccggccgacaccgacgaggcgtccgcgcagctgtgccgccggatcagcgcgctgctgccagcgccgagctgagccgccgggccgccgcggcggggtcgtccgccgcggtgatcgcccgcaccaccacgacccggcgggccccggcgtcgagcacctcgggcagccgctgcgcgtcgatcccgccgatcgcgaaccacggcttgccggtgtgcagctcggcggccgcccgcaccagcgccaagcccggcgccgcgcggcccggtttggtgggcgtgggccagcagggcccgacgcagaagtagtcggccggtcccgccgccgccgcggccatctggtcgcggtcgtggctggacagcccgagcagcacgtcgggcccgacgaatgcgcgcgccacctccagcggcaggtcaccctgccccaggtgcagcacgtcggcgccggccgcgcgggcgatgtcggcgcggtcgttgacggcgaacagggcgccgtgccggcgggccgcgtcggccaggatctcgcaggcggccagctcgtcgcgcgcctccagcgggccgaaccgctgctccccgggcgaccccttgtcgcgcagctggatgacgtccacgccgccggccagggcggcgtcggcgaactcggccagatcgccgcgctcccggcgggcgtcggtgcacaggtagagccgcgcggcggccagagttgccagacgttgatgcacaccgcgacgctagcgcgctagcgtggaacccgaacaactcgttttagacacgggagtcccgggaccggggtctgagagtgggcgcgcccgcccttaccgtcacacctgatccggatcatgccggcgaagggaggccgcgaatgccctcggactgcgggtcgctggccgtcgtcggtggcggggtcatcgggctggcggtggcgcgccgggccgcgcaggccgggtggtcggtgcgggtgcaccgcagcggcgagcggggcgcctcctgggtggccggcggcatgctggccccgcacagcgaaggctggcccggcgaggagcgactgttgcggctgggcctggaatcgctgcggctgtggcgggagggcggtttcctcgacgggctgccggggcggctggtcaccgcgcgcgagtccctggtggtggcggtcgaccgcgccgacgtcgccgacctgcgcaccgtcgcggattggctgtccgcacaaggacatccggtggtctgggagtcggcggcccgcgacgtcgaacccctgctggcgcagggcatccggcacggcttcactgcgcccaccgaactggccgtggacaaccgcgcggtgctcgaggcgctggacgcggcctgcgagcggctcggggtgcgctgggcgccgccgctgcacgacctggcggaggccgacgccgacgcggtggtgatcgccaacggcatcgacgcgcaggcgttgtggccgggcctgccggtgcgcccggtgaagggcgaagtgctgcggctgcggtggcgaaagggttgtatgccggtgccgcagcgggtcattcgggcccgcatgcacggccggcaggtgtacctggtgccacgcgcggacggggtggtggtcggcgccacccagtacgaacacgggcgagacaccgccccggtggtctccggggtgcgggacctgctcgacgacgcctgcgcggtgctgccggcgctgggcgaatacgagctggccgagtgcggcgccgggctgcgcccgatgacgcccgacaatctgccgctggtgggccgcctggacgcgcggaccctggttgccgccggtcacggccggtcgggattcctgttggcgccctggacggcagaacagatcgtgtccgaactggccccggtgggagcacaccgatgatcccgccggcgacgatgcttcagcgaagcgatgaggaggagcggcgccaatgatcgtcgtagtcaacgagcaaaaggtcgacgtcgacgcgcacaccacggtcgcggcgctgctcgatgagctgggcttcggcggccgcggcgtcgcggtggccgtggacgacgccgtgttgccccgatcccgttggacgacagagctttccgagggcgcgcggctcgaggtggtgacggcggtgcagggtggttgattcgaaactgaccatcgccgaccgcagcttcaactcgcggctcatcatgggcaccgggggagcgggcaacctggcggtgctggaagaggcgctgatcgcctcgggcaccgaactgaccaccgtcgccatccgccgggtggacgccgagggcggcaccggcctgctcgacctgctcaaccggctgggcatcacaccgttgcccaacaccgcgggatgccggggcgcggccgaggcggtgctcaccgcgcagttggcccgcgaggcgctgaacaccaactggatcaagctcgaggtgatcgccgacgagcgcaccctgctgcccgatgcggtcgaattggtcagggccgcagaacaattggtggacgacgggttcgtcgtgctgccctacaccaacgacgacccggtgttggcgcgccgactcgaggacgccggctgcgcggcggtcatgccgctgggctcgccgatcggcacgggtctgggcatcaccaatccgcacaacatcgagatgatcgtcgccggcgcgggcgtcccggtggtgctcgacgccggcatcggcaccgccagcgatgccgcgctggcgatggaattgggttgcgacgccgtgctgttggccaccgcggtgacccgggccggcgatccggccgccatggccgccgcgatgtcggccgccgtcaccgccggctatctggcccgccgggccgggcggatccccaagcggttctgggcccaagcgtcgagcccgcctcgatgaaacgctatgtggcgctgggcagttcgatggccgccggccccgggatccggccccgcgccgccggggctccgcgctggtcgggtcgatccgcgcgcaactacgcgcacctggtcgccgcgcgttgcggctacgacctggtcgacgtcaccttctccggggcgaccaccgcccacgtgctcaccgagcgccaacacggtgcggcgccgcagatcgccgcgctggacggctcggagagcctggtcaccgtcaccatcggcggcaacgacgtcggctacatcccgctgttgacggtcgccgcgctgccgcgcccgctgcggcggctgccactgctgggtgaccgcatcgccgaactgctggacgccgaggcgcgaaacggcgcgctcgaggcggtgttcgaatcgctgtgcgccgtgggcaccgcggtgcgtcaacgctgcgcggaggcacggattttcttcgtcgactacctgacgatgctgccgccggcgggcgtgccggccgcgccgctgtcacccgccgatgccgacctgggccggcacgtggccgccacgctggaacggatgaccgccgacgccgccgcggcgaccggctgcgatctcattccggcggccgcggccagccgcgaacaccacgcctggtccgccgacccgtggacgacgctgccggcgcgctacggtctcccgctaccgggccggcccgcgccgttgcaccccaatgccgccgggatgcgtgcggtggcggaattgattgcggcgcgactgtaaacgtcagccgttggtgcgccaccactggtagagggcgttgacgtcggagttggccgcggtcaggtggcccagcacgttcttggcgtcggtggtccaggtcagcgtcgcgtagttcttgtaagtgccgcaggcgatctgaccacccgtctggccgttctgcttccaggtgcccggcgactgcccggcgtctccgcagttggccagcgacacgtccttgatggtggagctgaacgcggacgccaggttggtgccgttggagaatagggcgtagacgcccgaccccggtccgctggggtcggggctctgcccgcacagcagctcggccagctcgccggactcggtcagttcctgcggcttgcagttgttcaggccatagcctttcgacagcgccgccgccagcgtgttcatgtccgaggcgctgccggtgttgggttcggcgagtgcgggggcgctacccgcgagagccacactgccggtgaaagctgcggccgacaccagacgcagcgcggtgttccgatatgacattttctgactccctgcggttgatggaaacaaagcgggcgaacgcatcttggcgctcacccgttggcgcgccaccagtggtagagcgccgcgacatcggtgttggacgcgcgcaggtagctcaggatgttcttggcgtcgatggtccagatgatctcggcggcgttgcggaaggtgccgcacgcggcctgcccggcgctggcggacgaaccatccttgcgccagctcgacggcgactcgtgggcgtcgccgcacggggtcaggacatcctctttgatggtggcccggaacgcggtggccaggttctcggcgttggtgaacaacacgtacttggcctgcgccggtcccttcgggtcggggctttgcccgcaggtcagtaccgccagttgcctgccgcggtcgatgtttccggcggtgcagatattcagcccgtagcccttcgacagcgacgcggccagggtgttgatgtccgacgggttaggtgtgccggccgggtcggcggccgccgcggcgctgcccgcaaagacgaatccgccagtgaataccgccgccgtcgccgccctcagcgcattgctgaattcggacatcaatggctcctataaccgcacctgttaacacggatagtagggctatgtcgcggtaatgcaatacgttccgtcggcaattgtctgtctgggcatcgatttccgcgcatcccgcggaggaccagccagtggcggcagagtgaatttttccgcgccatatttcgaattctgttgaggggcgatcggtgtcggcgtggcgcggatgcaccgatgtggccgggtcggcacggcccgactcggccgaatcaaattttgtcattgctagtgccgacccgagcgcgagcgggtatggttagcaccgctttacgccagctaactcccctcgactggagaatccatgacacagccgccgcctcccccgccgccgcccgggtatccgccgcagcaaccggccgcccaagcgccgaacaactatctggtgtggtcgatcctggtcaccctgttctgctgtcttccgttcggcatcgtcgcgatcgtcaaatccagccaggtcaacggattatgggcgcagggccgctacgccgaggcgcaggcgtccgccgacagcgccaagaaatgggtgatctggtcggcggccatcggggtcgtggtgggcatcatctacggcatcttgatggcggtcggcgcgctgaacacgaacaccaacgcggcgctcgccgcgatgttctgacgccgcgggggcctcgatcatggtgatccgccggggggcggtgcagcagaatttgactgcgccggtggtggtggccgcatccgcgacggtgctgtgcgccgccgtctgggcgggtgacccgaccaccccgggcgggccgctgccggtgtgccccaccaaggcgctgctgggcgtcgactgtcccggctgcggcagcctgcgcatggtgtacgcgctcatgcacggcaatctgttgggggcggccaggttcaacgccttgggcctggccgccgtcgtgctgttgatgtgggcgtacttcgcctggacctacgggcacctggtgggacgacggatccgcagttggcaacaccatcgctgggccgcggcggtgacgctgtcgttggtgctggcctggttcgtggtgcgcaacatcccggtggcgccgttcaccgcgctgcatgtctgaggacgccgtgtcctgaatccgcccacccgggccgcggtctaacctggggcgcgatggtgaacaaattcacgacatttccggcgctgctcgcggtggtcgccctgaccgcgttggccaccggctgcgggcaccgctcctccggcgcgggccaaaccaccggggaccccgccgcggccgagttcgcgtccgggttgcgcaacaaggtcaccaccgacgcgatgatgacccacctgaccaagctgcaagacatcgccaacgccaacaacggcacccgggcggtcggcacacccggctacgaggcgagcgtcgactacgtggtgaaaaccttgcgcgacagcgggttcaacgtgcagaccccggagttctcggcccgggtgttccacgccgaaaagcccgatctcaccgtcggcggcaggccggtggaggcccatgcactggacttcagcctgggcaccgggcccgacggggtgagcggcccgctggtcgccgccccgcccaacaaccccgggtgcgcggtcaccgactacggcagcctgccggtgcagggcgcggtgatcctgctcgaccgcggcacgtgcccgttcgcgcagaaggaagatgtcgccgcgcagcgcggcgcggtggcgttgatcatcgccgacaacgtcgacgaacaacagatgggcggcacgctcgggccgtcgaccgaggtgaagatcccggtgctgagcgtgacaaagtccgtcggggtgcagctgcgcgggcagcccgggcccaccaccatcaagctcacggccagcgcgcaaagcttcaaggcgcgcaacgtgatcgcgcagaccaagaccggatcggagcacgacgtggtgatggccggggcgcacctggacagcgtgcccgagggcccgggcatcaacgacaacgggtcgggcgtggccgcggtgctggaatccgctgtgcgactgggcagttcgcctccggtgcacaacgcggtgcggttcgggttctggggcgccgaggagctcgggctgatcgggtcgcgcaactacgtcgagtcgctggacttgaccgcgctgaaaaacattgcgctgtacctgaatttcgacatgctcgcctcgccgaaccccggctacttcacctacggcggcgaccagtcgctgccgatggacgcccgcggccaaccggtggtgcccgaagggtcggcgggcatcgagcgcacgctggtggcctacctgaagtcggccggcaagaccgcacaggacacctcgttcgacggccggtcggattacgacgggttcaccctggcggggattccggccggcgggctgttctccggcgccgaggggaagatgtccgccgatcaggccaagctgtggggcggaaccgccgaccagccgttcgaccccaactaccaccagaagaccgacaccctcgaccacatcgaccgcaccgcgctggggatcaacgggggcggggtggcctacgcgatcggtctctacgcccaagacctcggcggccacaacggcgtccccgccatggccgaccgcacccggcacgtgctcgccaagtcatgaccgtccggctgggcgcgacgctgctgtggatcgccgtgctgctggccggttgctcgtcggcggggcccggactgccgaccgcggcacccgatttgggccacggcctggccaagaaggtgaccgccgacgccatgatggcccacctgcgcgccttgcagaacatcgccaacaccaacggcggcaaccgcgcggacggcaccccgggctttcaggccagcgtcgactacgtggctaaagcgctgcgcgacaagggtttcgacgtacagacgccgcagttcgaccggctctacccggtgtcccccggcaagccgacgctgaccgtcgcgggccgcggctaccccgtcgaccaggcctcgatgttggtccagaccccgcccggcgggctgaccggacccgccgtccgcccggcccagccgtcgggttgcgcggccagcgactaccccggcgccctgcccaagggtgcgatcgccgtcgtcgacgacacccgctgctcggtggtcgacaaacagaacagcgcggtggcccggggcgcgagcgcgctgatcgtggtgagcgcacccgacgggcacggcgccccgcccaccttgttcacccccggctactacaaacagctgagtgtgccggtggccgtcgtcaacccgtccggcgccgccgcgctggccggtgcaggcgggccggtgcggttaatcctggatgcagtcaacgtcaaggtcacgtcgcgaaacgtggtggcgcagaccaagaccgggtcagcccacgaggtcgtcatggtcggtgcgcacctggacggctcgcgcgccggaccgggcatcaacgacaacggctccggcgtggccgcggtgctggaaaccgcgctgcagctgggcccgctggcgccggtaagcaacgcggtgcggttcgtgttctggggcgccggggaagacggactgggcggcgtgatggattacctgttcggcctggaccgcgaccaactcaacgacatcgcgctgtatctgaacttcaccatgctcggctcgcccaacgccgggttcttcaccgacgacggcgatcagtccgggccgccggcccccggtatttcggccgccgacgttcccgaagggtcggccggcatcgagcgcaccctggcgggctatctgaacctggccgggaagcgtgcggcggacatgcccctgaacacccgggccgactaccaccccttcatggtggccggtgtgccgatcggcggcatgaccaccggagcctcgcaaccgaaaaccactgtgcagtcccggttgtggggcggccaggccggcgtgccgttcgatccgaacttccaaagcccccgcgacaccgccgacaacatcaaccgggacgccctggcggtgatgggttccggcgtcgggttcgcggttggcagctacgcccaatcgatcggcggggtcaacggggtgccgccgcacgacaagcggcatcgcacccgagtgccctgaccgcggcacaacgagttacgccggcacgccgaagggtgagaaatcgcgagatcccttgaagggagccagcgcctttcttgcccccggcgacggccggtcgctctacactgagccatgcacagccacgcgctcaggtcggcattcgtgtgggccgcggcggtgttgctggtggcgggttgctcgacgttcgtcgagggacgcgcgctgtcgatgctcaacgacccgttcctggtcggtggtctgcccgcgaccaacgggcccagcggcatccgctctaacgcacccgcccccaccggcaaggtgctcaacaccgacaacgggtcgatcgactcgctgtcgttgctgtcgatcaacgacatcgaggattactggcgctcggtgtacggccaatcgctgaagggcaaattcgttccgatcagcaagatcgtgtcctacaactcgaccgatccgagcagtccgatcgtgtgccacaacgacacctaccaactggtcaacgcgttctacacgtcgcggtgcaacctgatcgcctgggaccgcggcgttttcatgccggtggcgcagaagtatttcggcgacatgtcggtgaccggtgtgctggcgcacgaattcgggcacgcgttgcagcagatggccgcactggtgaccaaacgcgatgcgaccatcgtgcgcgaacagcaggccgactgcttcgccggggtctatctgttctgggttgccgacggcaagtcgccgcgcttcacgctgagcaccgccgacgggctcgaccatgtgctggccgggatcatcaccacgcgcgacccggtgatggacagcgagaccgcgaacgacgacgcgcacggctcggcgctggaccggatcagcgccttccaaatgggtttcctcaacggcgcctcggcctgtgcgtcgatcaaccgcagggaaatcgagcagcgccgcggcgacctgcccaatgccctgcgggtcgacaccagcggcgcaccggagaccggcgaggtcccgatcaaccaggacaccttgtccacgttgatggagctgctgggaaagatcttcgcgccggccaatccgcccgcgctgagctaccaaccggccgcatgcgccgacgccaagcccagcccgccggcgtcctactgcccggccaccaacaccatcgccgtcgacctgcccaagctggccgcgctgggcagggtcgccgacgagaacgaacacagcctgccccagggcgacgacaccgccctgtccgtggtgatgtcgcgctacgcgctggcggtacagcatgaacgcggcctggccatgcagagcccgtggaccgcgctgcggaccgcctgcctgaccggcgtggtgcaccgcaggatggccgagccgatcgagctgccctcgcacaaccaattgctgctcaccgcaggcgatctcgacgaggcggtggccgggctgctgaccaatcatctggtcgccagcgacgccgacggcaccagcgtgccggcgggtttcacccgcatcgcggcgttccgcggcggcgtgaccggcaacgcggacgcctgctactcccggtatccgggatagcgaaagccgaacgccatcaaccgatttcggccagccgggggatcacctcatcgcccagccggcggatatagccgacgggatccggattgccgggcagcggccccacgttgatcatgtcgatgccgagccggccgaagcgttccgccgtcctgaggtattcgtcgaggttctcgaacgggtcgagggtcgccaggccaccgcacgtcttacggatatcccgcgggtcgcggcccaccgcgtcgcagtgccggtgcagcacctcgatcttgtgctcgagctcggcgaggtcgttcgacatgctgttccagacgtcggcgtactgcgcgaccaaacgcagcgtcttcttctcgccgtccccaccgatcaggatcggcgggcgccgaatcggctgtggcgcacagatcgtctcggccagccggtagtgcttgccctggtacgcgccgtcgtcgtcgctccacatctgccggcagatctgcagggtttcctcgagcatctcgaaccgtgtgctcagcgcgggatacggaatgcccaacgcggtgtgctcgcgttcgtaccaggccgccccgagtcccagcatcgaccggccctgcgacaacacgtccagggtggtgaccgtcttggccaacacgccggggtagcgataggtgaccccggtgaccagcagcgccagctcgatcgtggaggtctgcgcggccagaaaacccagcgacgtgtagccctcgaggaacggattctccgcgggcccaagctgttccatctggaagaagtggtcggccagggtcaacagcgtggcaccgccctgctcggcggcgcgggccgcctcggtcagcgtcgggcccagccgtgccgggtcgccgggcagaaagtcgatgaaatgcaatcccaattccatggtgggtccctctctgctattgctcggtcaagcgctcgagcagcgacagcgcgtcgacgatgacgcgccgctccgcctccgtgtagcgctcctggatggcgcgggccagccactcctcccgggcacggcggtcgctctcggcgcgcttgcggccggccgccgtcaacgagacgacctggcgccgcttgtcattcgggtcggggctgcgttcgatgagccggcgttggcccagcgcagccaggatggtcgccatcgactgggggcgcacccgttccgccgcggccagtgcgctggccgacgacggtccctctttccacagccgggtgagcaccgccgtctgcgacggggtcaacccgtcgaccgcgatgtccttcagccggcgccgcagccggctgaacaccacccggatatcgcgcgcggccgccaccgcggagtcgctgacgccatccacacggccagcctaaactgcacagtcaaaactgtccagttaaaactgtctaattccggccgagcagctgcagcgcggcgtcgacggccagcgccgccacgttcagcgtcttggaccgcagatcgtgtcgggcgctggcgatctcgaccaccgccgtcgttccgccgaccaacgcggcggccgcgttgagctcctcgggcgtcccgaagggatccgacgtcccgtgggtgaagaccgtcggcaccgtgatggccggcagatgctcggtgcgggcccgttccggcttgccgggcggatggaccgggtaggagaacagcgtcagcacgtccaccgcggcgtcaccggcggcgaccaccatcgacgtctgccggcccccgtatgaatggccgccggcgatcagcgggccgtcggcaagcccgcggcacagcgtgatcgcctcgacgatgccggcacggtcggcggcgcccgacccggacggcgggccggtgggccggcgccggcggaagggcaggttgtagcgcaccgccagccagccgcgctgggcccactcgtcgcaaacctgctgcagcagtggcgaatcccggttgccgccggcgccgtgggtgagcaccaccacgccttcgggggtgccgtcgggccggtgggcgatgcccgcgatccggtcgaggttcatccgtcccccgagagccggaacaaggcggagacggggccgtggccgtggcccagcgggtaggaggcgcgcaaacactcggtgacccaacgctttccgaaggcgaccgcatccggcacggtgaagccgtgcgcgagcgcacaggcgacggcactggccagcgtgtcgccgccgccgtggtcgttgccggtggccagccggtgcgcgtcgaactcgtagcacgagtcgccgtcgtagagcaggtcacagctgcgttgcgacgaccgcagatgcccgcccttgaccagcacccattgcggccccagcgcgtgcagggccttggccgcagcccgctgcgacgcggcatcggtcacgtcgatgtccaccagcagccggacctcgtcgaggttcggcgtcaccagggtggccagcgggaacaattggccgcgcagggtgtccagcgcgtcggcggccagcagcgggtcaccgtgcatggacgcgcacaccgggtcgaccaccagcggcaccgacaactccagccggcgccaggtcgcggccacctcggcgatgatgggcgaggacgccagcatgccggtcttggccgcctggatgccgatgtcgccggcgaccgcctcgatctggccggccaccacgtcggcgggcacctcgtgaaagctgttgacccccaacgtgttctgcacggtcaccgcggtcacggcgacgcaggcgtgcacgcccagcatcgccatggtgcgcaggtcggcctggatgcccgcaccacccccggagtcggatccggcgatggacagcacccggcgcggcgtggtgcccggcggcgccagtggcagcgtcggcggcggccccgtcactgtgccagcggtagatacacccggttgccgtgctcggcgaactcgcgagacttgtcggccatggccgcctcgatcgcttcctcgctgtccagcccgtgcttggccgcatagtcgcggacgtcctgggtgatgcgcatcgagcagaacttcggcccgcacatcgagcagaagtgcgcggtcttggcgggctcggcgggcagcgtctcgtcgtgatactcccgcgcggtgtcgggatccagcgacagcgcgaactggtcgttccagcggaactcgaaacgcgcctggctcaacgcattatcgcgctgctgcgcgtgcgggtgccccttggccaggtcgccggcgtgcgcggcgatcttgtaggcgatcacgccgtccttgacgtccttgcggtccggcagccccaggtgctccttcggggtcacgtagcacagcatcgccgtgcccgcctgggcgatgatggccgcgccgatcgccgaggtgatgtggtcgtaggccggggcgatgtcggtggccagcgggcccagcgtgtagaacggggcctcctcgcaccactcctcctccagccgcacgttctccacgatcttgtgcatcggaacgtgcccggggccttcgatcatcacttgcacgccatgggatttcgcgatcttggtcagctcgcccagggtgcgcagctcggcgaactgcgcggcgtcgttggcgtcggcgatcgagccgggccgcaggccgtcgcccagggagaaggtgacgtcatagcgggcgaagatctcgcacagctcgtcgaagttggtgtacaggaacgactctcggtgatgcgccaggcaccaggcggccatgatcgacccgccgcgggacacgatgccggtgacccgcttggcggtcagcggcacgtagcgcagcagcacaccggcgtgcacggtcatgtagtccacgccctgctcgcactgctcgatcacggtgtcgcggtagatctcccaggtcagcagcgtcggatcgcccttgaccttctccagcgcctgatagatcggtacggtgccgaccggcaccggcgaattacgcaggatccattcgcgggtctcgtggatgttcttgccggtggacaggtccatgatggtgtccgcaccccaccgggtggcccacaccatcttgtcgacctcctcggcgatcgagctggtcaccgccgagttgccgatgttcgcattgaccttggtggcgaacgccttgccgatgatcatcggctcgatctcgggatggttgtggttggccgggatcacggcgcggccgcgggcgacctcgtcgcgcaccaactccgccggcatgccctcgcgggcggcgatgaacgccatctccgcggtgatctcgccggcccgggcccgctgcagctgggtgccgcggtcgcgcacccggcccggccgcgccggcagcccggccgtcaggtcgatcgtcgcgtccggatcggtgtaggggccggaggtgtcgtagaggtcgaagtggtcgccggtggacaggtggacgcggcggaacggaacccgggcaccgggcaccccgtccagttcgcggtagaccttgctgctgcccgcgatgggcccggtggtcacgctcggttcgacaattgcggtcatttttcatctccctacgccggcattacccggtcaggttcgtacggtcgacggccccgagccgtcctctcagcacacttggcgtgcgctcccgcgtctgatggatgggtccgcacgcgacgttacccccaccggcaaccgcatggcatggccgacggccctattcccgccggttcgtgccgcgcggtcaccgcgcgccaaccctcacacctcctccatcgcctccccgagctcctcgaggatcttgttgtggtgattgctggccagcaggtgccccgcggcgatgaccacggccaccggccagtcgatgagctccagcgccgccagggcggccagcccgccgaagtaggccagctgctcgggccggggaatctcgacctggcccaggcccggcaggttcaccacgaaggtctcgccctcccggatcttttccaccgcctcgcgctgggacgtgccgcgcctcgccttcttttccgccatcatttgcctttcggtaacgaagggtttcccgactcgctgggtcgcgcgtccaccgtcggaactatgtcgacgatgaccgacaccgggggcgatccgctagtttcgtcgtttgcttcggtgctgaaggtgccgctagttgaactgtatgcgctgttgtggcgcgtcggggtggtcgagattcgccacgacgatcggacgcgcgccgcggcgtcgggcccgatctgtccggatccgtcggcccatcgggccgaccgggtggccgtctagttcagttggtgctgcgcaagtcgccggcaccggcgcggcgccccggggccttcttggccgtcgacttggcggcggtcttggccggcgccttgcgggccggcgccgattccgccggcaccgacttcaggttcgccttgaccgcccgcggctcgggctggcgctccttgcggttcaaccgctgcagcagcaaggcgccgccgccgacggccagcagcaccggccactccaccagtcccgcgacgccgagcgcgccgaaggccagcgcggccgcgggcgtggaatggctgccgctgttcattccgcgtttgacgccctccgcggctccggtgacgccgccgatgacgccgttgaccgccgcgccgcccacggcaccggcggccgcggtcgtcgcggacgcggcgcggttcaccgcctgactcacgccccggactgctccgccgatgacactcatgatgactccctggctttgattgcgtgcgccgcgcgccggcgtcggcagcgagtagtacccgctgaacgcaggcttaacaactaggcaatgctgtttccgctcctgattttgcaaagcctgccaccttgccgcgcggcagacaacgagaagcggtgccggatttctccctaggacggcggctcgtcgcggctcacatcgaccagcaccggcgcgtgatcgctggcgcccttgcccttgcgctcctcgcggtcgatctgcgcgtgcgtcacgcggcgcgccaacgcgggggagccgaggatgaaatcgatgcgcatgccttgccgtttcgggaaccgcagcgcggtgtagtcccagtacgtgtacacccccgggcccggtgcgaaaggccgtaccaggtccgcgaattgcgcgtcgaggatggcgttgaacgcgcgccgctccggctcggagacgtgggtggcgccggcgaagaactccatgctccacacgtcgtcgtcctgtggggcgatgttccagtccccggccagcgcgatctgggcggcgggatcctcgcgcagccaggccgcggccgaatcacgcagggcggcaagccaatccagtttgtaggcgtagtgcgggtcgcccaccgcgcggccgttgggaacgtagaggctccagatccgcacaccggcgcaggtggcggccagggcgcgggcctccgcggcggcggcgacctccggcttgccgctccagctcggctggccctcgaagccgacccgcacgtcgtccaggccgacccgggaggcgatcgccacaccgttccactggttgaagccgacgtgggcgacctcgtagccgagttcgaagaacggcaacgtcgggaactggccgtcggcgcacttggtctcctgcatggccagcacgtcgacctcggtgcgggccagccagtccagcacccggggcagccgggagcgaatcgagttcacattccaggtggccagccgcacggactagaaactatcccaccggcccggccgggaccgtcaggtagcggcgccggtggtgcagccggaaacccagcgccccggccagttccagcgccgcggtgtcgtcgtcgggcaccgccagataggcgcgcgtggcgccccgcccggcgccccacgccagcagcgcctcgcacccggcgcgggcctcggcgtcgtgcccgccgggcggcacccacagccccacccaccgggtgccgtcgggtgcggcgctcaccgcggcctgcgcgacggacgcgtcgacccgaaccccgggttcgtcgccggacgggcgggaaaggtcttgcaccacaacctgttcggtgcgctcgcaggtcagcccgggcggcggcgtcagcatccggtccgggacggccagtcgcggcgtcaggccgcgccgctggtaccagccggcgatctccgggatggcctcggcgtgagcggaaagatccagcggcacagcggaatcggttgagggcccggcgggccggccgggtggcgggccggcccgcagcagccagccgtgcagccaggtctgctccgcggcgggccaggccgcggcgtgttcgagcgcgcggatctgcgaggtgcggatcggggtgtcggtgagcacccgcagcgcaaccacgtcggcgggcgcgaactcgacgaccgcgccggtcttggtctgcacccgcaccgtcggatcgaccgtcagcagccggcccaccgcgtcggtcagcggcggcaccgatccgggcgggcgccggtagcgaaccgtcacccgggtccccgggtcgggccacgagaacatcagtgaccgaacgggtccggtccctcgccgggcatccaggacaggccgggcacaccccagttgtgggatttgacggcccgtttcgcgctgcgggcataccggccgatgagccggtccagatacaggaagccgtccaggtgcccggtctcgtgctgcagcatccgggcgaacaggccgtggccctcgatggacaccgggttgccgtcggcgtccagcccggtgacccgtgcccagctggcccgcccggtggggaacgattcgccgggcaccgacaggcagccctcgtcgtcggtgtccgggtcgggcatggtctcggggatctcggaggtctccagcaccgggttgaccaccacgccgcggcgccgctcggtcagcccccggtcgtcggcgcagtcgtagacgaacacccgcaaccccaccccgatctggttggcggccaggccgaccccgtgggcggcgtccatggtgtcgtacatgtcggcgatcagcttgcccagatccgccggcagggacccgtcgtcaccgaccggcaccggctgtgtcggggtgtgcaggacgggatctcccacgatgcggatcggtacgactgccatggtcggctaagctaccgcacgctcgcgggtgggcaatctgggtcaatcggccgactcgcgggtctggatgacggcttgagggtttggggcgtgtttcaataattcgcgcaaaccacgcgcttagctaagccaagtcattcgagcagttcggaattcgccgaaagggtccaggggaagcgatatggacagcgccatggcgcgggcaaatcgatcgggggacgacgccgagatcgcagatgggctgacccgccgcgaacacgacatcctggcgttcgaacgccagtggtggaagttcgccggtgtgaaggaagacgccatcaaagagctgttctcgatgtcggcgacgcggtactaccaggtgctcaacgcgctcgtcgaccggcccgaggcgctggccgccgacccgatgctggtgaaacggctgcggcggctgcgcgccagcaggcagaaagcgcgcgcggcacggcggctcggcttcgaggtgacctgactcgttacagtagggctcgatgaaagaacgagttcccgactccactggactgcctttgcgggccgtggtgatggtgctgttgttcctcggcgtcatcttcctgctgctcgggtggcaggcgctgggttcgtccgggaactccgaggacgattcggcgtcgccggtgtccagctcgacggccaccagttcggcgtccgcctcgccgactaacaagccggcggcgaaccaggccgaggtgcaggtgtacaacatctcctcgaaagagggcgtggcggcacgcaccaaggatcagctgacgtccgccgggttcaaggtcaccaaggtcgacaacctggccgtgcccgacgtctcggccaccacggtctactacaccgacgccgacgacgagcacgccaccgccgatgcggtgggcaaaaacctgggcgcgccggtcgagccgcgcatccccgcgctgagcggccaacccccgggtgtcatcgtcctcgtcgcgggctgagcgggccggcgaagcgttaggctgctggctatgcccaagctgctgcctcccgtggttctggccggttgcgtcgtggcgctgggcgcctgttcgtcgccccagcacgcgtcgtcgctgccgggtaccacccccgcggtgtggaccggatcgccgtcgccgtcgggcgcgggcgcagccgaggccgcgccggccgcggcgcccagcatcaccacccacctcaaggcgccggacggcacccaggtcgcgaccgcgaagttcgagttcagcaacggctacgccaccgtcaccatcgagacgacggccaacggcgtgctcacgcccggcttccacggggtgcacatccacaaggtcggcaagtgcgaacccagctcggtcgccccgaccggcggcgccccgggggacttcctgtccgccggagggcatttccaggcgcccgggcacaccggcgaacccgccagcggcgacctgacctcgctgcaggtgcgcaaggacggctccgggacgctggtgaccaccaccgacgccttcaccatggaggatctgctcggcgggcggaagacggcgatcatcatccacgccggcgcggacaacttcgccaacatcccggcggagcgctacaaccagaccaacggaacaccgggccccgacgagatgacgatgagcaccggtgacgccggcaagcgggtggcgtgcggtgtcatcggtgccggctagacggggcgacgcgcacatcgatttcgcccgttcgccgcggccgaccatcggggtggagtgggagttcgcgctcgtcgacgcgcagacccgcgacctgagcaacgaggccaccgcggtgatcgccgagatcggcgaaaacccgcgcgtgcacaaggaattgctgcgcaacaccgtcgaggtggtcagcggcatctgccggaccgtgcccgaggcgatggaggatctgcggcagaccctggggcccgcgcgccggatcgtgcgggaccgcggcatggaactgttctgcgccggcgcacatccgttcgcgcagtggacgacccagaagctcaccgacgccccccgctacgccgagttgatcaagcgcacccagtggtggggacggcagatgctgatctggggggtgcacgtgcacgtcgggatctcctcgccgaacaaggtgatgccgatcatgacgtcgctgctgaactactacccgcacctgctggcgctgtcggcgtcctcgccgtggtggaccggggtggacacgggctacgccagcaaccgggcgatgatgttccagcagctgcccaccgccgggctgccgttccagtttcagacctgggcggagttcgagggcttcgtctacgaccagaagaagaccggcatcatcgaccacgtcgacgaagtccgttgggacatcaggccgtccccgcacctgggcacgctggagatgcggatctgcgacggcgtgtccaacctgcacgagctggccgcgctggtggcgctgacgcactgcctggtggtcgacctggaccgcaggctggaggccgacgagtcgttgccgaccatgccgccctggcatcaccaggagaacaagtggcgcgccgcccgctacggcctggacgcggtgatcatcctggacgccgacagcaacgaacgcctggtcaccgaggacctcgacgacgtgctcaaccggctggagccggtcgcccgcaagctgcagtgcgccgacgagctggccgcggtggccgacatcccccgccacggcgcgtcataccagcgtcagcgccgggtggccgaggaacacgacggcgacctgcgcgcggtcgtcgacgcgctggtcgccgagctggagatctgatgaccgaacccgttgcgctgccgatgtttccgctggagtcggcgctgctgcccgaccaggacctgccgttgcggatcttcgagccccgctacggcgcgctggtgcggcactgcctggacaccggcgagcagttcggggtggtgctgatcgcccgcggccgcgaggtgggcggcggtgacgcgcgctgcgacgtgggggtgctgtcccggatcgtcgactgcgtcgaccagggcgccggccggtacttgctgaattgccgcaccgggcaacgcattcgggtgtccgagtggctgcccgacgacccctatccccgggcaacggtgatgccgtggcccgacgagcccggcgccgcggtgacgccggagcagctgcgcggcgtggaagaccgcgcggtggcgctgttcgagcggatcgcgcaggcgcgcggcatcaccctgcccgggcgcgacgtgctactgggccgccacgatccggaacgcccgcccgggcaacgcctctacgagctggcctcccgcatcccgatcggcacagccgaccgctacacggtgctctgcgcgccgtcggccgccgagcgcctggccgcgctgcgcgaggccgtggacgcggtgaccgaagtggtcgagttccagctttccgaatagcgctgcgcgacaggagcttacgatgaaggttcagctgcaggtcgacggttcgccggtgcgggcggcggcaagtgccgccgagatcgccgcgaccggcgccgacggcctgttcaccttcgagggccagcacgacgtcttcttcccgctgctgatcgccgccgaggccaccgggtgcgagctgatgaccaacgtggcgatcgccccgccgcgcagtccgatgcacctggcctacgcggcctacgacctgcagctctatagcggcggccggttccggctggggttgggctcgcagatcaaggtgcacgtcgaaaagcgttacggcagtaggtgggagccgcccgcggcgcggatggccgaggccatctcggcgatcaaggcgatcttcgccgcgtgggaaggccgggcccgcctggattttcgcggtgagttctacacgcacaccatcatggcgcccaccttcgatcccggccccaacccgtacggggcgccgccggtgctgctgggcgcgctgggtccggtcatgacccgcaccgccgccgaggtcgccgacgggctgctggtgatgccgttcaacagcgcccgccacttcgccgagcgcaccctgcccgccatcggcgaggggctgcgccgctccgggcggaccttgaccgagttcccgatcatcgcccaggccatggtggccgtcggccgcgacgaggccgacctggcgacggcgatcgacgcggtggcctccctcatcgcgttttacggctccacgccggcctacctgccggtgctgcaggtcgagggttgggacggcatccagcccgagctcaacgcgctgtccaagcagggccgcttcgcgcagatgcgcgggctgatcaccgacgagatggtggcccggatcgggatcgtgggaacacccgagcaatgtgctgagcagatcgccgcccggttcggcgagcacgccgacgaggtgtgctgttactttccgggctacaccccccgccccgcggacgtcgccgacctgatcggcgccctgcaccgggtgccggcgctgccgtgaccaccgacttgaccgccgaaatcgactcgggcgtcgcggttctcacgctcaaccggcctgaccggctgaacgcctacaccgccgagatgggcgagctgctgggccgcgcctaccgcgagtgcgacgaggacgacgacgtccgggtcatcgtgctgaccggcgccgggcgcgccttttgcgccggggccgacttctccggcggcgcaagcccgttcgacgcccccgccggcgacggcgccttcaccgcctcaccgatcaccccggcggcgttcgagttgcgcaaaccggtgatcgccgcggtcaacggccacgccgtcgggatcggcctgaccatcgcgttgcaggccgacatccgcatcgtcgccgaggacgccaaatacggtgtggtgcaagtgcgccggggtgtgctacccgactgcatggcgcactggacgctgccccagttgaccaacctgggggtggccgccgacctgctgctcaccgggcggatgttcggcggcgccgaggcgaccgcgctcggcatcgccaaccgcgcgctgcccgccgatcgggtgctcgacgaggcgatggcgctggcccgcgacatcgccgtcaacgtggcgccgatgtcggcggccctgtgcaaacgcctgctgtgggacagcgcgatcaatcgctacccaccgcgacaggtcgccgcgctggaaaccctgctgcacgaacgggtgatgggaggcggcgacgccgccgagggcgtcgccgcgttcctcgagcaccgggcgccgcgcttcaccgcgcggctgtcgtcggagtgggagccgctgccggagccatgacggcggcgcgccgcatcagccgcggtgccacgatccggtgcagcgggccgaccagcgcccagaccgctcgcgcggcgagcttgtgacggtaatgcaggcgcgtggtgaggacggcgcgccggccgtcctcgcgccgcagcgtcagccgggcgtccatcagcggcccgcgcgcggcgagcacgacttcgtcgcgagccgaacggacgatcgtccacccgcccagccgcagcacgtgccggtgcacccagcgcaccgcgtcgccgcccgcgcccggccgccccaccgcgtcgcgaaaggtctcctcggcgctgcgcgaatccccttggggcagaggtacttcgaacacgtcagtgtagtcggcccgcgcggcggcccgggcgacacggttcagcgtgcgccgaacgacgatgcggtgcccgccggtgccgatgaccagcgcccggtaggccttgccgtgcacccccgggaaggccgcccaggtggccgcccgcagccgggtgcgtgccgggccgtcgagcgtgtccagctcgaacacccaccggtacaccgcgaacgggtggcggcccttcagcgcgaaccgcaccggcggccgggcctcgtccagggcgaagcccagcggcacggtcgacgggtcgtgcgggtcgcggcacagcacccgcagcagcgccgcccacgtgtcgtcgcggttggcctcgatggttatggcatgctcatcgatatagggcaatcgttccatatagaaggaatgtactagatcatggcgcctccgcggaagcatgaaaccgatgtgatcctcgacgccgcccgggctctggtgctcgacggcgggccgcgcgcggccagcgtggccgcgatcgcgaaagccagtggcgcgccggcgggcacgctgtatcaccggttcggcaaccgcgacggcatcctgaccgcggcgtggctgcgggcgctggaacgcttccaggcccgggcgctggccgccgacggcgacaccccggaggacaccgcggtggcgatggccgtggccgcggtcggcttcgcccgcgccctgcccgacgacgcccggctgctgctgacgatccgcccgggcgacctgctcgacggcgagcccgacgcggcgttccggcagacgctggccgcgatgaacgccccgctgacccagcggctggcgcagttggcccggcacctgtacgggaacgcccggccgcgatcggtcgacgccgtcgcccgcgccgtcgccgacctgccgtatgccgtggtgcgccgtcacgcgcacgacgacccgatgccgtcctggctggaaaccgacgtggccgcgtcggcccgggccgtgctacggagcttcggcgaacgcccgtagcgacgcgacctgcgcgggatccaaagagggacggacgttttcgcgagccgcggcgaggtcggcggccgtcacgtcggtggcgtcgatggaccggcgcatggccgtcagcgcggcctcgcgcagcagcgccacgcagtcggcggcgctgtagccgtccaggccggcggccagctcgtcgaggtcgacgtcagcgctcagcggaatcgatttgcccgcggtgcgcaggatttcgcgccgcgccgcggcgtcgggcggctccacgaacaccagccgctccagccggcccggccgcagcagcgcggggtcgatgaggtcgggccggttggtggcgcccagcaccacgacgtcgcgcagcgggtcgacgccgtccagttcggtcagcagcgcggccaccacccggtcggtcaccccggagtcgaagctctgcccgcgccggggcgccagcgcgtccacctcgtcgagaaagatcagcgcgggcgccgaatcccgggcccgccgaaacagttcgcgcaccgccttttccgagctgcccacccacttgtccatcagctcggagcccttgacggcgtgcaccgacagctggccggtgctggccagcgcgcgcaccacgaaggtcttgccgcagccgggcggcccgtacagcagcaccccgcgcggcggctgcacacccagccgggcgaacgtgtccggatgctgcagcggccacaacaccgcctcggtgagcgcctgccgggcctgcgccatgtcaccgacgtcgtcgagggtgatgtccccgacgctgacctcttcggcggccgagcgggacagcggcctgatcacgctcagcgcgccggtgaggtcctcctggtgcagcgcggggggacggccgtcggagctggcccgcgacgccgcccgcagcgccgcctcgcggatcagcgcggccaggtcggcgacgacgaaacccggtgtgcgagaagcaatttcatccaaatcgaggccatcggtgggcacgttgcgcagcagcgactccagcagggccttgcgggtggcggcgtcgggcagcggcaggctcagctcccggtcgcacaggtccggcgcgcgcagccgggcgtcgagctggtcggggcgcgccgaggtggcgatcagggcgacaccctcgctggccaccgcgccgcgcagctcggcgaggatcaacgaggccaccggctcggcggtggccggtagcagggcgtcgacgtcggtgatcagcagcacgccgccgccgtcgcggaccgtctgcacggccgaggccaccgccttgagccggtcgtcggcgcccagcgcgccgacctccgggccgtccagcgtgaccagccggcgatccccgcacaccgcgcgcaccagcgtcaccttgcccaccccggccgggccggtcaccagcacgcccaggaaggtggccgcgcccagggtcttgagcaggtgcggctcgtccagcgcgagcttgagccattcgaccagcttggcggcctgcggctggcagcccttgagctcctcgaccaccgtctgtgggcgggcttcctcgaccgaggcccgcgacgccgccgcgggcgccgccccggcgccccagccgaccagcgagttgggctgcacgctgaccggcccgtccgggtcgacgccggtgacggtcagcagctcggaggtccagctgatgcctaccgcggcggccagcgcacgggtcgcctcggacgtcgaggtgccgggcccgaggtcgcggggcagcagcgacaccgcgtcgccgacggtgagcaccttgcccagcagcgcctgacgcaacgtgaccggtgacaccgaccgggtggtcagcggcgagccggacagggtcaccgaccgcgcgccgtacacggtgaccgggctgaccaccacggcggtcccgtcgcgcaggccggcgttggacagcgtcacgtcgtcgagcaacacggtgccggagggtatttcggggccggccaggccggccaccgccgcggtggtgcgcgaaccgatcagcgacaccgcgtcccactcccgaatgccaagggccgcaacggcactcgggtgcaggcggacgacgccgcgacgggagtcgacggccgaggtgttcagccgggcggtcagcgtgagttgacgcgccgagccggaaccggtcacggcacgcgcctgcccggcttgcgcaggcccagccgcgtcaccgaccggcggttgggctgtgcccggcggatcgcccgccgggcggcgcggcgctgcttgggcgcctcgtcccacgcctcggggtgcgcggccagccagcgctggttgcgcaccgcgaacggcacgtggcacaggtaggcgacgatgatcacccagatcagcacgtagggcgccagcaccgccgccgccgcgcagatcgccagcaccgccagcagcggcgccgcccaactcggcggcaccgccaccgcgtgcatcttgcgcatcgggatcttgctgaccatcaggatcgacgtcccggtgatccagatgcacaaaaacagcggggacgtccaccagccgtcgccgaactgcagcttgagcccgatcaggccgatcatcgacaccgcgccggccggcgccggcatgccgacgaagaactcatgggtgtaggcgggctggctgccgtcgtccagcagcgcgttgaaccgggccagccgcaacaccacgcacaccgcgtagagcaggatcgccacccacccggccggcgacgtggtcagcagcgtcacgtagagcacgatcgccggggtcaccccgaagttcaccgcgtcggccagcgagtcgatctcctcgcccatccgggactgggcgtccaggatgcgcgccacccggccgtccagcccgtccaggatggcggccgccgcgatcagcgccatcgcggccttgggctggtgttcgagggcgaaccggatcgaggtcagccccgcgcacaccgagagcaccgtcatcgcgctgggcaggatctgcagattgaccgcccggcggccgcgcggcttgctgatcatggcagctcggccagcacggtctcgccggcgatggcgcgttggccgacggtcaccagcggctgtgcgcccgccggcaggtaggtgtccagccgggagccgaaccggatcaggccgtaggtgtcgccgatcgacagcttgtcgccgacgtgcgcgtcgcagatgatgcgccgcgccagcagcccggcgacctggaccgcgaccacctccgcgccgccgggggtgcggatgcgcaggctggtgcgttcgttctcggtgctcgcggccgccaggtcggccgacccgaaccggcccggccggtgctgcacgtcgatcacctcgccgctgaccggggcccgctgcacgtgggcgtccagcagcgacaggaagatgctgacccgcggcagcgccacgtcacccatgctcaattcggcgggcggggtggcgacgtcgatcacgcagatctcgccgtcggcgggcgcgacgatcgcgccgggccgggtgggcggcacccggggcgggtgacggaagaatcccgcgcacgcccccgccgccagcaggcccgcccggcgcagccagcggtgccggcgcccggccagcgcaagcgccagcccggcgccgacgaacggccggccggccggatgcaccggcgggatggcggagcgcaccaactccagcgcatgctgggggctgaaaccggggtcggcagccgaggggccgatggtgcgggggcgtcgtgccacgcggccatcttacggagccggtgacggattcgtcgccgcccgcgaagggaacgttcaccgtcgacatgctgagtcgggccaaacgcggtgtcaccgcggtgttcgtcgctcacggcctgctgttcgcgtcgtgggccgcccacattccgcaggtcaaagccggactcggcctggacgacgccgcgctgggcacggcgttgttcggcgctccgctgggctcggtgctggccacgctggccggccactgggcgctgccgcgctgggggagccaccggctgatcccggtcaccgtcgccggctacgcggcggccgggacgacggtggggctggcccggtccgggccggcgctgttcgcggcgctggcgttgtgggggatgttccagggcacgctggacgtcgcgatgaacacgcaggccggcacggtcgaacggcgcgccggggccccgatgatggcgcgctttcacgggatgtggagcctgggcaccctggccggggcgctgatcggggcggcctgcgtcggcgccggcatcggcctgaccgctcagctgacggtgctcggggcggtcgtgctcctcgtggtggtaatgctgacccgacgcctgctgccggacgcggccgattccgtggccgcgccgccggaaccggccgcgggccggcggatgacgccggcggtggcgatcctggcggccgtgtcgttcgcgtcgttcctgtgcgagggcgcggccaccgactggtcggccacctacctgcgcgacgtcgtcggcgccggcccgagcgtggccgcggcgagctacgcggcctacaccctgaccatggtcgtcacccggttcggcgccgcccggctgcacgcgcggctgcccagccgccggttgctgccggcgctggcggtgctggccgtggcgggcatgagcgtggcgctggcgaccgccgacgcggccgccggggtgctcgggttcgccgcgctgggcgtcggcgtcgcgctgctggtgcccaccgcgttcagcgcggcctacggcgcccgcggcgccggatcggcgatcgcgatcgtggccgccaccggctggctgggctatctgctgggcccgccgctgatcggccacctgtccgagtgggtgggcctgtcgggggcgctggtcaccatcccggtgatgatgacggtcgtcgccgtcgccatccgctacaccccggccttcgacaccgccgacgaattccatcgagcgcccgccggctgaatcgggctagcgcagatcccacacctcgagggtggtcccctcgggcacctcgacgacgtcttcggggatgtccagcagcccgttcgccgacgccagccagcgcaggtgatgcgaggccggcgggccgtagctgacgacggtgccggcgtcgtcgtccagcaccgcgcggcggaattggcgtttgccgcgcggcgaggtgagcgactcggcgagcaccgccgaccggtgcgggcgttcgggatcgggcaggcccatcgcggcgcgcagcgccgggcggatgaacacctcgaaggacaccagcgcgctgaccggattgccgggcagcgtgacgatggtcgccccggccacccgtcccacgccctgcggcatgcccggctgcatggccaccttgacgaactccacgccctgatcgccctcgcgcccgaaggcgtccttgaccacctcgtaggcgccggcgctgacgccgccgctggtgatgatcaggtcggtgccggccgcataccggtcgatgatcgaactgaactgtgccacctcgtcctcggcggtcgcgacggccaccagctccgcgccggcgtcgcgcacggccccggccagcatgatcgagttggactcgtagatctgccccggccgcagcgcggcgcccggggccaccagctccgatcccgtcgagatgaccagcacccgctgccgcgggatcaccgacagctcggcgatgcccagcgccgcggccagcccgagcaccgccggcgtcactacctgcccgcggcgcaacacggtggtgccgggggagacgtcctcgccggcgcggcggatgtgcttgccgggttcgcgcgacgcccggatcgacaccacgtccacgccgccgtcggtgtcctccaccggcacgacggccgtcgccccggccggcaccggcgcgcccgtcatgatccggtgcgcggtgcccggctgcagcgtcagctcgtcggtgcgtccggccggaatgtcctcggcgaccggcagcacgaccggccgctcgggggtggcgcccgcggtgtcctcggcgcgcaccgcgtagccgtccatcgcggagttgtcgaacaccggcagcgccagccccgccaccacgtcgtcggccagcaccaggccctgggcctgcgccagcggcaccgcgaccggcggccgggcgcggatcagcccggccaccacccgctggtgttcggcgacggagcgcatcgcggccatggaggtcagaccgggaagtggacgccggtgagttcttcggacacggcccacagccggcgctgcagctgctcgtcgtgcgactgggcgctggactcgaccagcttcgggcgcccgcgctgttcgaggaagccgtccgggccgtagtactgcccgccctgcacggccggatcggtggcggcccgcagcgtcggcagcgcgcccatcgccgggctctggaacagcaccggccccagcaccgcctgcaccggccggaagatgccgggcaggtggcgggccagctcggtgttggagccgccggggtgcgcggcgaccgcgatggtcttcgcgtccggggcggccgccagccggcgctgcagctcgtaggtgaacagcaggttggccagcttggactggccgtaggcggcgacccggtcgtagcggcgctcccagtgcaggtcgtcgaagtggatggccgcgcgcagccggtggccgaggctgctgaccgtcaccacccgcgaatcccgcactcccagcaggtgatcgagcagcaacccggtcagcgcgaagtgccccagatggttggtgccgaactgcaattcgaaaccgtcctcggtgacctgcttgggcgtccacatcacgccggcgttgttgatcagcaggtcgatgcgcgggtaggccgcgcgcagcgcctcggcggccgaacgcaccgaggccagcgaggccaggtccagctgctgcagcgtgacgtcggcgttcgggctggcggccacgatccgcgacagcgccgcgttgcccttctccaggtcgcggaccgcgagcacgacgtgggcgccgcggtgggccagcacggcggccgtctcgtagccgatgccggtgttggcgccggtgatgacgacgacgcggccgctctgatcaccaacgtcggcctccgaccagtcgcggtgctgtttgtcgtggggagccatggcccacaacatactcaccgaccgggacgcgctattgaacccagaagttgtcgtgccgggcgaaccattcccggcgttcctcgtcggtcatgtcggccagcgcggcgaagccttcgaagtaggcctcgcgcggcgcgccgggcgcgaacaacatcaggatcgacgcggggtcgtcggcctcgttgcggaagccgtgcaccccgccgggcgggacgtaaaggaagtcgccctggtgcccgtcggtccactcggtgccgtcgtagagcttcatcgtgccggagagcacgaagaacgcctcggacatggcgcggtgaaaatgcggcccgggcccgccgccggccggggcgatgtcgacccggtacaacccgtagtcgccggcggtgtcgtgctggttggccaggtagtggtacttgacgccggcggtctggtagtcgggcggttcgtcggcccgcttgagccaggcgctggtctccggctggtctttcgtgtagcgggcgggcggatagggcggcacgacgagggacatgaggtccagcctgccagttagcatcgccaaggtggaggcctccgaggacgtgcgggtgcggcggctgctggacgcccaggacaaggcggcgcagctgttcgacgagatcgagcggcgcggcatgatccgcccgggagtggccgaacggcagctctcggacgagatccacgacctggccggggcgatgttcggggtgcgccagcactggcaccggcggatcgtgcgggccggccccaacaccctgcagccgttccaggaacgcccgccggaccgcacgatcgccgccgacgacatcgtcttcctcgacctggggccggtcttcgaggagtgggaggccgacttcgggcgtaccttcctgctcggcgacgacccgcacaagaaggccgttcgcgatgcgctgccgcgggtgtggcaggccgggcgggactacttcgccggccaccccgacgtcaccggggccgagctgttcgacgccgtcgtcgcggtggcgcgcgccgagggattcgagtggggcagccacatcgccgggcatctgatcggggagttcgcgcacaagaagatcgccgggccgggcatcgagtggtacatcatgcccggatcggacaagccgatgcgccgcaccgatccccgcggccgcacctgccactggatcctggagatccatctggtggaccgccggcgcggtttcggcggcttctacgagcagctgctcgacctgccctagttgcgacccgacctgttcttgcactcggcatgggcgagtgctaagaatgacttggcactcgcgaccagtgagtgctaggtcgggacggtgaggctcggctctgtcgtcgcccgacggcagcagcctggtcgtccgtcgcgggcactgcacccggccaggacgtgtcatccccaatccggaggaatcacttcgcaatggccaagacaattgcgtacgacgaagaggcccgtcgcggcctcgagcgggggctcaacgccctcgccgacgcggtaaaggtcacgttgggccccaagggtcgcaacgtcgtcctggagaagaagtggggtgcccccacgatcaccaacgatggtgtgtccatcgccaaggagatcgagctggaggacccgtacgagaagatcggcgccgagctggtcaaggaagtcgccaagaagaccgacgacgtcgccggtgacggcacgacgacggccacggtgctcgcccaggcgttggtccgcgagggcctgcgcaacgtcgcggccggcgccaacccgctgggtctcaagcgcggcatcgagaaggccgtcgagaaggtcaccgagaccctgctcaagtcggccaaggaggtcgagaccaaggaccagatcgctgccaccgcggccatctccgcgggcgaccagtcgatcggcgacctgatcgccgaggcgatggacaaggtcggcaacgagggcgtcatcaccgtcgaggagtccaacaccttcggcctgcagctcgagctcaccgagggtatgcggttcgacaagggttacatctcgggctacttcgtcacggacgccgagcgtcaggaagcggtcctcgaggacccgttcatcctgctggtcagctccaaggtctcgaccgtcaaggacctgctgccgctgctggagaaggtcatccaggccggcaagccgctgctgatcatcgccgaggacgtcgagggcgaggccctgtccaccctggtcgtcaacaagatccgcggcaccttcaagtcggtggccgtcaaggcgcccggcttcggcgaccgccgcaaggcgatgcttcaggacatggccatcctcaccggcggccaggtcatcagcgaagaggtcggcctgtcgctggagagcgccgacatctcgctgctcggtaaggcccgcaaggtcgtcgtcaccaaggacgagaccaccatcgtcgagggcgccggtgactccgacgccatcgccggccgggtggcccagatccgcaccgagatcgagaacagcgactccgactacgaccgcgagaagctgcaggagcggctggccaagctggccggcggcgtggcggtgatcaaggccggcgccgcgaccgaggtcgagctcaaggagcgcaagcaccgcatcgaggacgcggtccgcaacgccaaggcggccgtggaggagggcatcgtcgccggcggtggcgtggccctgctgcacgcgatcccggctctggacgagctgaagctcgagggcgaagaggcgaccggcgccaacatcgtccgggtggccctcgaggctccgctgaagcagatcgccttcaacggtggcctggagcccggcgtggtggccgagaaggtccgcaactcgcccgccggtaccggcctcaacgccgccaccggtgagtacgaggacctgctcaaggccggcattgccgacccggtgaaggtcacccgctcggcgctgcagaacgcggcgtccatcgcggggctgttcctgaccaccgaggcggtcgtcgccgacaagccggagaaggcggccgctcccgcgggcgacccgaccggcggcatgggcggcatggacttctgagtccgttacggaaaagcccggtccctcgaaatctcgagtgggccgggctttttcgtgccggcgtcgggcctggtttaccgcgccgagcgtgggggctacgtccgtccacaccccggaattcgtgcacagcccccacgctcggcgcacccgccgcgcgtgtgcgacggcgaatatgccggcatgcccccgtttctgggcagtgacgccctgcaccgcggcgcggtgacccgcagtcaacttgcgaacgcggtatcgcaaggtgttccgcgacgtctacatcgcgaaggacgccgagctgacgccggccggcaaagcgcgcgcggcgtggctgtcgaccggtgcgacactggccggtttgtccgccgcggcgatccatggcaccaagtggctcgatgcggccgcgcccgccgaaatcgtgcgggcggatcggcacggtcagcgcggcatcctcgtgcgcagctacacgctggccgatgacgaggcggacagcgtgtccggaatgcgggtgacgaccgccgcccggacggcgttcgacatcggttgcggcctgcccgccgccaaggcgctgccgatcctcgacgcgttactcaacgcgacgggtatcaagcccgccgacgtcgtcgctgtggccgaccggcaccggggcgcccgcggcattcgccggctgcgcgcctcgctggagctggccgacggcggtgcggagtctccgcaggagaccaggttgcgggtgctgctggtgcgggccggactgccgaagccgcagacgcagatcgagctgcgagagctgcgcgttcgggtggacatggggtggcgggagtggaaggtcgccgtcgagtacgacgggatccagcactgggacgatccctatcagcgggcctgggacatcgagcgaatcgcgttgctcgaggcggccggctgggccgtgatcagagtcagcgcggcgatgttgtcgcggccgcaggtgatcgtcgagcgcgtcacggccaagctcgccgagcgtggggcctacggtcgaccgcgagcgagttcccgtgcctaaggcccacgctcggcgcccgtagggtcgagcgttatcccgttgtggtgcaacgtgattgctcatagcggcgacgcgggtcactccaagacgcttgccgacacctgctgactcatccggacatttgtggggtgctcaatcgtcgagcacagccagcgaccagcaccatccggccagctcacgcgcgatcgcggcgttggcaaccacggagcgttttttgcgctgatcaaaacgccctcacatgtgagcgaggccccagacccccataccgtctaggccggcagcgagaacaccacgcagtcgtgcagacagcccttggcggcgtcggccgagtcggcgtcgcggtgcaacagcgcgcgggtgggcgccaccgccagccgaaccgcgtcgccggcctcgctcacctgcgccgtgccgtcgacgatcagcgagtagccgcccggctcggtcggcggccacagcagggtgacgtcgcggcgccgggccaggttctgctgggtgcggccaccgatcaacccgacgtccaggatcgactcacgcagcaccggttcgaccgtcacggtgtgcgcgcggtagtcgtcgtcgaccgtgatcaggtaggcatacgggtagtcggccagcgcgtcggccagcgcctgcagatcgaccttcttcttgctgcgcatgatgttccacgataggcgcgcgcggcgtcactgcggcgcgcgcggcgcgagaaaccccgcgatgcgcgaggtgtagccgcgggccacggcgcccgagccggccgggcgggtgacggcggtgctggcattggagaacccgaggttctgcaacacctcattccacggcggcaacttcgccacggccgccgaggcgtcggcgtggtagccgaacatcgccgccacgtccgaggcccacatctgctcgtaggcggcctcgatgtcggcgatcgccggtgtgttctggcccagccagttggtggcggccagcgcctgcaccaacgcccggttggcggccaccacggcgggctgcacggtggccgccagggccacctcgaacgccgtcgcgatggccgaggcctggtgcgacacctcctcggcctgcgcggcggccgcggacagccagctcacgtattggttggcgacggtcatcatggccgccgacgacgcgccctgccacgacccgctggccagatccgacgtgaccgaagaaaacgactgtgccgacgacgccagctcctcggccaggccgtcccacgccgccgcggcagcaagcagcggcccgggaccaggaccggaataaattagtgccgagttgacttctggcggcaaccacgcaaaatgcgggttcgtcacggacccaacttagctggtatatgccacttttggggcgttatcgcaagggtgccgggccgggccggcggccgcgcaccaacttgcccggacgcgcggcggtgggcaccccgttctcggcgatgatctccccggagacgatggtggcgacgtagccgtcggcggtctgatccaggcgccgcccgcccgccggcaggtcgtgactgatcaccggcttgtgcagccgcagcgcggcgtggtcgatgacgttgaggtcggccttgtagcccaccgcgatgcggccgcggtcgcccagccctgccacccgcgcgggcaccgaggtgagccggcgcaccgcgtcggccacgctgaaccgccccgactttcggtcgcgcgcccagtgcgtcaggaagtaggtcgagtagctggcgtcgcagatcatcccgtagtgcgcgccgccgtcgcccagacccagcaccacatcgtcgcggtgcagcagctccccgacggtgtccagcgagttgccctgcaggttgctggtcgccaccagcagcatggcccggccgtcgtcgtcgagcagccggtcgtaggcctcctccatcggatccacgccgcgggcgcgggcccgggccgcgatggacgtcgacgggtccggctcgtaatcggggttgtcgccgagcgggtagatccagtcccacatctgggccacgtacaggatcgggtggccctcgccgggcttgtcggccaggatgcgggcccgcacctcgggcttgcgcatctgtgcgacccgctcggccagcggcaggtgcgcgatctcgcggtagctggggtagagcacgaatgggtttgcgctcaactgcaatccgatgatcaacccgatcgggcgcggcaacagctgcgcggtgatgtcgccgcccgccgcgttggccttctcgatcatcgtgatggcgtccggccacgtcgggtcaccggagttggcgacgacgagggtgaaggtgagcggcaggccgacgtcctcggcgacgtcgaacaccgtctgcagcaccggctggtagccgtcggccgggatgtcgggaacgaactgcagcaggccgccgccgccgtccaccacaccccgggcgatctgctcgatctcctcccgggcggcgtcgtaactcgggataggagaaccgctttcggtcttgtggatggtcagccgcgacgaggcgaaacccagtgcgcccacctcgaccgcctccttggccagcgcccgcatcttcgccaggtcctccgcggtggccggctcccggtcggcgccgcgctgacccatcacgtacacccgcagcggcgaatgcggcagataggcggccacgtcgatgtcacgcttgccggcctcgagggtgtccaggtattcggggaacgtctcccacgtccacggcaggccgtcggtcatcacgacgccggggatgtcctcgacaccggccatcacgtcgaccagcacgtcgtggtcggactggcggcacggggcgaagccgacgccgcagttgcccatcaccaccgtggtcaccccgtgcgccgacgacggggtcagccgctccgaccagacggcctggccgtcgtagtgggtgtgcaggtccacgaagcctggcgtgaccagccgcccggtggcgtcgatctcgcggttcgcggtggccccgttcaccgcgccgaccgccgcgatcacgccgtcgcgcaccgccacgtcgccgacgtacggctcaccccccagcccgtcgacgatgctgccattacggatgatgaggtcgtaagtcattcaaacaatctacgaccgttcccgccggtcgtgccaggatctgttccgtgatcgatcacgtgggaatcaactgcgccaactacgcggaatctcagcggttttacgacgcagtgctgggcaccctgggtttctcccggcagctggatgtggggccagccatcggctacggccgcgcgggcaaaccgacgttttggatctcggacgcgctcgcgggccccaaccgggaggtgcacctggccttcgaggccgccgacgaggacgcggtgcgtgccttccaccgggcggccgtcgacctgggcgccgaggtgctgcacccgccgcggctgtggcccgaataccaccccggctatttcggtgcattcgtgcgcgaccccgacggcaacaacgtcgaggcggtctggcacggcgcgtagggtcggccttatgcgagctgacagcgacgccgttacccgagagctgctgcgcgacgcgttcacccggctgatcgaacacgtcgacgaactcaccgacgggttgaccgacaaggtgtcgggctaccgcccgacccccgacgccaacagcatcgcctggctgatctggcacagcgcccgggtgcaggacatccagctggccgacatcgccggggtggagcaggtgtggacccgcgacggctgggtggaccggttcgggctggacctgccgcgcaacgacaccggctacgggcattcacccgaggacgtcgccaaggtgcgggcgcccgccgacctgctgtccggctactaccacgcggtgcatgagctcacctgcgaatacatcgccggggtgaccgccggggagctgagccgcgttgtggacaccaactgggacccgccggtgacggccagcgcgcggctggtgagcatcatcgacgactgcgcccagcacctcgggcaggccgcatacgtgcggggaattcagtagattcgcggccgtgcgattcgcgggcgtcgtgctggggtggctgatcgccacgctggccctggcggtggcggtgccggcgggatgggtgcagctgcacgtcgtcgacgccgacggctatgccgcgctggcccgccgggccgccgctgacccggccctgcaatccgccatggcggccgaactcaccacgcgggcaatggctttgatcgccgagcacggcggcggccgctacccggtggacggtacgcaggtgcacgacgccgccgccgcgttcaccgccgggccggcgtttccgccgttgttcgcccaggccaaccgcgccgcgcacgcctggctgttcgacgagtccggcgcgggcggcggccagtgggcggtcgatgtggccccgatgctcgacgacccctcgatccggccgctgctgcgccggcacaacgtcgcggtcccggcgaaactgacggtgccgcttaccgtttcggtgcctcggcagggccggctcagcgggctgacgcgctgggggccgtggctgagcctggggtcggcggcgctgtgcggggtgggtgcgctgctgacgctagccgccgcccggcgccgcggcaaggcgctcagcggcctgggcgtcgcggcgctgctggtcggcgcggccggatgggccggcctggaggcggccggccgctacgtcaacgacgcgctcaaccacaccaccggcaacgtccgccgcatcgccgaggtgatggtcgcgcacgccgaatccggtgtgcaccaatggctcgacgccacgctgctggccggggcggcgctggcggggctgggtgtgctggtggcggtgctgggcggcctggccggtgcggctagccgaaggtgaacgagaagacctgcagccctgggctgacgcgcatgtccagctggtcgcggtgcgcggagtcgtcggcgacgatccggtgcagggtgggcgccccgccgatcggcgtcgtggtggtcgtcccgtcccgggtcacggtcagggtgccggtgccgccgacgacggcgtagacgtctttggcggtgtagttcagccggaccgcgcagtcgtcgccggccgcggtggcgccctggtcgtccagcgtccagcgcccgcgcagcgcgaacctgtcctcgcccagggtggccggatagctcagcgtcgcggtgcccgaccggtaatcgccggtgccgccgtagtttccggccttgcccacccccaggtaggtctccggggtgagcctggactgcggcgtggtgtcggcggtgttcgccggggcgggtagccgcgcgccgggatgggcggcggtgagcagttcgcggatcagccgttcggtgccgtcgtagtcgccttcgccgaacttggtgtgccgcacctgcccggtcgcgtcgatcaggtactcggccggccagtacaggttctggtagttgttccacgtcgcgtagtcgttgtccagggcgatcggatagccgatgtgcaggtcggccgcgccgctggccacgttgcccgggacccgttcgaaggcgtattccggggtgtgcaccccgatgaccaggaatccgctgtcgtgataccggtcgtaccaatcgattacgtgcgggatggcgcgctggcagttgatgcacgagtatgcccagaagtcgatcaggatcaccttgccgcgcaccaccgccgggtcgagcggtttgccgtccggggtgttgagccacccggtgatcccggtgagcgcgggcgccggcccgcaccgctgcagctccgccgacccgtcggaacagtcggacagcgccccgccgccggtgacgtcgtccgggctcagctgcagcgcgccgccctgggtcggcggcggcccggctgggctcagactgcgctgaatgtcgttggcgcccaaccggttctgcatcgcggtggtgtagtcggggacggcacgctgcagcatcgcgggcaggttgaacaccagcgcgacggccagcacgatcatcgcgatcccgccggcgacctgtatcgcccgctgccggcggcggaacgccgcgacccgctgggcgacgcgccggccggccagcgcgaaggccagcagcggcagcgcgtttccggcggcgaacgtcgcggtcaacaccagcgcgccggggccgatcgaggaggtgccgccggccaccacgatcgcggcaagcaccggtccggcgcacggcacgtacagcgcgcccaacgtcaggcccaggccgaaaccgtctgcgccgggccgactttggcgctgcggcaggtaggcgaacggtcgctcgatcagttgctgcagcggcgggaagatcagtcccagcccgatgacggtcagcaccaccagggcggtccaccggatcgcatcctggggcaggtgcagcgccgtcagcagcgccgagccgatcagggtggccacgctgaagctgcacaccaggcccgcgatcaccaggtagggccgcgccgcggagcccacgccgcgccggtcgccgtccatgctggacagcaggatcaccggcagcaccggcaggatgcacggcgagatcccggtgatcaggccgccgaggaacccgatcagggcgatggtctgcacccgtccagcttgacgcgtcgcggcggggctcagtggcccacgacaaatcacgccacgtgcgttatacaaatcacataatgtgcgttacgctcggccggtggcgcaactaacattccagcgcgcccgcaccgaggagaagaagcgccaacgtgcggaggccctcgtggaggcggcccgttcgctggcgctggagacgggcgtcgcgtcggtcaccctgaccgccgtcgcccgccgcgccgggatccactactcggcggtgcgccgctacttcacctcgcacaaggaggtcctgctgcacctgtccgccgagggctgggtgcggtggtcgaacacggtgtcggacaagctcgcccagcccggcgccgcgacgccgtcgcggatcgccgagacgctggccgacgccctggccgacgatccgctgttctgcgacctgctggccaacctgcacctgcacctggaacacgaggtggatgccgaacgcgtggtcgaggtcaagcggatcagcaccgccgccacgctgtccctcgccgactccatccagcgggcgctgcccgaactcgggcgctcggggtcgctggacatcctgctggccgcctactcgctggcggccacgctgtggcaggtggccaaccccccggaacggctcaccgacgcctacgcagaggagccggaagtcgttccgccggaatggaatctggacttcgcctccgcgctgacccggctgttgaccgccacgtgcatcggcctcatcccgcaatcggcatgatcgcagaaaggggggcgcgcccatgacgacgaccgagccaaggaccgagccgttgaacaagcaggactccgcgggccgcgagggcggcgagaccgcccggcagcgcgccaggaagaaggggtttctgggccgtttctggctggtgctcacgatcgcggccgtcgtcgcgctgtcggggttcgtcgtctaccggttgcacggcatcttcggtgtgcaccccgggtcgttcggcggcggcacctcgggggaggtgctcgacgagttcaacgccaagaccatcacgcttcaggtctggggcccgccgggcagcacggccaccatcaactatctcgacgaaaactcccatccgcagcaggcactcaacgtgcccttgccctggagcaaagtattgagttcaacgaaacccggcatcccggcaaacctggtggcgcaaggagacggcagctggatcgcctgccagttcgtggtgaacaagcacgacggcagcggtgacgtcatcaagaccccgaatcgctcggatcccaaccagaccgtgaacgcgttcgtctactgcctggacaagtccgcatgagcgagccggtcgaggctgcgccgcgcgtcgatcagccgctgatcccgccgttcctgccgcggatgatccatcggctggccctgccgatcgtcctggtgtggttgggcatcgtgttcatcaccaacacggtggccccgcagctggaggtggtcgccaaaacccactcggtgtcgatgagcccgaccgacgcggcctccttccagtcgatgatgaaggtcggagcgacgttcaaggagttcaactccgacaactcggccatgatcctgctggagggcgacaagcccctcggggccgaggcgcaccgctattacgacgagatcgtcaggcgcgtcgagcaggacaagaaacacgtgcagcacgtccaggatttctggagcgatccgctgacggcggcgggttcccagagccacgaccagaaggccgcctacgtccaggtgtacctcgccggcaacatgggcggcggcctggcgaacgagtctgccctggcggtgcgcaagatcgtggactcggtgcccgcgccgccgggaatcaaggcgtatgtcaccggcgcgggtccgctgttcgccgaccagtcccacgcgggtgagaagggcgtcgcggtcgtcaccctcatcaccttcgtggtgatcatcgtgatgctgctggtcgtctaccggtcgatcatcaccgtcgcggtcatgctgggcatggtgttcatcgagctggcggcggcccgcggtgtcgtcgcgacgctcggcaactacggcgtgatgggactgtcgaccttcgccaacaacatgctggtgctgatggcgatcgccgccgggacggactacgcgatcttcgtggtcgggcgctatcacgaggcgcgtgggctgggcgagacccgcgagcaggcgttctacaccatgttccacagcaccgcgcatgtggtgctcggatccggcctgaccatcgccggcgcgatgtactgcctgagcttctgccgactgccgtacttccagtcgctgggggtgccctgtgcggtcggcatgctggtcgcggtgctggcggcgttgacgctggctccggcgatgctgacggtcgcctcgttcttcaagctgatggatccgaagcgcacgctgcagacccggggctggcgccggatgggcaccgcggtcgtccgctggcccgcgccggtgctcgcggtgacgatcgcggtcgcactggtcggtctgctcgccctgcccggctacaagacggactacgacaaccgccacttcctgccggcggacaccccggccaatgtcggttatgccgccgcggaccggcatttcgaccaggctcggctcaatcccgagctgttgatgatcgagaccgatcacgacctgcgcaacccggccgacttcatcgtcctggacaaggtcgccaaggcggtcttccacatccccgggatcggccgggtgcagaccatcacccggccgttgggcaccccgctcgaccacagcacgctgggttttcagatgggcgcgcaggccgcgggccggctgcagacccagcactaccaggaggagcaggcgaacaatctgctcaagcaggcagacgagctgcgcaagacgatggcgacgctgcatgagcagatgcaggtcacccaggacctgagcaacaccacccatgaaaccaccaggctcaccaaggaaaccgtgcagatcaccgagaggttgcgcgacgacatcgccaacttcgacgacttcctccggccgatccgcagctacttctattgggagaagcactgttacgacatcccggtctgctgggcgctgcggtcggtcttcaacgcgctcgacggcatcgaccaggtggccgagaacatcgtgaacctcagcgcgaacctggacaagctggacaggattcagccgaagctggtggcgttgatcccgccgcagatcgagagtcagcagcgcaacctcgacaccatcatgtcgaactacgcgatcacccagggcctcaacgaccaggccaaagcgcaggccgacaacgccaccgcccagggcgatgccttcgacaaggcgaagaacgacgacacgttctaccttccgccggaggcgttcaagagcccggacttcgcgcggggcctgaagaatttcatctcgcccgacgggcgcgcggtccggctgatcatctcccacgaaggcgacccggccagtcccgagggcatcaggcacatcgaaccgatcaagcaggccgtgcacgaggcgatcaagggcaccccctgggagggcgccaaggtctacctcggcggcaccgccgcgacgtacaaggacatgcacgacggctccaacatcgacctgttgatcgccggaatcgccgcggccacactgattttcatcatcatgctggtgatcacccgcagcgtcgtggcggccttcgtgatcgtcgggacggtgttgctgtcgctgggcgcctcgttcggcctctcggtgctgctgtggcagtacatcctgggcctaaagttgcactggatggtgctggcgatggcggtcatcctgctgctggcggtcggctcggactacaacctgctgctgatctcgcggttcaaggaggagatccacgccgggctcaagaccgggacgatccgcgcgatggccggttcgggctcggtggtgacctccgccggtctggtgttcgccgccaccatggccacgttcatgttcagcccgctgctggtgatggcccaggtgggtacgacgatcgcgctgggcctgctgttcgacaccctgatcgtgcggtcgttcatgacgccgtcactggccaccctgctcgggcgctggttctggtggccgcagcacgtgcgtccacgcccggccagcaccatgctgcggccctacggaccgcgtcgggccgtgcgcgagctgatcctcgccgacgtcgacgagcacccgccgggcggcgtggtccagccccgctgaggggctaaggaatcgggctaagcgattacgaccagttccacaccgacatgtcgccgggcgggtactggttgcagatgtcggtggccttggccaccacgcccttgttgttccagaagatcttcatgtggttgggccaggcctcccacagcggatcggcctggggggcgcatagaagttctcggagtagttccggcggtcctgcggcgacaacgcgtagaaccagtgcgccttgtcgatggtcgcctgctggacgttggggtggttgttgaagtcgatcatgtagcgctggtagtacaccgggctggtgtcccgcgtggccgccaggatctgctcggcgtcgcacgtggtgttgatcatccggcgggggatcgggaagtcctccgtcgagtcggccaccgcggtcgacgggaagatcgcagcggtgacacccagggcaacgaacgcggcgcctgcacgcaggcctctactcagccgagacatagacgttacggtagcacttctcggcccggcgcgaacagttcccaggtcacccccagggtgatcgctagtgcatctcactatccatcgcgatcagggacgatgacgtggctcggatcgggccgcagctccggcggggcctggctgtagtcgccgaacgggccgtcgcggcgctcgacggcggcccgcaccccccgcgtctcggcgatcttgatgaactccagcgcgtcgggggtgttgcgcatcagcccgtcgaggatgccgcccagcgtctgggtggacgccagccccatgttctcgtaggcctggttgacgatcagcttctgcgcctgcagctgcgacagcgggatgcgcgccagctcggcggcgacctcggcgacccgcgcctccagccgctcgaacggcaccgcctcgttgatcagctcgatctcggcggcctgcacgccggtcagcggccgtcccgtcagcgcatgccacttcgccttggccaggctcagccggtagagccacatcccggtcagatacgccccccacatcctgctgtagggcgtgccgatcacggcgtcctcgctggcgatgaccaggtccgcgcacagcgcgtagtcgctggccccgcccacacaccagccgtgcacctgcgcgatcaccggtttggacgcccgccagatggccatgaatttctgggtcgggccggtctcgcgggcgctgaccatcgcgaaatccttgcccgggtcccagcggccgtcggtcatcatggcctcgccccagtgctgaaaaccgccgccgaagtcgtagccgccggagaaggcccggcccgctccgcgcagcacgatgaccttgatggccgggtcacgctcggcccgcccaacggcggcctcgatctcgtcgggcatcggcggcacgatggtgttgagctgctccgggcggttcagcgtgatcgtggcgaccggaccggccgtggtgtacagcagcgtttcgaagtcggagggcatggccccaacttagggatcgggctcgcggttttccggcgaagacgcatagatgcggccgttgatcttcaggtacggggtggtgaggtaggccgagaaggccaccacggccgcgaagatcgccgccgccaggacgccgttgggccacagccggccggtcccgaacgcgaagcagacgatgccgatcaccgatgtcgcccagtagaagcgccggccggcccgccggtcgttgatgaaccggtagcgcgcctgcgccgccgaaaccaggatgaagatcagtccggtcgccagcagggtgagttcgatccgttgcgccgacacgtcgacgatcttagggccggccgagcgtctgccacaggaacgaataggtcagcgccgacttgaacgccacctgttcgttgtccgccgccccggcatgaccgccctcgatgttctcgtagtagtagacccggtggccggcggcctccagggcggccgccatcttgcgggcatgccccgggtgcacccggtcgtcgcgggtggaggtggtgatcagcaccggcgggtaccggcgcgtcgccgaaatattctggtacggcgagtattcggagatgaacgcccagtcgtccgggttgtccgggtcgccgtattcggccacccaggaggcgccggccagcagcaggtggtagcgcttcatgtccagcagcggcacgctgcacaccagcgcgccgaacttctccggatacttggtcaacatgatgcccatcagcagtccgccgttgctgccgccctgggccccgagttgggcgaccgtcgtgatgccgcggtccaccaaatcggttgccacagcggcgaagtcctcgtgcaccttgtgccggccctcgcggatcgcctgggtgtgccagccggggccgtactcgccgccgccgcggatgttggccagcacgtaggtgccgccgcgggccagccacagccggcccagcaccccgctgtagccgggggtgttcgaggactcgaagccgccgtagccgtagagcagggtgggcccgggccggtcggctgccgggccggtcggccgcaccacgaagtaggggatcggtgtgccgtcggtggagtcgacgaaatactgtgccacgctgatgttttcggcatcgaagaaggcgggggcggtcttgagctgctcgagtcgcccgtcgtcggtgccccgcatcagccgcgacggtgagtcgaatccgctggagtccaggaagaattcgtcgccggtgtcgtccgcggagacgacgacggtgttggtcgcggccgggatcccggccaccggctcgcgccgccagtcaccgggtctgacgatctcgacgcggctggccacgtcgaccagggtcaccatcagcagccggtcttcggtccacgcgtagtggttgagcgcggtgtgctcgtcgggttcgaagacgacgcggaaatcccgtgcgccggaaaggaattcctcgtagtcggcggccagcagcgagcccgcggcgtaggtgcgggtgcccagcgtccagtcgctgcgcaactcgaccagcagccaccggcggtgcaggctcacgctggcgtcggtcggggtgtcgatgcggacgagctggccgccccgcagctcgtagacctcttcgttccagaagtccagcgcccggccgatcagggtgcgcccgaagccggggatgcggctgacgctggccaccacgttcacgtcggagcgggcgccctcgaacaccgtctgcgcctcgtccagcggcgtgccccggcgccaccgcttgaccacccgcggatagccggactcggtgagggtgccggggccgaagtccgtgccgaccagcacggtgtcggggtcctcccagctgagctgcgacttggcctcggcgagcgcgaacccgtcgtcgatgaattgctttgtctgcatgtcgaattcacgcacgatgcaggcgtctgagccgccgcgggacaagctgatcagcgcgcgggtgtattcggggtggatgacggcggcgccggcccacacccatttctcgccgtcggcgcggcccagctcgtcgacgtcgatcagcacctcccactcgggcgcgtcggtgcggtaactgtccagcgtggtgcgccgccacagcccgcgcgggttgtcggcgtcgcgccagaagttgtagaggtgctcgccgcggcggaccacgtacgggatgcgggcgtcggtgtcgagcacctcgagcgcctcgacgcgcatccgctcgaactcggcgtcgcggaagcgggccagcgtcggctcgttgcgggcgcgcacccaatccagcgcctgctcgccggtcatgtcctcgagccacaggtaggggtcgtactcggcggcggcatcggtgcgggcgtgcgacgtcatgccagccattgtggtcgcggcggtagtgtgaggtgtattacacaggtgaacgaggagtgagagcagatgactgtcttcgcacgtccgggttcggccggggcgttgatgtcgtacgaatcccgctacgacaacttcatcggggggcagtgggttgcaccggcgcgcgggcgctacttcgagaacccgacaccggtcaccggccagacgttctgcgaggtggcccgctcggatgaggccgacgtcgacaaggcgctcgacgccgcccacgccgcggcgccggcgtggggcaagaccgcgccggcggagcgggccgcgatcctgaacaagatcgccgaccgcatcgaggagaacctggaatccctcgcggtggccgaggtgtgggacaacggcaagccgatccgcgaggcgctggccgccgacatcccgttggcggccgaccatttccggtacttcgccggggcgctgcgcgcgcaggagggctcgctgagccagatcgacgacgacaccgtggcctaccacttccacgagccgctcggcgtggtcgggcagatcatcccgtggaacttcccgatcctgatgggcgcctggaaactggcgcccgcgctggcggccggcaacgccgtcgtgctcaaacccgcggagcagaccccggtttcggtgctctacctgatgtcgctgatcggcgacctgctgccgcccggagtcgtcaacgtggtcaacggattcggcgccgaggccggcaagccgctggcgtcgagcaaccgaatcgccaagatcgccttcaccggcgagaccaccaccgggcggctgatcatgcagtacgccagccagaacctgatcccggtcaccctggagctcggcggcaagagccccaacatcttcttctccgacgtgatggccaaggccgacgactaccaggacaaggcgctcgagggcttcacgatgttcgccctcaaccagggcgaggtgtgcacctgcccgtcgcgcagcctgatccaggccgacatctacgacgagttcctggagctggccgcgatccgcaccaaggcggtccgccagggcgacccgctggattccgagaccatgctgggctcgcaggcgtccaacgatcagctggaaaaggtgttgtcctacatcgcaatcggcaaggacgaaggcgccacgatcatcaccggcggggaacgcgccgaactgggcggcgacctgtccggcggcttctacatgcagcccaccatcttcgccggcaacaacaagatgcgcatcttccaggaggagatcttcgggccggtggtggcggtgacgtcgttcaccgattacgacgacgccatctccatcgccaacgacaccctgtacgggctgggcgcgggtgtgtggtcccgagacggcaacaccgcctatcgcgccggccgcgacatccaggccggccgggtgtgggtgaactgctaccacgcctatccggcgcacgcggcgttcggcggctacaagcagtccggcatcggccgggagaaccacaagatgatgctcgaccactaccagcagaccaagaacatgctggtgtcctacagcaacaaggcgcaaagcttcttctagatggagccgcggcccccgtccggagtcgtcatcaccgccgcggccgccgaggtgctggcccggctgcagcggcagcacggcccggtgatgttccaccagtccggcggctgctgcgccgggtcgtcgccgatgtgctacccggtgggcgacttcctggtcggcgatcgcgacgtgctgctcggtgtgctcgacgtcggcgccgacggggtgccggtatggatctcgggcccgcagtacgcggcgcactaccgcgacaagcacacccagctggtcatcgacgtggtgccgggccgcggcggcgggttcagcctggaggcccccgacggcgtccggttcctgtcccgcggcagggttttcagcgcggccgaacaggcggccgtggccgccgcgccgatcatcaccggcgcggactaccagcgcggtgagcggcccgcggcgcgcggcgcggtggtggccgacgcggcctgcaggacctgcccttgacgccggtcaccgcagtacagtcgagacggtgattcctcttccgcgtccctgggtgctggccggcgccatgctgatcggaagcgcggtcgggctgttggccggcgtggcgttcaccgtcgccgtgcaggcccacgttcgcccggacctcgcgatcgcggcggtggtcggcatccccagcgtgatcggcctggccctgatcctgttctccgggcggcgctgggtcaccaccctgggcgcgttcgtgctggcggtggcgcccggctggttcggggtgctcgtcgcgttgcgggtgaccgccggtggctgacgacaaggacgcctcgagcccgggcaccgaggcgttcgtgcccgacttctccgatgacgacgacgccgccgacaccggcacccagtcgtgggcgccggacttcgacgacgacgccgaggacgacgacgccgaggcggccgagcccgcggccgagcgggagccggagccggagcccgaaccggagccggagccggccgggttcgccggcccggtgccgccggtcgccgtgcccggccgctacttctacgtcaagtggtggaagttggtcctggtgctgctcgcggtgtgggccgcgtcggcggtgatcgggctgggcttgttttcctggtggtaccactcgatcgacaaaaccccggcgctgttcgcggtgctggtgttcgtgatggtgtgcgtcgtcggcggcgtcatgctggcgatggtcgaggccaggccgctgatttcggcccttgcggtggcggtgctgtccgggccgttcgccgcgctggcggccgcggcgccgctgtacggctattactactgcgcgcgggtggggcactgtctggtgggcgtcgttccgtactgacgtgattcgaggccaccgctcggcgcgttgggagcggcgcgactcacggcgttgtccgctgccagccggcgcccactagggtgggcacgtgacttctcactatgacgtcgtcgtcctcggggccggtcccggcggatatgtggcagccatccgcgccgcccagctggggctgagcaccgccatcgtcgaaccgaaatactggggcggagtctgcctcaacgtcggctgcattccgtccaaggcgctgctgcgcaacgccgaactcgcccacatcttcaccaaagaggccaagacgttcggcatcaacggcgaggcgaccttcgactacggcgccgccttcgaccgcagccgcaaggtggccgagggccgcgtcgccggcgtgcacttcctgatgaagaagaacaagatcaccgagatccacggctacggccggttcaccgatccgcacacgctggcggtcgagctcaacgacggcgggaccgagacggtcacgttcgacaacgcgatcatcgccaccggcagcagcacccggctggttccgggcacgtcgctgtcggccaacgtggtcacctacgaggaacagattctgtcccgggagttgcccgagtcgatcatcatcgccggcgccggcgccatcggcatggagttcggctacgtgctgcacaactacggcgtcgaggtgaccatcgtcgagttcctgccgcgcgcgctgcccaacgaggacgccgacgtgtccaaggagatcgagaagcagttcaagaagctgggcgtcaagatcctcaccggcaccaaggtcgaatccatctccgatgacggctcgcaagtgacggtggtggtcagcaaggacggcaacagccaggaactcaaggccgcaaaggtgttgcaggccatcggttttgcgcccaacgtcgagggctacggcctggaggcggccggggtcgcgctgaccgaccgcaaggccatcggcatcaccgactacatgcgcaccaacatcgagcacatctacgccatcggcgacgtcaccggcaagctgcagctggcccacgtcgcagaggcccaaggcgtggtggccgccgaaaccatcgccggcgcagagactttggcgctcggcgactaccggatgatgccgcgcgccaccttctgccagcccaacgtcgccagcttcgggctcaccgaacagcaggcccgcgacgaggggcacgacgtggtggtggccaagttcccgttcaccgcgaacggcaaggcgcacggcgtgggcgaccccagcgggttcgtcaagctgatcgccgacgcgaatacggtgagctgctgggcgggcacctggtcggccacgacgtctccgagctgctgccggagctcaccctggcgcagaagtgggacctgacggccaccgagctggcccgcaacgtgcacacccacccgaccatgtccgaggcgctgcaggaatgcttccacggcctgaccgggcacatgatcaacttctgagccctcgacgatgctgcgcaccctgacgccccagaccatcgcggccgccctcggtggcctggcgaccggttatgtcctttggctgcttgccatttcgaacggggacaacgccacggtgggccagtgggggccgctcgtgttggtggcgtcggtggtgctgggcggtgccgcggcggtgtggggcgcctggcagcgccggcgcggcagccggccgcgggccgccttcgccttcgcgctgccggtgcttcccgtgctgctgacgctggccatcctggccgacgtctacctatgacacctgctcatgacccctcggggtggtccagcggaatcgccagtgccgacatggtggccgccagcccgtcgtattggcttgccagcaggcagaattcgatcagctgccggcggtccaggtgctccgccagctgccgccaggtggcctcgctgacggtccggtcgttgacgaactcgtcggtcgccgccagcagcgcctgctgacgcacggtcaggcgggcctgcaccggttcgagtcgctgcggccacgcgaagatcgcggcctgcagatccgggtccagcccggccgtccgcgccatccggcgatggtgctgcagctcgtattcgcagccgcgcaggtgcgcgacccgcaggatcaccagctcggtgtcggcggtgggcagtttgccgcgcagcagccggcccccgtaggccagccaggtccaaaacagcagccggcgttgacccagcgtggtgaacaggtgcatctccggcgcgccgacggtgcgcgcgcccaacttcgcgatcacccaattgatcggtcccagttggcgaaaccgcccggccgggatgcggggcgcggtcacgactgcttcaccaggtagggagacaccgtgctgcggtgctcgtcgaggtcgagggcgcggccgagcgcggggaaggcgcgctgcgggcagttgtcgcgttcgcagacccggcagcccgcgccgatcggtgtcgccactgttcctgggccccccgagacgtcgagtccctccgaatagaccagccggtgtgcatggcgcagctcgcagcccaggccgatcgcgaaggtcttaccgggctgaccataccgggccgcgcgccgctccacggtgcgggccacccacatgtagttgcggccgtcgggcatctgggcgatctgcaccaggatcttgcccgggttggcgaacgtctcgtagacgttccacagcgggcaggtaccgccgctggaggagaagtgaaaacccgtggcggactggcgttttgacatgttaccggcccggtccacccggatgaaggagaacggcaccccgcgcatcgacggccgctgcagcgtcgacagccggtgcgcgatggtctcgtagctgaccgagtagaacgacgacagccgctcgacgtcgtagcggaaattctcggcgacgtcgtggaattggcgatacggcagcaccgccgcggcggcgaagtaattggccagcccgagccgggccagtttgtgcgactcctcgctggtgaacttgccctgcgccaccaggctgtcgatcaggtcgccgaactccaggtaggccagttcggcggccatcttgaacacctgctgcccccacgacaggtgattgctgatctccagcgtcttggtctcggggtcgtagcggtgcagcacggtgtcgcccagatcgatgcggcggttgatgtgcacgccgtgcacctcggtgagccggcgggtcagctcccgggccagatccccgtggtgcagccgcatcttgatggtgaggtcctcggcggcggtgtccagctcgtgcagatagttctgccgctggtagaagtagtcgcggacctcctcgtgcggcatggtgatcgacccggtgccgctgccgtcgaagaaccgctcctcggtggcggccgcaagctgcgcggtggtgatccggtaccgccggtgcaggttgaccaccgcgcgggccagaccgggatgggcactgaccatctcggcgacctcggtggggtcgacgtcgatgtccaggtcccggtccatggtgacctcgcgcagctcggccaccagccgggtgtcgtcctgcgaggagaagaaggtggcgtccaccccgaacacctcggtgatgcgcagcagcaccgccaccgtcagcgggcggacgtcatgctcgatctggttgaggtagctcggcgagatctccagcatctgggccagcgcggcctgggaaaacccgcgttcgtgacgcagctggcgaacgcgtgagccgacgaacgtcttggacactccacccaggttaccgggcctgtgaagccctggttcgcagagttggcagccgcgatggccgcgtcgcgattggtgttcggcgcacgtcgttggcatgattcgagcggggccgcaggccttagcctgggggcaccgacgaggaggaaacggggagcgacaccgtgagcctggacaaacaaatgatgccggtgcccgacggtcaccccgacgttttcgatcgcgaatggccgctgcgggtcggcgacatcgaccgcaccgggcggctgcggctggacgccgcggcccgccacattcaggacatcggccaggaccagctgcgggagatgggtttcgaggagacccacccgctgtggatcgtccggcgcaccatgctggacctgatccggccgatcgagttcaacgacatgctgcggctgcgccggtggtgctcggggacctcgaaccggtggtgcgagatgcgggtccgcatcgacggccgcaagggcggccttatcgagtccgaggcgttctggatcaacatcaaccgggaaacccagatgccgtcgcggatcgccgacgacttcctggccggcctgcacaagacgacctcggtggaccggctgcgctggaagccctacctcaaaccggccagccgcgacgacgcggtcgagatccacgagttcccggtccgggtcaccgacatcgacctgttcgaccacatgaacaactccgtgtactggagcgtcatcgaggactacctggcgtcgcacaccgagctgatgcggacgccgttgcgcgtcaccatcgaacacgaggcgccggtggccctgggcgacaaactggagatcatctcccacgtccaccccgccggatccaccgatcaattcggtcccgagctggccgatcgcactgttacaacgctcacatacgccgtcggcgacgaggccaaagccgtcgccgcgatctttgctcgctaacagtacaagcgtccgggttaatttgcggtgtgacctgcggctttggggttactgacgggtagcttctgaaacggttaagttcgttaccggcttagcaaacttcgcaaaatcgcccggtcccattgctgaaattggcaactgaaacggctggaccgggcgttatcggctgtgccatcttcgagttagcacaccagtgaagttgagccgctagctaccgccggtgaggcatccagcaattccgtagtgaagatcgtgaaggagcatgcccacgtctgtcgttggcacccccaagagcgccgaggagatccagaaggactgggacaccaacccgcgctggaaggatgtcacccgcacctacaccgccgaggacgtcgtcgccctgcagggcaccgtcgtcgaggagaacaccctggcccgccgcggcgcggaggtgctgtgggagcagctgcacgacctggagtacatcaacgcgctgggcgccctgaccggcaacatggccgtgcagcaggtgcgcgccggcctgaaggccatctacctgtcgggctggcaggtcgccggtgacgccaacctgtccggtcacacctaccccgaccagagcctgtaccccgccaactcggtgccgaccgtggtgcgccggatcaacaacgcgctgctgcgcgcggaccagatcgccaaggtcgagggcgacacctcggtgaagaactggctggcgccgatcgtcgccgacggcgaggccggcttcggtggtgcgctcaacgtcttcgagctgcagaaggcgatgatcgccgcgggtgtggcgggctcgcactgggaggaccagctggcctcggagaagaagtgcggccacctgggtggcaaggtgctgatcccgacccagcagcacatccgcacgctgacctcggcccggctggccgccgacgtgtgcgacgtgccgaccgtcgtcatcgcccgcaccgacgccgaggcggccacgctgatcacctccgacgtcgacgagcgcgaccagccgttcatcaccggcgagcgcaccaaggagggcttctaccgggtccgtaacggcctcgagccctgcgtcgcccgggccaaggcctacgcgccgtactccgacctgatctggatggagaccggcacgcccgacctggagctggccgccaagttcgccgagggcgtcaaggccgagttccccgaccagatgctggcctacaactgctcgccgtcgttcaactggaagaagcacctcgacgacgccaccatcgcgaagttccaaaaggagcttgccgcaatgggattcaagttccagttcatcacgctggccggcttccacgcgctgaactactcgatgttcgatctggcctacggttacgcccgcaaccagatgaccgcctacgtcgagctgcaggagcgcgagttcgccgccgaggagcgcggttacaccgccaccaagcaccagcgcgaggtgggcgccggttacttcgaccggatcgccaccacggtcgatccgacgtcgtcgaccaccgcgctgaccggctccaccgaagagggccagttccactgacgacgagcggcgtcagccgcgaggaggaagtggaaccgacggcttgagccactgaaaacgagcggcgtcagccgcgaggaggaagtggaaccgaggggcttgagccactgaggctgagcgggcttgcccgcgaagacgaggtggaaccgagggcttgagccactgagttagtgctgccagcagacccaaaaggacccttttgcacagcaaaagcggtgcctttgcgtctgctcgcggcgtgtaaggtgcggtgcacgacaagacgattggcggagaaacagtgagtgacgcagcgattcagcgagtaggagtggtcggggccggccagatgggatccggcatcgccgaggtctcggtccgcgccgacgtcgacgtgacggtgttcgagaccaccgaggccctcatcacggcgggacgcaaccgcatcgtgaagtcgctggagcggggcgtgagcgccggcaaggtcaccgagcgggagcgtgaccgcgcgctgagcaagctcaccttcaccaccgacctgaaagacctcgccgatcgccaactggtcatcgaggccatcatcgaggacgacgccgtcaaggcccaggtcttcgccgaactcgaccgggtggtcaccgaccccgatgcggtgttggcctccaacacctccagcatcccgatcatgaagctcgccgcggcgaccaagaacccgcaacgggtgctgggcctgcacttcttcaatcccgtgccggtgctgccgctggtcgagctggtcagcacgctggtcaccgacgaggccgccgccgcgcgcaccgaggagttcgccagcgcggtgctgggcaagcaggtggtgcgctgcagcgaccggtccggcttcgtggtcaacgcgctgctggtgccctacctgctgtcggcgatccggatggtggaggccggcttcgccaccgtcgaggacgtggacaaagccgtggtggccgggctgtcgcatccgatgggcccgctgcggctttccgacctggtgggcctggacaccctgaagctgatcgcggacaagatgttcgaggagttcaaggagccgcagtacggcgccccgccgctgttgctgcgcatggtggaggccggccggctcggcaagaagacgggccagggtttctacacgtattgacatgtattgaccggcgcccgcgcggccgcgcgtgatcaggtcggttactatgctcgcgttcaataagacgaaaggtttgtgccgcgcatgacgggcttggaaccgtattacgaggaatcgcagtccatctacgacgtctccgacgaattctttgcgttatttctcgatccgaccatggcctacacgtgcgccttcttcgaacgcgacgacatgacgctcgaagaagcgcaaaccgcgaagttcgacctggcgctgggcaagctgaacctcgagcccgggatgacgctgctggacatcgggtgcggctggggcggcgcactgaagcgggccctggagaagtatgacttcaacgtcatcggaatcacgttgagccgcaaccaattcgaatacagcaagaagctgctggccggatttccgacggaccgcaacatcgaggtgcggctgcagggctgggaagagttcgacgacaaggtcgaccggatcgtcaccatcggcgccttcgaggcgttcaaaatggagcgctattccgcatttttcgaccgcgcctacgacatcctgcccgacgacggccggatgcttttgcacaccatcttgacctacacccagaagcagcagcacgagcgcggcgtttcgatcacgatgagcgatttacggttcatgcggttcatcggccaggaaattttcccgggcggccagttgccggcgcaggaggacattttcaaattcggtgaggcggcgggcttttcggtggagcgggtgcagctgctgcgcgagcactacgcgcggaccctcaacatctgggcggcgaacctggaggccaacaaggacaaggccatcgccatccagtcgcaagcggtctacgaccgctacatgcactacctgaccgggtgcgagaacttcttccgcaagggcatcagcaatgtggggcaattcacgctggtcaagtaggcgggtcgggcaggacggctacttcttctccatggtgaactggttgacgtcggtgtagccctcccggaacagcttggcgcagccggtcaaatacttcatgtaccggtcgtagacctcttgggactggatggcgatggcctgctcgcgattggcctcgagtgcctgcgcccacaggtccagcgtccgggcgtagtgcagctgcagcgactgcacccgggtcaggtcgaagcccgccgtcacgccgtattcgccgacggtctgcggtgtgggcagccaaccgccggggaagatctcggccaggatgaaccgggagaactcgacgatctcgtgggtcagcttcatgcccttggcccgggcgtccttgaaggagggccgaacgatggtgtgcagcaacatgattccgccgggcggcagcacgtcgtaggccatcctgaagaagcggccgtagcgttgccggccgaagtgctcgaacgcgccgatcgagacgatgcggtccacgggctcgtggaacttctcccagccctccagcagcacccgccgggtgcgcggggtgtccatcgcgtcgaaggtcttctgcacgtgctcggcctggttctccgacagcgtcaggcccaccacgttgacgtcatacttctcgatggcccgccgcatggtggcgccccagccacacccgatgtccagcaacgtcattcccggctcgagcttcaacttgcccagcgccaggtcgatcttggcgatctgggcctcttccagggtcatgtcgtcgcgctcgaagtacgcgcagctgtaggtctgagtggggtccaggaacaggcggaagaagtcgtcggacaagtcgtagtgggcctttacgtttccaaaatgcggcgtgagctgcacggacatgtcgacacgagcctttctatatgagatggcgggggtgggcagccacgcaaccaccccgcttcgtcccccaacgctgtcctgcatggtagtcgctggggcgggtgaagtcgccctgcccgggccggtgccggggcgtcagagcgccgcttcccgcggcggcacgatgggcgacgggtgcggctcttcgcggaacttctccagcgacccgccgacttccacgatccccttgagcgcgttccagctcagcatcgtcaggtagtcgatcagctcgtcgcggctcatccgcgggtacgacatccaggagtgggtggccagttgcacaccgccgacgatcaggtacgcccacggttccacgccgccggtgtccattccggcgtgctgcatgcgccggcgcatcagcaccgcgagcatgcgcgcgatgatgcgctcggagtcggcgatgaccttgctcttgctggccgagctgttggacatcacgaaccggtacggctcgggttcgttggccacggtctccacgtagacccggatgacctcgcgggtcaggtcgaagccgtccaggccggaggtgagcgcggcggccatgttgggaatcagcgtggtctgggtgaaccgcatcatcacggcggtcgtgaggtcgttcttgtccacgaagtagcggtagagcaccgtcttggagaccccgatctcggcggcgatctcgtccatgctcagcgcgccgccgagccggcgaatcgcgtcgatcgtgccgtcgaccagttcgttgcgacggtccactttgtgctgatgccagcgccgcttgcgcccgtccattttgacgctcgcagccgtgatttgctctgccactatcgccgaaatcccattccctagacgccctcgatactacggcgtggaccggccggttcgcggtcttggcccgggcgtggacgaccgtcgcgcgcggtgtcgtcgcaccaatcggcgggaaagatagatgatggagtggtggcacacagagcctcgggccgcacctcgttcgccgaatccttcgccggcgccgatccgcaggccgacgcgcagcggcgggtggcgctgcgccggatgaaggcggtggcgctgagtttcctgatcggtgccaccggcctgtttttggcctgccgatgggcccaggcgcagcccggcgtgggcgcctgggtcggttatgtcggggcggccgcggaggccgggatggtgggcgcgctggcggactggttcgcggtgacggcgctgttccgccatccgctgggcatcccgatcccgcacaccgccatcatcaagcgcaagaaggaccagctgggggagggcctgggcaccttcgtgcgggagaacttcctgtcgccggaggtggtggagaccaagctgcgcgacgcgcaggtctccggccggctgggtaagtggctgtcggaagccgcgcacgccgaacgagtggccggcgagacggccacggtgctgcgggtgctggtggagctgctgcgcgacgaggacgtccagcaggtgatcgaccggatgatcgtgcgccgcatcgccgaaccgcagtggggtccgccggtgggccgggtgctggcgacgctgctggccgagaaccggcaggaggcgctgatccagctgctggccgaccgggccttccagtggtcgctgaacgccggcgaggtcatccagcgggtggtcgagcgcgaccagcgggtggtcgagcgcgactcgccgacctggtcgccgcgcttcatcgaccacctggtgggcgatcgcatccaccgcgagctgatggacttcaccgacaaggtgcgccgcaaccccgaccacgaactgcgccggtcggcgacccgcttcctgttcgaattcgccgacgacctgcagcacgacccggacaccatcgcccgcgccgacgccatcaaggagcagctgatggcgcgcgacgagatcgccaatgccgccgcgacggcctggaagacgctgaaacggctggtgctcgagggcgtggacgacccgtccagcgcgctgcgcagccgcatcgccgacaccgtggtgcgcatcggggagtcgttgcgcgacgacgccgacctgcgcgacaaggtcgacaactggctggttcgggccgcccagcacctggtctcgcagtatggggtggaaatcacagcgatcatcaccgacaccatcgagcgctgggacgccgaagaggccagccggcgcatcgagctgcacgtcggccgtgacctgcagttcatccggatcaacggaacggtggtcggctcgctggccggtctggtcatctacgccgtcgcgcagctgcttttctagcagtgctaacaagtgcttgcaatagcaagcacttgtagtagtctgagggccgtccagaccgaccgtccgaccaggagcacgccgtggcacccgaggagaagctctccgccaaggtgtccaacgctgcctccgacatggcctccgacatcggcagcttcatccgcagccagcgtgaactcgcgcaggtgtcggtgcggcaactcgccgagaagtccggggtcagcaatccctatctcagccaggtggagcgtggactgcgcaagccatcggccgacgtcctgaaccagatcgcgaaggccctccgggtttccgccgaggttctctatgtgcgcgccgggatcctcgagcccagcgacaaaagtcaggtgcgggacgcgatcgtcaccgacaccgcgatcaccgagcgccaaaagcagatcctgctcgacatctacgcatcgttcacccagcaaaacgaagccacccatgaggagtgtccgacccagcccgacagcgagtgatcagtccgtcgccggcgggtcagtgatgtatagacgaccggccgcgggggttaccccacagtagggatctggcggttccagccctactgcatgacgaacgaccgacgctccgcgcggccccagttgcgaaggagacgtttgcacctaatttcccgaccagacacctgacaaacacacagagcagaaaccatgaaaggaacaaccatggcggaaaacccgaacatcgacgacttgcgagccccgctgctcgcggccctgggcgcggccgacctggccctggccacggtcaacgacctgatcgccaacctgcgcgagcgggccgaggagacccgcgccgagacccgcacccgggtcgaggagcgccgcgcccggctgaccaagttccaggaggacctgcccgagcagttcaccgagctgcgcgacaagttcaccaccgaggagctgcgcaaggcggccgagggctacctggaggcggcgaccaaccggtacaacgagctggtcgagcgcggcgaggcggccctgcagcggctgcgcagccagaccgccttcgaggacgcctccgcgcgcgccgagggctacgtggaccaggccgtcgagctgacccaggaggcgctgggcaccgtcgcgtcgcagacccgcgcggtcggtgagcgcgccgccaagctggtgggcatcgagctgccgggcaaggccgaggccgccggcaagaaggcccagaaggccatcgccaaggcccccgccaagaaggcgccggccaagaaggtcacccagaagtagcaccgcagttcccacgacgctcgactccgagttgccttcgggtgactcggagtcgacgttgcggacgccgcccgcctacgcttgaggcgtgaaccacctcgtgggtaccgtcatgctggtcttgcagatcgccgtcctggtcacggcgatctacgccttcgtgcatgccgcgctgcagcgccccgacgcctataccgccgccgacaagctgaccaagccggtgtggttgctgatcctgggcggggcggtggctttgacgtcggtgctgggctacgtgttcggcgtgctgggcatggcgatcgccgcctgtgcggccggggtgtatctggtcgatgtgcggcccaaactcctggaaatacagggcaagtcgcgctagcgggatgcgggtcccgctggccgcgccggccgcgctgctgctggcgctgtgctggccgatagcgcccgccgccgcgccggaccccggcgccgggacggccgacccgccgttcatcgaccacaccgactgggcgcaatggcagggccgaagcagcctgcgggtcttcccgacgcccgccgggcgcaccgccgccaagacgcccgggtcgatggcgatggccgacgaggcctgggccgaggtgctcgccctggccccggacgccgacaccgccgggatgcgcgcgcagttcctgtgccactggcagttcgccgagctgggccggcccggcaagctcagctggaacctggagccgtggcgccccgtcgtcgacgacgcggagatggtcgcctccggctgcaatcccggcggaccggaagaatccttcggatgacccccacccgcgcccagctggcggcattcgtcgaccacaccctgctcaagcccgaagccaccgccgccgacgtcgccgccctggtcaccgaggcggccgagctgggcgtctacgcggtgtgcgtctcgccgacgatggttcccgccgccgtgcaggccggtgccggcgtgcgggtggccagcgtggcgggattcccgtcgggcaagcatgtgtcggccgtcaaggcccacgaggccgcgctggcggtggcctccggcgccgccgagatcgacatggtcatcgacgtcggcgcggcgctggccggtgacctcgacggggtgcgcgccgacatcgcggcggtgcgcgacgcggtcggcggcgccgtgctcaaggtgatcgtggagtcgtcagcgctgctggcgctggccgacgagcacaccctggtccgggtgtgccgcgccgccgaggacgccggcgccgacttcgtcaagacgtcgaccggattccacccgaccggcggcgcatccgtgcgggcggtcgccctgatggccgaggcggtcgggggccggctgggggtgaaggccagcggcggcatccgcaccgccgccgatgcgctggcgatgctggatgccggcgccacccggctgggattgtcgggcacccgggccgtgctcgacgggctgggctgaggaccgccggcgtcagaggttggcgaagcaggggtcgttgttgttgccggtcgggatggcggcgttgcgggtggagaagtggctggtcacacccttgtcggtgacctgcacgctgtccgcgtgaatgcccagcgggtagttcttcgtcaggttcgaggtgaagtcgtccagcgtcgactgcaccgactccttgggcatggtgaagcccagcgcgttgaagctgacgatctgtagttgcaacccggtgcccgagatcaccggcttggcggtgatgttgtccaacatgcctttcagctcgatggtgccgtcggcgggatgggtggtcaccgtgttggtgacgaacgggccaagcaccgggatggcgttctgcaccgactgtttgatgccgtcggtggtccagtcgatagtggcgtccaatgcgccgatggtgcccttcgagttgccgttgtccttgagccggacgtcattgatattgatcgagagcttcatgcccttggcatcgcggatgttgttgccggcggtctgcaccgagatgttggtgtagtgcttggtcgcctgctgccacagcatcagcggtgtcacgccgaaggacgcggtggcctggtccttgacctcgcaggccaccgcctgggcgaccttggtgtcggcgacgtgccgcacgtacagctccgccccgatgaacccggcgatgagcagggcgaacacgatgatgaagatcaacagcaccgagaccgggtcacgcaggaaccggcgcttctttttcgccggcccgttgtcggggttcggcgcggtggccagccgctcggtgggcccggcgggcggggtgggcggcggcgggtagccgggctgctgcatctggggccgcggcgcgccgaatcgttcggtctggccggggggcgggggagcgggcgccggcggcggtggcggcacctgaccgggcgcctgacctgggccgccggtgttgatccgctcggtcggccgttccgtgggaggctggccgtagggtccctggttggcgggacggccccacgtcgacgggtcctgattcgggggtccttgtgggttcgtcacccgaccgattctgccctaccaacctgagcaaagtccgagcggttgctgagcgccgcgatagtcttgcgggcctgcgcgacccggtcgacgtcgatgtcggccagcaccagctgcggctgcgcgccggccgacgcgaccacctcacccagcggcgaggcgaccagactgccgcccaccccggtcggcgcccccgacgcggacaggatctcgccggggtcggcctgaccggccgcggcgatgtagctcatcgagtccagcgcgcgggcgcgggccagcagggtccactggtcgagtttgccgggacccgcgccccaggacgcgcagaccgcgatcagctgggcgccgcggcgggccagctcggtgtagagctcggggaatcggatgtcgtagcagacgctcagcccgacccgcaccccgtcgacgccgaccaccaccggctcgcggcccggcgcgacggtgcgcgattcggtgaagccgaatgcgtcgtagaggtggatcttgtcgtagtgggtgaccgcctggtcgtccgaattggccacgagcagtgtgtttttcacgcggccgtcgccggacggggtgaacatgccggcgatgacggtgacgttcgcctcggtggcgatgcggcgcaccccgtcggcccaggggccgtcgaccggctcggcgatcggcgccagcggcacaccgaaccggcacatggtggcctcggggaacaccaccagccgcgcgcccgccccggcggcccggcgggtgtattcgccgaccagcgccaggttcgccgcggggtcggtgccgctgaggatctgcgccagcgcgattcgcatgagcgccagcttaggcccggcgacgatgcgcgccgccgcggcggcgcgaggaggagtcgggcgatccagcttaggcgcgagctcaggcggtttgggcgatccactcggtggtgaagcgctgctcggcggcgatcagctcggccaggcgcgcgccgatgaagttctccagcttgccgccgatgatcggcacccgcacctggaccgtggcccggaaggtcaaccgggcgccgccggtgtcctcggcgggctccagcacggcgtcgccggccagattcaccggggcgtccacgatcgagccgacgaccgagccggtggcggtgccgcccgtcaccggcccccacgtctcctcgcggcggatacacagatcgccgctgtgtaactgggtgaccatgcccggcaacttgtcgctgcggatcacctgcagcgtgacgacctccacgacgtcctcgtcaccggactgtccgccgacgcgcatcgactccagtgtcgccacgtcgacgccggagctggccagcctggcccgccagtaatcggcatcggtgaaggcccggtgcacctcgtcaacgctgccgtcgtagtgggccgacaagtcgaatgagcgcggcatagcaggtcaggctaccgttacgggccatgaaatccagcggtgcaggtgcggcgttcgccggcgcgtcagtggccgacgcggcgccgctggcgccgctgaccacgctgcgggtcggacccaccgcgcgccggctgatcacctgtgccagcagcgaacaggtgatcgccacgttgcgccggctggacaccgaaaggcttgccggacaacgtgatccggtgctggtgttcgccggcggctcgaacctggtgatctccgacgcgctgagtgacctgaccgcggtgcggctggccaacgacggaatcaccgtcgagggcaatctggtgcgcgcccaggcgggggcggtgtgggacgacgtcgtgctcaccgccatcgagcacggcctgggcgggctggaatgcctgtccggcatccccggctcggccggggccaccccgatccaaaacgtcggggcgtacggcgccgaggtctccgacaccctcacccgggtcagggtgctggaccgcggcagcgggcaggtgcgctgggtgcccggcaccgagctggaattcggttaccgcaccagcgtgttcaaacggcgcgccgacgacgggctcgaaatcccttccgtggtactggaagtcgagttcgcgctcgatgcgtcggggcgcagcgcgccggtgcgctacggcgagctggccgccgaattgaaggtgcccgtcggccagcgcgccgacccgcgcacggtccgcgaggcggtgctggcgctgcgggcgcgcaagggcatggtgctcgacgccgccgaccacgacacctggagcgtggggtcgttcttcaccaacccggtggtggcccccgacgtctacgagcggctggccgggtccgtcgacgggccggtgccgcactatccggccccgggcggggtcaagctggccgccggctggctggtggagcgggcgggtttcggcaagggctatccggtcccggacccgggcggcccggaagcgccctgccggctgtccaccaagcacgcgttggcgctgaccaaccgcggcacggcccgcagcgacgacgtgatcgccctggcccggaccatccgggacggggtgcggtctgtgtttggcatcacactggtgcccgagcccgtcctgctcggttgcaggctgtagcggcaaaatttgccgacgcgcgcccggcgcccgatttgtcgcggcagggttgcccgattttccccggtatctttgattttcgtgaccccgtccagcgccccgcggccgttcaaccggcgcgtggctttggcgaccctcgggatcggtgcgctggcccccggcgtgctggccgcctgcggtggtggcaccgccaaggaggccgagaagaaggagcagccggcgctgcggctgaagtaccagcccgccgacgcggcccagaacgtggtgcccaccgcgccggtcagcgtcgaggtgagcgacgggtggttccagcacgtcacgctgtcgaactcgtccggcaaggccgtcgcgggcaccttcaactccgaccgcaccgtctacaccaccacggagccgctcggctacgaccagacctacacgtggagcggctcggccgtcgggcacgacggcaagaccgtcgccgtggcgggcaagttcagcaccgtgtcgcccagcaagaagatcagcggggcgttccagttggccgacggccagaccgtcgggatcgcggcgccgatcatcctgcagttcgacgcgccgatcagcgacaaggccgcggtcgagaaggcgctcaccgtcaccaccaacccgcccgtggagggcagctgggcctggctgccggacgaggcgcagggcgcccgggcgcactggcgcacccgcgagtactaccccgccggcaccaccgtcaacgtgcaggccaagctgtacggcctgccgttcggcgacggcgcctacggcgccgaggacatctcgctgaacatcaacatcggcaggcgccagatcgtcaaggccgaggtgtcctcgcaccgcatccaggtgatccgcgacgagggcgtcatcatggacttcccgtgcagctacggcgaggccgacaaggcccgcaacgtcacccgcaacggcatccacgtggtcagcgagaagtacgccgacttctacatgtccaacccggcggccggctacagccacgtgcacgaacgctgggcggtgcggatctccaacaacggtgagttcatccacgccaacccggccagcgccggcgcgcagggcaacaccaacgtcaccaacggctgcatcaacctgtccaccagcgacgccgagcagtactaccagtcggcgatctacggcgacccggtggaggtgaccggcagctccatccagctgtcctacgccgacggcgacatctgggactgggcggtggactgggacacctgggtggccatgtcggcgttgccgccgcccaccgcgcacccgccgtcgacccagatcccggtgaccgcgccggtcacgccgtccaacgcgcccaccctgtcgggcacgccgaccacgtcgacgaccacgccggccagcaccggcccggctacccccggcggttgaaccggctggccgacgcctgatcgcgcggcttcatcacgatcagatccaggttgacgtgcgccggtcgtgacgcgacgaacccgatcacctcggccacgtcggccgccaccagcggggtgatgccggtgtagacggcgtcggcgcgttgttggtcgccgtcgaagcgcaccagcgagaactcggtttccactgcgcccggggcgatctcggtcagccgcacgggcttgcccagcagctcgccgcgcagcgtgcggtgcaacgccccctgcccgtgcttcgcagccgtgtagccggcgccgccgtcgtaaacctcaagtgccgcaacggaagtcacggtgacgatcagtccgtcgccggaatcgaccagcttgggcagcagcgcgcgggtgacccgcagcgtgccgatcacgttggtctcccacatccaccgccagtgctcgaggtcggcctcggcgaccggttccaggccgcgggctccgccggcgttgttgaccagcacgtcgacccggctcaatttgctcgccagcgccgccaccgcggcgtcgtctgtgacatcggccacaatggcggtaccgccgatctcgttggccagggcgtggatccgctcggcccgccgcgccaccgcgacgacgtgaaagccctgtgcagccagggttcgggcggttgcctcgccgattcccgagctggccccggtgaccaccgcgacgcgttcattcctgccagttccaaccatcgaaacaaccttagtgaacgtgctaaattttgcgtgtgcacctcagcgctctgtccaacatcaccaccgccgcgtgtctgtgcgcggcgggtgcgtgttgttgctgcgcactttgccgctcctgaccccatgccaggtgtggccaagacggccagcaaaattcggacaaaggacgctcgtgcgcacgaataccctcacccatccccatcattcgcccggtcgcgccgtgggccacgcgcccggccccaagccccaccgcgcggtgcggcggcagatcgtgccgccggcactgcacatccccgaatccgcggcggcctccgtcttccgggccgtccggctgcgcgggcccgtcggccgtgacgtcatcgccaacgtcacctcgctgagcatcgccacggtcaaccgtcaggtcatcgcgctgctggaggccggcctgctgcgcgagcgcgccgacctggcggtctccggcgccatcgggcgcccgcgggtgccggtggaggtcaaccacgagccgttcgtgacgctgggcatccacatcggcgcgcggaccaccagcatcgtggccaccgacctgttcggccgcaccctggacacggtcgagacgcccacgccgcgcaacccggccgggcccgcgctggcgtccctggccgacagcgcccgccgctacctgcgacgctggcaccgccggcggccgctgtggatcggcgtcgcgatcggcggcaccgtcgacagcgccaccggccaggtggaccacccgcggctgggctggcggcaggcgccggtcggccaggtgctggccgacgcgctgggcctgcccgtgtcggtggcctcccacgtggacgccatggccggggccgagctgctgctgggcatgcgccggttcctgcccagctcgccgaccagcctctacgtgtacgcccgcgagaccgtcggctatgcgctggtgatcggcgggcgggtgcacgtgccgaccagcggcccgggcaccatcgcgaccctgccggcgcactccgagctgctcggcggcaccgggcagctggaatcgaccgtcagcgacgaggcggtggtggccgtcgcccgccagctgcgcatcctgccgttcgccccggcgaaccgggccagcggatccgccgccgggatcgccgacctgctgcgggtggcccgcgccggcaatgagcaggccagggagctgctcgcggagcggggccgcgtgctgggcgaggcggtggcgctgctgcgcgacatgctcaaccccgacgagctggtggtcggcgggcaggccttcaccgagtaccccgaggcgatggagcaggtggaggcggcgttcgcggcgcgctcggtgctggggccgcgcgacatccggctcaccgccttcggcaaccgggtgcaggaggccggcgccggaacggtgtcgctgagcgggctgtacgccgatccgctgagcgcgatgcggcgggccggggcgctggacgcccggctgcgcgaggtcgcgcgggacgagtcgtcggcctgacccgacgccgccgtgtgctgcgcacttgggcccggtggcgaaccatcctgtaaagatgacagagtgcggcacgatgacgtcttccggctgaatgagccgcgccgggtggccgtgctggcggtccacacctcgccactggcccagcccggcaccggcgacgcgggcggcatgaacgtctacgtgctgcagaccgccctgcacctggcacgccgcggcatcgaggtggagatcttcacccgggcgaccgcctcggccgacccgccggtgcagcgggtggcgcccggcgtgctggtgcgcaacgtggtggccgggccgttcgagggcctggacaaatacgatctgcccacccagctgtgcgcgttcgcggccggagtgctgcgcgccgaagcgtcgcacgagccgggttactacgacatcgtgcactcgcactactggctgtccggtcaggtcggctggctggcgcgcgaccgctgggcggtgccgctggtgcacaccgcgcacaccctggccgcggtgaaaaatgccgcgctggcgcaaggggattcgcccgagccgccgctgcgcacggtgggcgagcagcaggtggtcgacgaggccgaccggctgatcgtcaacaccgacgacgaagcgcggcaactgatttcgatccaccacgccgacccggccaggatcgacgtcgtgcatcccggggtggacctcgacgtgttccgacccggcgaccgtcgcgccgcccgggccgcgctggggctgccgctcgacaaggacatcgtggcgttcgtcggccgcatccagccgctgaaggcccccgacatcgtcttgcgtgccgccgcgaaactgcccggggtgcgcatcgtggtggccggcgggccgtcgggcaccggcctggcctcgccggacggattggcccggctggccgacgaactcggcatctccgcgcgggtcacgttcctgcccccgcagtcccgcccgaacctggccactctgttccaggcggccaatcttgttgcagtgccgagctattcggagtccttcggcctggtggcgctggaggcgcaggcgtgcggcaccccggtggccgcggccgcggtcggcgggctgccggtggccgtgcgcgacggcgtcaccggcaccctggtggccgggcacgacgtcgaccactgggccgacgcgctggccgggctgctgcgcgcgcccgccccggcggccgcggcgatgagccgcgcggcggccgcgcacgccgccaccttctcctgggaccacaccacggacgcgctgctggccagctaccggcgcgcgatccgcgagtacacgaccgagcgccggggggtgggcgcatgagcgccaccgtcgagcgggtgatcgaggacacgctgcaggccagcggcctgacctactcgaaacacgctggggcgcatggcggtccgtcgggcctggtggtggaactgcccggcgagcgcaagctcaagaccaacaccatcctgagcgtcggcgagcactcggtgcgggtcgaggcgttcgtgtgccgcaaaccggacgagaaccacgagggcgtgtaccggttcctgctcaaacgcaaccgccgcctctacggcgtggcctacaccctggacaacgtcggcgacatctacctggtgggccgcatgtcgctggcgtcggtcagcggcgacgagatcgaccgggtgctcgggcaggtgctcgaagcggtggactcggacttcaacacgttgctggagttgggttttcgctcgtcgatccagaaagagtgggagtggcgggtgtcgcgcggcgagtcgctgaagaacctgcaggcctttgctcatctgatcgacgacgacgagggttagcccggggccacgcccggcagcgcttttcgggtgcgtgagagactaaccggcatgggtgagactgccacgctggtactgctgcgccacggcgaaagcgaatggaactcgctgaacctgttcaccggttgggtggacgtcgggctgaccgacaagggccgcgccgaggcggtgcgcagcggcgagctgctggccgagcagggcctgctgcccgacgcgctctacacgtcgctgctgcgccgcgcgatcaccaccgcgcatctggccctggacgccgcggaccggctgtggatcccggtgcggcgcagctggcggctcaacgaacgccactacggggcgctgcagggcctggacaaggccgagacgaaggcgcgctacggcgaggagcagttcatggcctggcgacgcagctatgacacgccgccgccgccgatcgagcggggcagcacctacagccaggacgccgatccgcgctacgccgacatcggcggcgggccgctgaccgagtgcctggccgacgtggtcgtccggttcctgccgtacttcaccgacgtcatcgtcccggacctgcgcagcggcaagacggtgctgatcgtcgcgcacggcaactcgctgcgcgccctggtcaagcacctcgatcagatgtccgacgacgacgtcgtggggctgaacatcccgaccggcatcccgctgcgctacgacttggacgcccggctgcggccgctggttcccggcggcacctacctcgaccccgaggcggccgccgccggcgccgccgcggttgccagccaggggcgcggctgaggcgtcgaaccccgccgggaggctgcccaggggggcgccgaaagccccatttgccaaacagcacgtgaacggaagcagaacacctgttacgcaaggtgtgacttgtccgattttggcctcgttccgctagggcagcgttcaggaagatttgtaggatttgctatgtgactgtgttctcggcactgttgctggccggggtcttgtccgtgctggcactggccgcaggtgtggcggtcgggacccggttgtccccgcgggcggcgcagcgccgccagcgaatcagcaccgaatggaccgggatcaccgtcgcgcagatgctggaacgcatcgtggcgctgatgccgctgggcgcggcggtggtggacgcccaccgcgacgtcgtctacctcaacgaccgggccaaggagctgggcctggtgcgcgaccgccagctcgatgaccaggcctgggaggccgcgcagcaggcgctgaccggtgtcgacgtggaattcgacctgcggccggcgaaacggtccgggggccgggccggcctgtcggtgcacgggcaggcgcggttgctcagcgaggaagaccgccggttcgccgtggtgttcgcccacgaccagtccgactatgcccggatggaggcgacccggcgcgacttcgtggccaacgtcagccacgagctcaagacgccggtgggggccatggcgctgctcgccgaggcgctgctggcgtcggccgacgactccgagaccgtgcgccggttcgccgagaaggtgctggtcgaggccaaccggctgggcgacatggttgccgagctgatcgagctgtcccggctgcagggcgccgagcggttgaccaacgtcaccgaggtcaacgtggatagtgttgtgaacgaagcgatttcgcgccacaaggtggcggccgacaacgccaacatcgaggtccggaccgacgcccccagcggtttgcgggtgctgggcgacgagacgctgttggtcacggcgttggcgaacctggtgtccaatgccatcgcctattcgccgccgggctcgccggtgtcgatcagccgtcgccgccgcggcgacaacatcgagatcgccgtcaccgaccgcggcatcggcatcgcgctggaggatcaggagcgggttttcgagcggttcttccggggggacaaggcgcgctcacgcgccaccggcggcagcggcctgggcctggccatcgtcaagcacgtcgcggccaatcacaacggcaccatcggggtgtggagcaagccgggcaccggatcgacattcaccctgtccattccggcggccgtggcgtcgcatcggggcgacggcgaatccgagcagccgcagggtcgtgacgtgcggcccaaccgttcccaacgagaggaagaactaagccgatgactcgcgcgtatgacgatgcagagcgtagcgatgaggaggaatcgcgccgatgacccgcgcgtatgacgatgcagagcgtagcgatgaggaggaatcgcgccgatgaccagtgtgctgattgtcgaggacgaggagtcgctggccgacccgctggccttcctgctccgtaaggagggcttcgaggccaccgtggtgaccgacggctccgccgcgctcgccgaattcgatcgggccggcgccgacatcgtgctgctcgacctgatgctccccgggatgtcgggcaccgacgtctgcaagcagctgcgcgcgcgttccagcgtgccggtgatcatggtgaccgcccgggacagcgagatcgacaaggtcgtcggcctcgagctcggcgccgatgactatgtgaccaagccgtattcggcgcgggagctgatcgcgcggatccgggcggtgctgcgccgcggcggtgacgacgactccgagatcagcgacggcgtgctcgaatccggcccggtgcggatggacgtcgaacgccacgtggtttcggtcaacggtgacacgatcacgttgccgctcaaggaattcgacctgctcgagtacctgatgcgcaacagcggccgggtgctgacccgcggccagctgatcgaccgggtgtggggcgccgactacgtcggcgacaccaagacgctcgacgtgcacgtcaagcggctgcgctccaagatcgaagccgacccggccaacccggtgcacctggtgacggtgcgcgggctgggctacaagctggaaggctaactagcccgacgggcgtgccggcggcggaccgtcggtgtcgaagacggtccgctcatcgtcgttggcgctcaacgtgatacgccgacgcatgtccgccgtcatcggcggaagctcatcgaggtcgaaccacgcggcggcggtgctctcgtcgtcggcggggaagggctccccggacagccactccatccggaacacgtgatccaggtactgggcgtggtcgccgttggcgtggatggccggccgggtcacgtgcacccacgccagccgggtggcccgcgcgctgacccccgtttcctcgcgcacttcgcgggcggcgcagtcggccggattctcgcccggctccacgatgcccgtcacggccgtccaggcgccattgtcggatcgcttgaccagcaacacctttcggccgcggatggtgacggccgtgatgccgggcaaccacagcggcgcatgaccgatccgccggcgaagctcgacgatgaaatccgggaccggcgtcacgccgggatccgctcgttgacggcgggtgcctcggcgccgcgcagccccacttcggcgtgcccgagcaccgaccaccgccggtcgtcgatctcgacgcggatgtcggcccgttcggtgttggtgcacaccgcggtgccgccgtcgggatcggtgtagcccaggctcacgcagcgctccggcggcaggtcggcccggatgcacacccggcgcccgccgatccggcccgccagctgccagtgcggcagctgcaatcgcgtccgcatccgcagcgacggcaaaacacttgcgggccaatcgtttccgtcgagccggaagcgcacgaaagccagcggcgcgaggcggcgcagcccgggcctgtgcgacaccgcggaaaccacctcgagaacgtcgccgccgccgaggtcggcatgcatccacccccagcgacgggcgttgccgtgcccgtagatgtgggcgacaccgccacgccacccctcgacgcgcgcgggggcaccgtcgaggtgcaaccggccggtgaactcggcggtgggggcgagcaccacctgcgcgccgggcagcagctcacgctcccacgcgagtcgcgggaacgtccacagcgggcgcgtggggtccgtccaggacagctcccaggccagcgctccggcccgcccgcgcagccgctcgtcggccacccgaacgcccgcgcaggcgaaccagtccgggccggtggcggggtgcgcgggcaccggcccgaaccggccggtgcgcggcggcccgtcgggcggaaaccaggtggcccagccgtgcccgtaggcggcgccgcgcagcggggccacggtctcgcaatggacccacaatcccgcgccggtgcgcggatcggacagggtggcgtaccagacctcgaggcgccccggccggccgcgccggcgcggggcggcggccgatcgcttttcgtcgtccaccacaggcccgacgtcgtggctactcggcgatccgggtcgccgggtgcaccgcgatgagccctaacttgctgcggcgcttgcacattgcggccagctccgcgtatgccttggcgcccagcagctcggtgagctcgtcggccaggctttcccacacctgggtggcgccgacgtgagcggccgggtcgccggtgcagtaccaatgcaggtccgcgccgccggaaccccaaccgcggcggtcgtattcggtgacccaggtcttgaggatctcggtgccgtcgggccgggtcacccactcctggctgcgccggatcggcaactgccagcagacgtcgggcttcatggtcagcggcggcacgccgagcttgagcgccttgctgtgcagcgcgcacccgacacctccggcgaaacccggccggttcaggaagatgcaggcgtccttgtgcttgcgggtgcggtactgcggctggccgtcgtgctcgtcgagctccagataacccttgcggcccaagcctttttcccggaattgccagtcgtcgtcggtcagctgtttgaccgcgtcgtccagccgggcgcggtcgtcgtcgtcggacaggaacgccccgtgcgagcagcacccgtcgtcggggcggcccgccacggtgccctggcaggccggcgtgccgaacacgcaggtccaccgcgacagcaaccaggtcaggtcggcggcgatcaggtgctcggggttgtcggggtcgtagaactccacccattcgcgggcgaaatccagctcgacctcttgtccgggttgtcccggttgcgggtgcgaattcgccacgtcgtccacgttagacgaagatgcggtctcgccgagccgctgacactcgggcccggtatggctctgatcacggcgattgaccgggtcgcgcgacgcggggcgatcggggcaccgttaggttgttggcgtgcgattgggcgtgctcgacgtgggtagcaacacggtgcatctgctggtggtcgatgcccaccggggcggccatccgaccccgatgagttcgacgaaagccaccctgcggctggccgaggccaccgacagcgccggcaagatcaccaagcgcggcgccgagaagctgatctcgaccatcgatgaattcgccaagatcgccgacagttcgggctgcgaggagctgatggcgttcgccacctcggcggtgcgggaggcgggcaactccgaggaagtgttgaaccgggtccgcaaggagaccggcgtcgagctgcgggtgctgaccggggtcgacgagtcccggctgacgtttctggcggtgcgccgctggtacgggtggagtgcgggccggatcatcaacctcgacatcggcggcggctcgctggagatgtccagcggcctggacgaggagcccgaggtggcgttgtcgctgccgctgggcgcgggccggctgacccgcgaatggctgcccgacgatccgcccggccggcgccgggtggcgatgctgcgggactggctggacgccgagctcgccgaggccagcgaaaacatcctggaggccggaaccccggacctcacggtggcgacgtcgaagacgtttcgctcgctggcgcggctcaccggggcggcgccctcgggcgccggaccgcgggtcaaaaggacgctgacagcaaacggcctcaggcaactcatatctttcatctctaggatgacgaccgctgaccgggccgaactggaaggagtgagcgccgagcgggcgccgcagatcgtggcgggcgctttggtggcggaggcgagcatgcgagcgctgtcgatcgaatcggtggatatctgcccgtgggcgttacgggaaggtctcatcttgcgcaaactcgacagcgaagccgacggaacggccctcatggagccgtccgtgcgtaatgctggaggtcaggtagttgatcggaatcagaaccgatcgagaggcgacaaaccatgaccggaccgcattccgagaccgagagcccaggcactcggccgatctcggttgccgaattgctggccagaaacggaaccatcggcgccccggcggtcacccggcggcgtcgccggcggcgcggcgacagcgacgcggtgaccgtggccgagctcaccggcgagatcccggtcatccgtgacgacgagcccgacgaccaacccggcgccaccgacaccgtcgacacggccgcacccgcccaacccgtggccgaatccgccgagccggtagccgaagacgagcccaagaccccctactggtccgagcccgagccgcgctggcccaagtcgccgccgcagcccaagcgcgcccccggccccgagcgcagcgcctacccgcggccgctgcccgagccgggcccgtccgccaacggcaccggccggcgatcctcgggcgccgaggacatgagccccgacccgatggaccactacgccgacattccggtggacgtgatggactccgaggtgcgcgaggccgaaccggcgttggaggactccgcgtacgtgcgctcgtatctgcaatcggattcggcgctcgacgacgacctcgacgaggatctcgacgacgaccacgcggatgccgcgacgctgaccgacgaggacctcgacgcggcgcacctcgaggacgaggacgccgaggcggcacacccggcgcccggcaggctcgaggcgatctggcgcggcagtgtggttgtgctgcaatcgattctggccgtcgcgttcggcgccgggctgttcgtggccttcgaccagctgtggcgctggaacagcatcgtggccctggtgctctcggtgctggtcatcctcggcctggtggtcggggtgcgggtggtgcgcaagaccgaggacatcgccagcacgttgatcgcggtcgcggtgggtgcgttgatcaccctggggcccttggcgctgtcgttgcagtcgggctagcggcaccgacagacagtgcgccctgccatcaaagtcggcctgtccacggcttcggtgtatccgttgcgggccgaggccgcgttcgaatacgcggcccggctcggctacgacggggtggagctgatggtgtgggccgagtcggtcagccaggacatcgcggccgtcaagaagctgtcccggcgctatcgggtgccggtgctgtccgtgcacgcgccgtgcctgctgatctcgcagcgggtgtggggcgccaacccgatccccaagctggaccgcagcgtgcgcgccgccgaacaactgggcgcgcagaccgtcgtcgtgcatccgccgttccgctggcagcggcggtacgccgaggggttcaccgagcaggtcgcgacgctggaggcggccagcgacgtgatgatcgcggtggagaacatgtttccgttccgggcggaccggtttttcggagcgggccagtcgctggaacgcatgcgccgccgcggcggcggccccggcccggcgatctcggcgttcgcgccgtcctacgacccgctggacggccaccacgcccactacacgctggacctgtcccacaccgcgacggccggcaccgattcgctggacatggcgcggcggatgggcaacgggctggtgcacctgcacctgtgcgacggcaacgggctgcccgccgacgaacatctggtgcccggccgcggcacccagcccaccgccgaggtgtgccagatgctggccgccggccatttcgccggccacgtcatcctcgaggtgtcgacgtccagcgcgcgcagcgccaccgagcgggaggccatgctcgccgaatcgctacagttcgcccgcacccatctgctgcgctgaccacccaggagaccccccgagttcatgaacgcgttatttaccaccgcaatgacgttgcgggaggccggatccggcgtctacgacggcgagctcgacaagcgctggaccatcggtcccaaggtgcacggcggcgcgatgctggcgctgtgcgccaacgccgcccgcaccgcctgcgccggcgggccggaatcggcgcagcagcccgtggcggtgtcggctagcttcctgtcggcgcccgatccggggccgatgcgattggtgacgtcgatccgcaagcgcggccggcggatcagcgtggtcgacgtcgagctcacccagggtgagcggaccgccgtgcacgccgtcgtcaatctcggtgagccggagcactttccggccgatgggtcggcggcaatcgccaagccgctgctgtcggccaacccggtaacggctctgatgccgcccgaaccgcccgacgacatcgaaccgatcgggcccgggcatccgctggccggcctggtgcacctgggcgaggggtgcgacgtgcggccggtgttgtcgacgatgcagccctccgccgacgggcgaccgccggtgatccagatgtgggcacgcccccgcggggtggcgccggacgcgctgttcgcgctgatgtgcggcgacctgtcggcgccggtcaccttcgccgtggaccgcaccggctgggcgccgacgatccagctcaccgcgtttctgcggggcctgccggccgacggctggctgcgcatcatcgcgacctgcaccgagatcgggcacgactggttcgacgaggaccacaccgtcgtcgacagcctgggccgcctggtggtgcaggcccgccagctggccctggtccctgccgctccttagccggcggtgtctgcgatgctgtccggcatggcaagaatcgcaatcatcggtggcggcagcatcggggaggccctgctgtcgggtctgctgcgggcgggccggcaggtcaaggacctggtggtggtcgagcgggttcccgagcgcgccaaatatctggccgacacctactcggtgctgatcacctcggtggccgacgcggtggaaaacgcgtcgttcgtcgtggtcgcggtgaaaccggccgacgtcgagtcggtgatgtccgagatcgcccgcgccgccggccaggccgagagcgacaccgccgagcaggtgttcgtcacggtcgccgccggggtcaccatcggctacttcgaatcccggctgccggccgggacaccggtggtgcgggccatgccgaacgcggccgtgctggtcggcgccggggtcaccgccctggccaagggccgcttcgtcaccgccccgcagctcgagggcgtctcggcgctgttcgactcggtcgggggcgtgctgagcgtgccggagagccagatggacgccgtcaccgccctctccggctccgggccggcgtatttcttcctgctggtggaggccctggtggacgccggggtggccgcgggcctgagccgcgaggtggccgccgacctgaccgcccagaccatggccggctcggcggcgatgctgctggagcggatggacgccgatcggcgactgggcgaggcggagacgcccgggctgcgggtggacgccaccgccacccagctgcgggccacggtgacctccccgggcggcaccaccgcggccggcctgcgcgagctggagcgggggggcctgcgggccgccgtcgacgccgccgtccaggccgccaaaatgcgctctgagcagctaagaattacatcggagtaatccaagaattttgaactgattgtcccccaccagtaccagtaaccccattagtcccgctattctccttgtgtaagcgcgtgtcggtgccagcggaggggaagccgctggcatgcgcgtgcctgacacgattgggttgcgatgacgtctacgaacgggccatcagcgcgagattctgcaggtaaggcacgggacgccggttccggcgacggccagcagggcaggacgcaatttctcaccgtcgccgaggtggccgcgttgatgcgggtctccaagatgacggtctaccggttggtgcacaacggcgaactgcccgcggtgcgggtggggcggtcgttccgggtgcacgccaaggccgtccacgacatgctggagacgtcctacttcgacgccggctgagcccgacgacggcgcggcggcaccggtcctgcgcgggcgcggtcacccgactccggtttggtgttcgatgcatccggccgggtaaagtgtccgggtccaatctttgaagcaggccacggtcagatagcggagttatgggttcagtaatcaagaagcggcgcaagcgtatgtcgaagaagaagcaccgcaagctgctgcgtcgcacccgggtgcagcgcagaaaactcggcaagtaactccgtcggcggcccggtgccgccgccccgcccggccgttaggctgttcgggtggatccgtcgaatgggcacaattccggaccggacgacaccgccggcaacacggtgcattaccccaagatcgtgttggtcaccggcgcctgccggtttctcggcggctacctgaccgctcgcctggcgcagaacccgatgatcaaaggggtcatcgcggtggacgcgatcgccccgagcaaggacatgctgcgccggatgggtcgcgccgagttcgtccgcgccgacatccgtaatcccttcatagccaaggtgattcgcaacggcgacgtcgacaccgtggtgcacgcggcggccgcgtcgtacgcgccccggtccggcggcaccgcggcgctcaaagagatcaacgtgatgggcgcgatgcagctgttcgccgcctgccagaaggcgccgtcggtgcgccgggtggtgctcaagtcgacgtcggaggtgtacggctccagtgcgcacgacccggtgatgttcaccgaggacagcaccagccgccggccgttccgggccggcttcgccaaggacagcctggacatcgaggcctatgcgcgcggtctggggcggcgccggcccgacatcgcggtcacgatcctgcggctggccaacatgatcggcccggcgatggacaccaccctgtcgcgctatctggccggcccgttggtgccgaccattctcggccgggacgcgcggctgcagctgctgcatgagcaggacgcgctgggcgcgctggagcgcgcggcgatggccggcaaggcgggcaccttcaacatcggcgccgacggcatcatcatgctctcgcaggcgatccggcgggccggccggattcctttgccggtaccgggtttcggcgtctgggcgctggactcgttgcggcgcgccaaccgctacaacgagatcagtcgcgatcagttcgattatttgagctacggccgcgtgatggacaccagccggatgcgttcagagcttggctaccagccgaaatggacgaccgcggaggccttcgacgactacgttcgcggccgcggcctgactcccataatcgatccagatcgggtacgctccctggagagtcgcgccatagccctggcccagcgctggggtagccgaaatccaattccgtggggtggggtcaggtaggtatcgtggcgggtgaaaccagagcgaatgtcattccactgcacacgaatcggggtcgggtagcggcgcgtcggagagccgatcaacgggccgagtcagctcgccagcatccttcgctgctgtccgatcccagcggccgcgcatccgccgagcagatcgccgcggtggtccgcgagatcgatgatcaccgccgcgcggccggcgcgtcgtcgccggaggcgccgctcaacgagctggcgcagcgggtcgccgcggtcgccgggttcctgcgtcagcgcctcaccggtgactacagcgtcgacgagttcggctttgacccgcatttcaacagcgcgatcgtgcggcccctgctgcgggtcttcttccggtcctggttccgggtcgaggtgagcggcatcgagaacctccccgccgagggcgccgcgctggtggtggccaatcacgccggggtgttgccgttcgacgggctgatgctgtcggtggccgtgcacgacgagcaccccgcgcaccgggacctgcggctgctggccgccgacatggtgttcgacctgccggtggtgggcgaggcggcccgtaaggccgggcacaccatggcctgcaccaccgacgcgcaccggctgctggccgccggcgagctgaccgccgtgttcccggagggctacaaggggctgggcaagcggttcgaggaccgctaccggttgcagcggttcggccgcggcgggttcgtcaccgccgcgttgcggaccaaggcgccgatcatcccgtgctcgatcatcgggtccgaggagatctacccgatgctgaccgacgtcaagctgctggcccggctgttcgggctgccctacttcccggtcacgccgctcttcccgttggccgggccgatcgggttggtgccgctgccgtcgaagtggcacatcgcgttcggtgagccgatctacaccggcgactacgccgcctccgacgccgacgacccgatggtcaccttcgagctgaccgaccaggtgcgcgagaccatccagcagacgctgtaccggctgctggccggccgccgcaacatcttcttcggctgagttcttcggcctgcccgccgaacgtcgagttgttgggcgattaagccgtttttcggcccaacaactcgacgctggccggcttacttgaccatggtgaactggcagacgttggtgtagccgtcgcggaacagctcggcgcagccccgcaagtacttgaggtagatgtcgtaggtctcctgacccttgagggcgatcgcctcttccttgtgggcctccagcgcgtcgccccaggcggtcagcgtcgggacgtagttctttccgatgaagtggtgccgctcgatcttgaaacccgcgtcggtggcgtacttgtccaccaggttgacctgcggcagcttcccgcccgggtagatctccttgaggatgaagctgatgaaccgcagcagggtcatgttcaccttcaagcccatcgcgttgccctcttcgcgggtcggcaccacgatcgagtgcagcagcatgcggccgtcgtcgggcagcaggtcgtagtacttcttgaagaaggtggcgtagcgctcgtacccggcgtcaccggcgccgtcggcgaagtgctcgaacgcgcccagcgacacgatgcggtcgatcggctcgtcggggaattcctcccacccctggatccgcacctctttgcggcgggggctgtccatcttgtcgaattccgccacgcaatgggcgtactggttctcgctgagcgtcaggccgatgacgtcgacgtcgtactcctccatggcgtggcgcatggtggaaccccagccgcagccgatgtcgagcagcgtcattcccggctcgaggttcaacttgtccagcgcgagcttgcgcttggcgtactgggcctcttccagcgtcttggcgccctcttcccagtaaccgcagctgtaggtcatcgacgggtcaagccagagcttgaagaactcgttcgacttgtcgtagtgggatcggaccgcctcgacgggcggtttgagctgtgtttccccctgtgacgtcatctatatcgcccctaactttcctgctgatatggatgcaactgccgcggcggtcgctgccgcgtcggcctcttggtgtgcggcctcccccagcatcgtgacgacgctggtgacaatcggctttccatcggcatcggtcacttcgctgcggatctccgcgagcacggtgccgtgggactcgatcaccgagtctagataggtgtcgaaatatagcctgtcgtgggccaggatcgggcgatggaacttgaacttctggtcgcggtggatgaccctggcgatgttgatggggatgctgaacttggtgaagatctccagctgcacgcggcgacccgcgatcgcgaggaacgtgaggggcgccaccatgtcggggtacccagctgcggcggattcactctcgtcgaagtgcgcggggtggtcgtctttgaccgcgagcgcgaactcgcggatcttctcgcgaccgacctcgaagtagtcgggtgcgcggtaatggctgccgataagtccttcggcttctttggggactgtcatgccgctgtgctctccgctcaaaaatgtctgcgcggcgcagcttatcagcgcgattgccgtctggaggccagagcggccagcgcaccaccggcggcgcccagcgccagcgccgacggcaccccgatccgggccgccttgcgggcggtgcggaaatcgcgaatctcccatccgcgttcgcgggccagggcgcgcagccgggcgtcggggttgatggccaccgcggtgcccaccagcgacagcatcggcacatcgttgtagctgtcggagtaggcggtgcagcgtttcaggttgagcccctcgcgaatcgccagcgagcgcaccgcgtgtgccttgccggtgccgtgcaggatgtcgccgaccagccgccccgtgaacacgccgtcgaccgattcggccaccgtgcccagcgcgccggtcaggccgagccgtcgcgcgatggtggccgcgagttcgtagggcgtggcggtgatcagccacacctgctgtccggcgtcgaggtgcatctgggtgagctcgcgggtgcccggccagatcttgtcggcgatgatctcgtcgtagatctcctcgccgagggccaccagctgctcgaccgaccggccctcgatgaaggcgagcgccttgcgccggccggcggcgacgtcgttgctgttctccttgccgagcacctggaatttggcttgcgcgtagatgaatccgaggacgtcgctataggtgaagtagttgcgggtggccagcccgcggccgaagtgcaccgccgaggagccctgcaccagcgtgttgtcgacgtcgaagaaggcggcggcggtcaggtcgatcgggggttgcgggcggtcatcctgggtggcagcggcttcctgcatgccctcgatcgcgcgggcggcgctggcgtcagcggccagcgactccaagtcaacgtgaccggtggggtctgcgttgaccgggtcagaggaagtcatcgccgaacctcctagatcgctgtgctgcctggcgacccagcgggtgcccgatatccaaccctatcgggcagacggcgtgggggcgttgacggttcggcggccgggcgggctggggcgcgggctgggcgttgccgccccgcggcgggctccccgtcgcccgtcgcctgtcgcccccgcgagcgtgaagttagtttcacgctcggcgcccagcgtgaagctaacttcacgctcggcgcttggctcacaccgcgataggccctcggcttgtgaggagggtcggcgccttcaggtagcggtgatgatgttgaagctaaaccaatcgggcggaattccctggcgcagcgcaccgtcgagctcttcgaaactgagccgcatcagatgtgatgctgcgacggcgtcgtgctcgggcatccaacctctgtcaattggttcaccgtcgacggtaatgctgacccgcccgggataattcaccggatcaggcttcgtaagagttatccccggatgcaagccctcttgataccagcgatagcttggtgaatcggtatatctccccggccacgcttcttggctgattagaaatagcatgtacttctcggcatcgtcgaatcgcctgaacatccataagttctttcgcgaaccgcgagattcctggtcgatgtagtatccgtcttcaccgagaacaagaaagtaggaaagttcgtagtcgtcaaggaagcgaagggtttcattgtcggtcatcgtcggtggccggggcgcccagtctggagtatgactcgagttgtcgaccttggcaccgctgtgcggcaaaggcttgcgcattctgcgcaggtaggttgcttgccatgagtaccacgacttcacgatccggtgtaattctggaggaaactccttcagattaatagggagatcgatcatccttcttcctgtattcattaaaggagtgccagtagcaggagtcgaggtcgggtggccacaccacggcgcggcgatggtattcgccgccgcggccggcgcgccgcgagtgtaagtcaggttcacactcggcgcccaccgtgaaaccagcttcacactcgccgctggtggggtggcgttggattgcccagttcgtaggggacgacccagcccgatcgcacccgacggatacaaggaaggttggcaagctgtcgtttgcggttgtgtggcgcctggcacggggagattctggtgccaaaaatggtctctatgtaacggtgaatacctagaagcagcattctggcaataagtaaaagtgcaagccttccgtgacgggtggagagctaagctttcttctcgggatcgtactcggtgccggaaatgtcatcccaaaatttgggcgaaatctttgttttgcggttttcgggagccacggcatcggacttcagcctgaaattcctcgaagtccttccttgcgcgttctaattcttctgccgttggttcggtaacgccgacttcttccggagtcgagaaaatcttacctgcgatcattttgctcatttggcgctcctttagtgatcctcagacgatcaacctgctcctcgcgcacaccggggctcgcgcgaagaaagtcctgctaagtctctgtgtccaagcccagcgctttgcgatccaggacaatccaatcataggcgtcattgactatctgcacacctttgatttctggcgatattcggatcattttcttaatttcggaccaccgcatccccccatatcttatatcggggcgtaccctactggtgtacgcacgtaatacagagcctaaatgtttcacgtggaatgtaggcattatcggctggccgtcagcgctttgtattttgcttagttctagaaatagttctctatcgcctatcgtggacccgagcgatgccggtaattctgatgcgttcgattttaccgtgctactgatgagctcttcgagtgactccgttgacccttcctgttctcggctcgctggacagccattatggcccaacgaagctggatcgatgtcgttaaggatatcgggaatctcactttttaggattgcaacgcactgcgattgccggttccataacactacccagtcgagagatggcattttgaccgctgcggcaagagcatctctgaaggtgctgcctgcaaaccgttgatgctcggataagtgcggatgtgactttgaagtaaacagcatcatcgcatgagtgccgtccgcgagtcgcgcaagaggagtggatcgcacctctctgccgtcgtgttgttcctgacgatatgggaagaagacttcggcgaaagtgattgcacgaaaaagatgtttgcgcgataacgacgaaccgtcggtagcggcgatcgccactagccgctcgatgtcgtcctcagtcattatggatgctcatttcaatatagtgtgaacgtattatcagtttcgccaaacattccctcgacatcgtataccagccctgtcgggcacgtttcgtcgaatgtgcagaccgcaaggtgaacgtcgcccattcccttacgtttcaattcgctaatacgtgtgggaactatcaccgtttgcgggttatcgggagacggcgcgggggcggtgacggtttggcacccggtcgagtgcgaccgtggcggctcttatggtcgccaacgcgggatctcagccgtgacgctctcggggatgtcctccaggagagtggtggtcagttcatcgaatgacagcgcaaggacttccatcctgggttggtcttcggggaatgcgtatccgtaggagctgcggtcttcttcgaatgtgtagcgtttcagatgttcctcgataaagccatcctggggagtgggggattcggtcttcatgaaacttatggcttgccgatccgcgggttcaactagtatgcgcgggctggggccgcggtcgtcccatttaacgaactgcgacgttaaacgaaggtcgacgcggacgctatctccgatccgcataatgacatacttggcagcgtctgagaactttgagaagaagaccttgatgctctcgtctcgttgtgccgctcgttcatgctttagggaactcaatacgcagaaataatccggcttccggtcgatgatccaagctccccagtcgcctgattccgcccactctgcccactttttgagcttttcggaataatcggaacgaaagtacaggcggtcgttttgtatgtcgggttcgtcgtacgatcctcggcaggcctcgttggcaattttgcgccagaagctgtaatgcttgattgcatcagcgaatccaacttctgcatcgagattcatagccaactctgcaggacctctctgtgctcgcccactatccccaatccaggtagccgttctcgattaaccactttatcagcacagtcttcttgtttttgtcaattactacccattgtgtgccgccccctggctggccaaatgcgtcgccaacttcgccgtatctgacttcccaaccttcgggcaattctttacctgtgccgtggaaccgattgtaatcgccagatgaaccaggtgccaggccgcggtgcggatagctatcaccgacagcgcccatgaaatcacctttagcgtcgctgacctctccaatcctgtccagccacgcatctttgggaatgctgcgagcagttttgtatatgccgtcggcgaacccttccacttttggccagtcccacgtcccagtcgcagggtcccaccatttattcaaaatttcttgcgcggtcattcccgcataagggctattcgccccggctgattcggcaagttctcgagggcagccgtgctctatgagatccttgacgagtttctcaggtgattccgcgagcgcaagttgcgcctggtgccaaggcggtaaatccgatggggtggggatctctggcggatgtccgtcggcgggttcatcgggaggcgcgccgtcgtgtggcgggtgcgatccgggcggtcgatcgccgtcgccaggcgggtgatgaccgccaggttgatgcggcccgctgccatcggccaggggatgtccgtcgccgggtccatggggaccgccatcaccaggatggtatggcccatctccgccgccgggcacgtggggagcgccatcatgcggcggctcgacgggatgagcgcccggctccccgccatgaggcacatcacctagaccggaaggtgtttcggcaggcgcgccgccgcccatcgggaccgaggacgccgatggaacgggcgccgccgccgcggccgcgggtgctggagcggacgcaggcgccgccgcagccgcgggtaccgccgcagcgggagccggcgtggccagaggttcgccgggggacgccggcgcgtgggcgggaacgggctcgtgcggttgagctggcgcgccctcggccggcgcgggcgtcactggcttgccgaccgattccggcggcgtcgcaatgggtttcggttcgccgctgtgcggcgcggcggtcggcttgggcggctcagcggccgggggtgtcccgccagccggcggcttggactcggtcgggctgtgcggcagcggaccgtcggccggcccgggcgccggcttccccgagggcgcgaccggccccggctttcccgaaggcgccggctggcccgagtccggtgctttgggcgcggccgggggcttgacctccggaggcttgggaaccccgggcggtttcttcagccctttcagcgcatcggcggcggtgtgcccgaatttgcccagcttggacagcggcccgccgggcaaggccaacgtcgccacgtcgaaagtggacttcccgagggcctcggccggattcgagccccactcgtcccagtgcgtgacgtccttgcccagcgccttccacgcgtcgaacgctcccggcacgccgtcgggccccagaccgacgagcgtgccggccccttcaaccatgccggccatggttttgccgtaacccacgggatccagcagcatccggttggggctgacctcatacagccctttgagaaatccccagccttcctcaccgacgcctttgaaggcctggcccacctggttgagcgccctgccgaccggcgtcccgtgcaagaagtggtcccactccttaccggcccaatggctcatgttctctgtggccgcggcaaccgcggacaccgtggcctcgatctggccgcccagcgtgtcggcttcccggccgaagttgtcgaccaccgtgcgaatgtcgtcggcgatcttcttgatctcgtcttcgtcttcgtcggtcagcagatcccagacctctttgatcccggtcagcggatcgcagatgcgcgacaacagatccaggatcgccgcgtgcacctggtcgaccttggccgcatagctgttgagctgcgcggcgatcgtctggcattgccgcgccacgtcggccgtggcgctggaggcgtcggccagcgccttgttgatcgcggcgccctccggaatctgttgtgcgccaatggctgccatcgttccgcccccggccgcggtctcggcggccatgaagttggcaccggcggtggcccaggccgccgcggcggcccgcaacttcgccgaatcgccggtgggccagatcatcccgatatacggggccacccagccccagccggccggggcgccgctgccgtgacccaccgccgacggcggcgccccgaccgtcaacggtccggtcacctggggtgccggcagggcggaggcccggcccgccaggtccgacatcgcctcggccaccgcgtagttgtgcgccgacatccgcaccccatcgccgatgctgcacaacccattccgggtgtcggccatcgcctggatcaacttggccgccgcgccgtcgtagcggcggccaagcgcggcgcccaccggatcgtcaccggccatcccggaggtgccggccagcgccgccgtcaaggtcgagatcaccgaacccaacgactcaccggcggccaccacggtggcgccggcgtggtctagggcggtgggatcacacgccagcggcgccatcgggtcacgaccacatgccgagattcttcgacatcgccccggtgtagttgccgtgcgcggtcgaggccgccttgccgagctgcgccagcgcctcgcgcatcatcgcctcgccgcgcacccaatgctgatgcgcctcggcatgcgccgcggcgccctcacccgtccacgtctggtgcaaacgcgttacgcgagaatcgatttcggcgatcatgtcctcggcgtagcgctggaattcggccatccgttgcacggcgtcggccagcgccgccgggtccacccggaacgcctcagccaccgcgcaccgcccgttcggcctgggcggcgccggcctcgttgctcgcataggcctcgccggcctggccgaccaggcgggccagcatcgccaacccgagttgcacttcgcgagcgccgcgatgccacagctcccacgccgcggcgtacgcgctgcccgacgcgccctgccacccgcccagcatctgaccgacctggtcgtcgagctggccgagctgtgccgaaagatgctcggccgcaccgctgagcgatgcggcggctccctgcatcaccacagggtcgacccgcaccgtgttgtcgctcatagccggaacgtaatgcctggtaacccgccccacaagtcaccgatgcgacactggtcgccatgacgtcagccaccccgcggccgcaggtggagctgcttacccgggacgggtgcaccatctgcgagcgcatccacgcccggctggtcgaactcgccgcggaattgggcttcgagctgtcgacgaccgacgtcgacgccgccgcggcggcgggcaatccggggctgcgcaccgaattcggcgaccggttgccggtgatcctgctcgacggtcgcgaacacagctactgggacatcgacgagccacggctgcgcgccgatctcgcccgctgagctcgggccggctgccaaacgattatttggtagcccagctgataaacgtttaccgtggacagcagttcagttactggaggaagcaagggagctggccaggtgatgctgccgtgagcgtcttgctcttcggggtttcgcaccgtagtgcgccggtctccgtcctggaacaactcagtatcgacgaatccgatcacggcaagatcgtcgaccgggtgttgcagtccccgctggtgaccgaggcgatggtgctgtcgacatgcaaccgggtcgaggtctacgcggtggtggacgcgttccacggcgggttggccgtgatcgggcaggtgctgtcggaccactccgggatgtcgatgtccgacctcaccaaatacgcctacgtccggtacagcgaggccgccgtcgagcacctgttcgcggtggccagcggcctggactcggcggtgatcggcgagcagcaggtgctcggccaggtccgccgcgcgtacgccaccgccgaaaccaaccgcaccgtgggccgggtgctgcacgaactggcccagcgcgcgctgtcggtgggcaagcgggtgcactccgagaccgccatcgacgccgccggcgcctcggtggtgtcggtcgccctggacatggccgaccgccggctgggcgggctggccggcaagaccgccgtcctggtcggcgccggagcgatgggcgccctggccgccgcgcacctgtcccgcgccggcatcgggcaggtccacgtgctcaaccggtcgctgtcgcgggcccaacggctggtccgcaagatccgcgaaaccggggtgcgggccgacgcgctgccgctggagcacctggccgacgcgctggccggggccgacgtcgtggtcagctgcaccggcgcggtcagcccggtggtctcgctggccgacgtgcaccacgcgctggccgccgccggccgctcggccgccgacgagaccgcccacccgctggtgatctgcgatctgggcatgccgcgcgacgtcgacccggcggtggccgggctgcccggcgtctgggtggtcgacgtggaccgcgtgcagcacgagccctcggcgcacgccgcggccgccgacgtcgacgccgcccgcaccatcgtggccaccgaagtcgccgcctacctggccgggcagcggatggccgaggtcacgccgacggtgacggcgctgcgccagcgcgcggccgacgtcgtcgaggccgagctgctgcggctggacaaccggctgcccggcctcgacagcgcccaccgtgaagaggtggcccgcaccgtgcgtcgggtggtggacaagctgctgcacgccccgacggtgcggatcaaacagctcgccagcgcccccggcggggacagctacgccgaggcgttgcgtgagctcttcgaactcgaccagaccgccgtcgacgccgtcgccgcgggcgaattgccggtcatagcaaccggattcgacgcgggcgcgccgcaacaacccaccgagtagccgattggcgaatgtgatccggataggaacccggggcagcctgctggccaccacccaggccgggggcgtcagggacgccctgatcgcccgcgggcacccggcggaactggtcaccatcaccaccgcgggggaccggtcgtcggggcccatcgagtcgctcggggtgggagtattcaccaccgccctgcgcgaggccatcgaggagggccgggtggacgccgccgtgcactcccacaaggacctgccgaccgccgacgatccacggtttgctgtggccgccatccccgcccgcaacgacccacgggacgcggtggtggcccgcgacggcctggtgctcgcggagttgccacccggttcgctggtgggcacctcgtcgccgcggcgggccgcgcagcttagagcattgggtctcggtttggaaatccgccccctacgaggcaacctagataccaggttgaacagggttagcagtggtgatctggacgcgatcgtggtagcccgggcgggtctggcccggctgggtcgcctcggggatgtcaccgagacgctcgagccggtgcagatgttgccggcaccggctcagggcgcgctcgccgtcgaatgccgagccggggacagccggttggccgcggtgctggcggagctggacgatgccgacacgcgcgcgtcggtcaccgcggagcgagccctgctggccgaactggaggccggttgctccgcaccggtgggcgcgatcgccgaagtggtcgagtccatcgatgaggacggccggatcttcgaagagctgtcgctgcgcggttgcgtggcggcgctggacgggtccgacgtgatccgcgcgtccggcatcggcactcccggtcgggcccgagagctggggctttcggtcgccgccgagctgttcgagctgggcgcgcgcgagttgatgagcggagcgcggcacgacccggcgcgaggaaattaagtgcgagttacctgggagcgacaatgacgacgcgagggcgtaagccgacacccggccgcatcacgtacgtgggctccggcccgggtgacccgggactgttgacggcccgggccgcgacggtgctggcgaacgccgcgctggtgttcaccgaccccgacgtgcccgagccggtgctggcgctgatcggcaaggacctgccaccggtgtccggcccggcgccggccgagccggcgtccaacggcgagggctccggctccgagcaggggcaggcgcagccggcggtgatctccggtggcccggacatccgcccggcgctgggtgatcccgccgaggtggccaagacgctgaccgccgaggcgcgcaccggtgtcgacgtggtgcggctggtggccggtgacccgctgaccgtcgacgccgtcatcaccgaggtcaacgccatcgcccgcagccacctgcacatcgagatcgtgcccgggctggcgcccaccaacgccgtcccgacctacgcgggcctgccgctgggctcctcgcacaccatggccgacgtgcgcggtgacgtggactgggaggcgctggccgccgcgcccggcccgctgatcctgcaggccaccgcgtcgcacctggccgacgcggcgcgcaccctgatcgaacacgaactggccgagaacaccccgtgcgtggtcaccgcgcacggcaccacctgccagcagcgctccatcgagaccacgctgcaggggctgaccgactcggcggtgctgggcggcaccgaccccgccggcccgctgaccggtccgctggtggtgaccatcggcaagacggtgagcgcccggaccaagctgaactggtgggagagccgcgccctgtacggctggaccgtgctggtgccccgcaccaaggaccaggccggcgagatgagcgagcggctgacgtcgtacggcgcgctgccgatcgaggtgccgaccatcgccgtcgagccgccgcgcagccccgcgcagatggagcgtgccgtcaagggattggtcgacggccgcttccagtgggtggtgttcacctccaccaacgcggtgcgcgcggtgtgggagaagttcggcgagttcggtctggacgcgcgcgcgttctccggggtgaagatcgcctgtgtgggcgagtcgacggccgaccgggtgcgggcgttcgggatcagccccgagctggtgccggccggcgagcagtcctcgctgggtctgctcgacgacttcccgccctacgacagcgttttcgacccggtgaaccgggtgctgttgccgcgggccgacatcgccaccgagacgctggccgaggggctgcgcgaacggggttgggagatcgaggatgtcacggcctaccggacggtgcgggccgcgccgccgccggcggagacccgggagatgatcaagaccggcggcttcgacgcggtgtgcttcacgtccagctccacggtgcgcaacctggtcggcatcgccggcaagccgcacgcccggacgatcatcgcctgcatcggtcccaagaccgccgagaccgccgccgagttcggcctgcgggtggatgtccagcccgagaccgcggcggtgggcccgctggtcgacgctctggccgaacacgccgcgcggttgcgcgccgagggggcgctgccaccgccgcgcaagaagagccgcaggcgctagcgtctcatggcttacccgcggcagcgcccgcgccggcttcgctcgaccccggcgctgcgccgcctggtggcccaaacctccttggagccaaggcatttggtgctgccgatgttcgtcgccgacggtatcgacgaaccgcgtccgatcgcctcgatgccgaaggtggtgcagcacacccgcgactcgctgcgcgccgccgccgccagcgccgtcgccgccggggtgggcggtctgatgctgttcggtgtgccgcgcgacgaggacaaggatccgatcggttcggccggcaccgaccccgacggcatcctcaacgtcgcgctgcgcgatctggccaaggacctcggcgatgccaccgtgctgatggccgacacctgcctggacgagttcaccgaccacgggcactgcggtgtgctggatgaccggggccgggtggacaacgacgccacggtggcgcgctacgtgaatctcgctgtggcgcaagcggagtcgggcgcccacgtggtcgggccgagcgggatgatggacggtcaggtgggcgcgattcgcgacggactggacgccgccggcttcaccgacgtggtgatcctggcctacgccgccaagttcgcctcggcgttctacggcccgttccgggaggcggtcagctccagcctgtccggggatcggcgcacgtatcagcaggagaccggcaactcccgcgaggcgctgcgcgagatccggctggacctcgacgagggcgccgacatcgtgatggtcaagccggcgatgagctatctggacgtggtggccgccgcggcggaggtctcgccggtcccggtggccgcctaccaggtgtcgggggagtacgcgatgatttgtgctgcggccgcgaacaattggatcgacgagcgcgccgcggcgctggagtctctgaccagcatccgacgcgccggagccgatatcgttctgagctattgggccgcggatgcggcagggtggctgtcgtgagacggggcttgcgttgacatcagacacgaccggggacgacgtccagccgaagcggttgttctacgagccgggggccagctggtggtgggtggcctgcgggccggcgtccgcggcggccatggtgctgatcgaaatctggagcggcgccaaggtgtcgctggtggtgcccgcgatctttttggtgctggtgtcggcgttcgtggggttgcaggtgaaggcggcgcgcatccacgtctcggtcgagctcaccgaggaggcgttgcgccagggcaccgagacgatcctggtgcgcgaaatcgtcaaggtgtacccggaggccgaaaacaacgaggcctccggcaaggagctggcgcgctggcagtcggcgcgggcgctgggcgagctggtcggggtgccgcgcgggcggatcggcatcggcctcaagctgaccaacggccgcaccgcccaggcgtgggcacgccgtcatcgccagctgcgcgccgcgctgaccccgctggtgcaggagcgggtggaaccgagccgcacggacgtgctggaccgcgaccccgacgacgacgccgggacggcgcaatgatcgccggctcccgcgcggtcgtcgaactcgtcctggccgtcgccgcgctggccgggtcggcggtgagctgggtgcgctcgcatcacagcgtggccgtcgcgcccatcgccgacgggcagccgttcaccacgtcggtggtgtacgacccgcagctgctgctgctcacactggtgttgttgacgagtgccggggtgttggccgtggtcgggatcacccggctgcggcgcgcccgttcggccgctacgacgtcttcttgaccagcggcaacgccatccggcggcggaccgcgatggcgtcggcccgatcccgcagcacctcgtgcaccgagcgcatgatcgggaagctggcgtcgtgaccggtgtcgtcgagcaccgcggtgaccgccgagctggcgaccagcgtccactccacctcggcggcgcgacaatcggcgtcgaaggcgtacagcagcgagatgccggcctcagcaaattgggtgacgtcggcgacgtcgagcaccaccgggttttcgccgagggtgaaccgccgaatgtggtggctgatccggtccacgttggcgtcgtcgatcacgccgcggatgtgcaccacggtcgccaggtgacggtgatgtgcccggacctgagcgccgtcgcagtcaaacacgcagttgtcgtggcgcgtctcggtacctgcgatcgtcatgaggacccctcactcgccgtggcgctcgcgctgccttcgaagggcgcctccacacccaccgaagctgcctcaaacgctaggccgcaagcctaaggagaccggtagccgcgtctaactctttgctaagaagccgctgagccgccgcgacggccccggcccagcgaaacccgagcaaacgccgcccggccaaaggcccgggtgaacgcggtgtggcacaccacaaccgtccacccatcggggcgattgcgctgctaggctgccatggctgccggttgccggtcgggggctggtgagacggccgccgcgcccgctcagccgggcggcacgagaacgcaacagcaggatccagacgggaaagagcaacgtgcggggcggagagatcaggggcgagatcaaagccctgacgggactccgtatcgtcgccgcgctgtgggtggtgctgtttcacttccggcccatgctcggcgatgcctcacccgatctgcgcgacgcgctggcaccggtgctcaattgcggcgcgcagggcgtcgacctgttcttcatcctcagcggattcgtgctgacgtacaactatctcgaccggatgggccggtccttctcgacgcgggccacgctgcatttcctgtggctgcggctggcgcgggtgtggccggtgtacctggtcacgttgcacctggccgcgctgtgggtgatcttcacgctgcacgtcgggcacgtgccgtcgccggacgccgcgtcgctgaccgcgatcagctacgtgcgccagatcctgttggtgcagttgtggtttgtgccgttcttcgacgattccagctgggacggcccggcctggtcgatcagcgccgaatggctggcctacgtgctgttcgccgggctggtgctggtgctgctgcggatgaagcaggcgacccgggcgcgcagcctgatggtgctggcgttcgcggcgtcgctgccgccggtggtgatgctgctggccagcggccacttctacacgccgtggagctggttgccgcgcatcgtcacccagttcaccgccggcgcgctggcgtgcgcggcggtgcgcaggttgcggctgaccgaccggggccgccggatcgcgggctacatctcgctgctgctgctggccgccatggtgggcgtgctgtattggtttggcgcacacccgatatcgggtgtggtggagaacgacagcgggggcgtcgtcgacgtgttgttcgtcccgctggtcatctcgctggccgtcggcctgggcagcctgccgcgggtgttgtcggcccgggcgatggtctacggcggcaagatctcgttctgcctgtacatggtgcacgagctggtgcacacctcgtggggatgggcggtcgagcagttcgagctggtgacccaggacaacccgtggaaatggaacgtcatcggcctgctcgcgatcgccctggccggcgcggtcgtcttgtatcacggcgtggaagagcccgcccgccggtggatgcgcaagatggtcgacgtgcgagccgtcagcgcgagaagcgaccccggcgaaccggccaacaccaagctgcatccgatcgaccgtccgctggaagcgatttcggcccgcgcggtgtgatggctgccttagcggccggccgcgacctactggcagtattcggtgagaacgcggcggcgcccggccatgccgttgacagtggaggtaggagtgagtcgtctggccacctttctcatcggggtgagtcttctgctgggcgtgggccttgtggcatacccggcgcagctgcgcacgtacgagacgctgacgctggacttccggctgaatcatgtggcagtgattggggattcgtacaccactgggaccaacgagggcggcctgggcgcccggtcgtggccgtcgcgcgcgtggcaggtgctcagcgcgcgcgggtcacgggtgtcggccgacgtggcggccgagggcagggccggttacgccgtgaccggcgaccacggcagcatcttcgaggatctgaccgcccgcgcggtgcagtccgatgacgcgctggtggtgttcttcggctcccgcaacgaccagggggtcgatcccgggctgctgatcgaaaagacgcacgccgctttggatctggcccgccggctggcgccggccgcgcgcctgctggtgatcggaccgccgtggccgaccgccgacgtgccgccgtcgatgtacctgatccgcgacatcctcggcggcgcggccggggcagccggggcgacgttcatcgacccgatcgccgaacactggttcgtcggccggcccgacctgatcggcgcggacggggtgcacccgaatgacgcggggcaccaatacatggcggacaagatcgcaccgctgatccgcacccagctgtcgacctgaccggggcttcagtcgtcggcgtgccgctcgtagtcccagcgttccagccgggcctgcagctgcagcaggccgattccggcgaagggtgcggcgacggccacacagaccagcagcagcggagacatgtcctacaacctccaataacccttcactgatctgacgttcgacggcgccgagcggttcatcgcactcacccctccgccagggcgcggtcggccagcgcgcccagcaccggcgccagcagccgcgcatactcggtcgtcacatggttgtcgtcgcggaacaccagggtgttgccgacgatcagcgggcaccggtcgggcgtgcagaacaaatcggacaaatcggcgtagtgaccgccgttgcccagcgtcgccgcctgctcggcggcgacgccgtcgccgtcgatcgccgcggatctggttggcgcacaagcggttacatcgtcgagatgagcggacaggcagaccggtgccgacgaatgcgggtcgggcgagggccccagcaccagcacggtcgcgccggtgccgcgcagctgcgccacggtgcggcccagggtgtcgatccaggccgggtcgtaggaggtgaaaccgaagtcggcgccgtagcgccggctcatgtccagcacgaccagccgcgggtgttcggcgttcatccgggccatgatctgggcgcgccactgctcgcattcggtgtactcgcggcccagatacgggctgacgatgtgcagctcggccagtgggcaggtcaccttcgccagggtttccagccgccagtgccgttgcccggccagctgctcgaaggccggattccacatggcggcgtgcgagtcgccgatcagggccacggtggtcggcgaggcggtgtcgccggtcgcgcactcgctctggccgacgtcgcgccatgaccgcacgcagccgttgacgaacaccgcggccttgttggcgggtgcctgggccagcggcgggtccaggttcgacgggacggcccgcacgccggcggcggccgcgaggatgacccgggcctgcgcgaaggcctgacgaaccgcggcctcctgcgcgctgatggcggggacgttggacgggggcgtcgcgatgatgttcgcgcggggagcggccacgccgtgccccaccggggcgggtatcacgttgagcagcaccaggcatgcgcacgcggtggcggcactcgcgccgcccgcgaccaccaggctgactttcgccgagcggcgcagcgcggcggcgaagcggccgggattctccaccagatgcagggtgagcacggccaatccggccgacaccgccgtcgcgctcagccgggccggcagccccgcgggctcgccgagcagcgcgggcatcagcaacagcaccggccagtgccacaggtaccaggaataggagatccggccgatcgcgcgcatcgccgggcggcacagcagtcggcccggcccgagcccgccggtgacggcgccgccaccgatgatcagcgcggtgcccagcaccggcagcagcgcctcggtgccgggatacggggtatgggcgttgagctgggtgcaggtcagcaggatcaacgccagaccgccccacctggcgatcgacgcggttcgcagcgacagccggcgccactgctggatcgacagggccaccaggccgccggccgccagctcccaggcgcgggtgggcagcgagaagaacgcccacgacggcgaggtgcgggtccacagcacgcccgcgaccaacgacgccgccccgatcagcgccagcaccaccgcgtacggcaccgggcgcggcgtcgcccgcagcggccggacacgccgcaccgacgccgcgacggcgatgatgagcagcggccacaccagatagaactgctcctccacccccagcgaccagtagtgctggaacggcgacggcgcgtcggcggtcaggtagtcggtgccgcgcagcgcgaaccggtagttgccgacgtacagggcgctggcgacgccgtcgaggaacacactgcgggcctgcagcggcggcagcaccgcggccgcgccgatggcggtgacggtgccgacgatggccgcggccggcagcaggcgacgggcccgtgcaccgtaaaaccggcccagcgcaacggtattggtggtggacgcttcccggaagagcaggccggtgatgaggaagccggagatgacgaagaagacgtccacgccgatgtagccgccgccgatcccgggaatgccggcgtggtagagcaccacggcgatcaccgcgacggcgcgcagtccctcgatgtcgggccggaatccccttcgggagccccgccgctccacgggctgtgggctgctggcgagcgattccggccggggtgtcatctgcgtgggctaggtcgccatccaggccagttcggcggggagttgactgcgccagaaggcgatatcgtgtccgccgagggagaagctgcccgccggtggtgtcttcaactggtagacgaattgctttgtggcgaaatagaagcggtcgaagttgccgcaatccacccgcagcggaatcgaattcagcgcgggcaggcccaacacgctgttctgcacgaagtcctcgttgctgtcgaacgccccgggcgcactggtggcgtacgaggtgtacagcgccgggctgatcgcgcagatgccggcggtgcgcgacgggcccagcttggcgcccaggcgaagcgccccgtagccgcccatcgaccaccccatgaacccgacccgggaggtgtcgaagcccatggtggacagcatcggcagcagctcgtcgagcaccatcgcacccgagtcctcgccggaagtccttttgtgccaataggtgttgccgccgtcgacacccaccaccgcgaacggcggcttgccggccttgaccagctgggccagcccgtcgggcacgcccatgtcgagcatctggttggcgtcgccgtccacgccgtgcagcgcgatcaccggacgcagcatcccggtctgccccggcgggatggcgatcacgtagttggtcttgatgccgccgcgggccgccgacacgaacgatccggtgagccgggtcggcagcgtcttgcccgccgtcggcggctcgaacggcgccggggcctgcggcagggtggcggcgcgcgcggtgcccggatccagcagggcgctgagcgcgaacacgccggcggcgccgaggctggcaccggcgcccatccggagcaccgcccggcgtgtgaggtcaggcatgatcgcaataatgccgcgcccggcgggcataacccgccgagccacgccgtattgcaagcattgtgtgatctggcgtgaccttgcggtcacgaaccggtgatcattcgccgcgccgcgggccgcgagcgacgctcgatttgcgcggtcggccgtagtcatcctagcgccccgcgcggtggccgccgtcactttccgcgggtccgcatgttccggcgcgcccaccgcgtgccgcgcggcaaaacgcgcagtcgcgcttgacttctggcgcggcggcggccgcctccggtcccgccgccgcaccggggccccggccgtcgtcgccgccgctggcgcgccccgatgccggcgctgatcgcggcggcgcgtggggatgcaatctcgaaggtttcaaccctggcccgccggcggcaccgcgaccaggatggaacccctgtgcacggggggcgaacgcgcaacgaagaggattgtgaattgagtctggcgtttcactggtttctgccgacctacggcgattcgcggaacctggtcgcgggcgggcacggcacgccgatgtccggtgaccggccggccacgctgcggtacctgcaccagatctgctcggccgccgaggacaacggcttcgaggccgtcctcacgccgacgggattgtggtgtgaggacgcgtggttgacgacggcgatgctggtcgaatcgaccgagacgctgaagtttctggtcgcgttccgtcccgggctgttgagcccgacgctggcctcgcagatggccggcaccttccagcggcactcgcagggacggctgctgctgaacgtggtcaccggcggcgaaccgcacgagcagcgcgcctacggcgacttcctggacaaggaggcgcggtacgcgcgcaccgccgaattcctgcacgtggtgcggcaactgtggacctcgccacagccggtcacctttgcgggagaacacatccgggtcgagggcgcgcaactgaacaacccgcccgacccgatacccgcggtgttcttcggcggctcctcggcgtcggccggaccggtggccgccaagcactccgacgtctatctcacctggggcgaaccgctgaccgcggtcgccaagaagctggactgggtccgcgggctggccgtcgacgcggggcgaatcctgcagtacggcttgcggattcacgtgatcagccgcgacacctcggacgcggcgtgggccgaggccgaccggctgctgtcggcgatcgacccggccgacatcgagcgggtgcaggccagcctggcgcgcagcgagtccgagggccagcgccggatgcgggagctgcacggcggcaacagcggcaaactgcttgtcggcccgaacctgtgggccggggtcggcctggtgcgcgggggagcgggcaccgccctggtcggctcgcacgccgaggtcgccgagcggctggccgaatacgccaaactgggcatcacccacttcatcctgtcggggtatccgcatctggaagaggcctactggttcggcgagggcgtgctgccgctgctggagcggatggggttgtggggcaccccaatcgtcggtcgcgtccggcggcgacgacgccgttcgcggtggcctcggcgcactgacggccatggcagccaccttgcccgcgccggcgcccgccgggctcgccgacggccatccggtcgacgaatccgccgagcagcagcgccgccgactgcgcatcgtggtggccgccagcctgctgggcaccaccgtcgagtggtacgacttcttcctgtacgccacggcggccgggctggtcttcaacaaggtgttcttcccgaacgaaagttctttggtgggaacgctattggcgttcgcgacgtttgccgtcggattcgtcatgcggcccatcgggggcctggtgttcggccacatcggcgatcggatcggccgcaagcgcagcctggcgctgaccatgctcatcatgggcggcgcgaccgcgctgatcggggtgttgccgacggccgcgcagatcggggcctgggcgccggtgctgctgctggtgttgcgggtgctgcaggggttcgcgctcggcggcgagtggggcggggcggtgctgctggccgtcgaacacagcccgggcgaccggcgcggccgctacggggcggtgccgcaggtcgggctggcactcggattggctttgggcacaggcatattcgctttcctgcagatcgtgctgggcccggcccggttcctgtcctacggctggcgcatcgggttcctgttgagcgtactgctggtggccatcggcatcgtggtgcggttgcgggtggaagagacaccggcgttccgggaactgcaggacctgcaggccgcgtccaccgtgccgatccgggacatcctgcgcgagcggcgttcccggcgtaacacggtgctggggctgctgtcacggtgggccgagggctcggcgttcaacacctggggcgtgttcgccatcagctacgccaccggggcgctgggactcaaccgggtctcggtgctgatcgcggtgaccatcgccgcattgctgatggcggtgctgctgccggtgtccggcgtcctgaccgaccgattcggtgcccgccgggtgtatctggccggcatcgcctgctacggcctggccgcgtttccggccttcgcgttgttcggcaccaagaagctgctgtggttcgggctggcgatggtcatcgtgttcggcgtcgtgcacgcgctgttctacggtgcccagggcaccctgtattccgcgctgtacccgaccaacacccgctacaccgggctgtcgttcgtctagcagttctccggcgtgtacgcctccggggtcaccccgatgatcctgaccgcgctgatcgccgcgctgggcggcgcgccgtggctggcgtgcggctacctggtggccaccgcggtcatcagcgtgctggcgaccgcgctgatccgcgatcgcgatctgtacctctagccgcgccaagcgcggccctcggctggcgctgccgatcccgatgtgctgtggttgatgctcatggcgggcacttcgcaactgcgccaagggctgtcgcagcggcaactgagcatgctcgctctgggcggggtgatcggcgccggcttgttcgtcgggtccggcgtggtgatcaaggacaccgggccggccgcgttcctcacctacgccctgtgcggcctgctcatcgtgctggtgatgcggatgctcggcgagatggcggccgcgaacccgtccaccggatcgttcgccgactacgcggctgcggcgctgggccgctgggccggattctcggtcgcctggctgtattggtacttctgggtgatcgtggtcggcttcgaggcggtcgccggcggcaaggtgctcaactactggttccacgccccgctgtgggtgctgtcgctgggcctgatgctgttgatgaccgcgaccaacctgttctcggtgtcgtcgttcggcgagttcgaattctggttcgccggaatcaaagtcgccaccatcgtcatcttcctggcggtgggcgcggcctatgtcgtcggattggtgccggggcatcacgacggcctgaccaacctggtgtcgcacggcgggttctttccccgcggggtgggcgcggtgttcgccgccatcgtggtggtgatcttctccatggtcggcgccgagatcgtcaccgtcgccgccgcggaaagccgcgacccgcggcgggcggtgcagaaggcgaccagatcggtcgtcacccggatcgggatcttcttcgtcggctcggtgtttctgctcgtggcgatcctgccgtgggactcggtggaactcggcgcctcgccgtatgtggccgcgctcaaacacctgggcctggcgggggccgatcaggtgatgaacgcggtcgtgctcaccgcggtgttgtcctgcctgaactccgggctgtacaccgcgtcacgcatgttgttcgtgctcgccgagcggggcgaggcacccgcccggttggtgcggctgagcgggcgcggcgttccccacatcgccatcctgtgatcctcggcggtcggcttcctgtgcgtcgtcatggcccgggtcgcacccaacaccgtgttcctgttcctgctcaactcctcgggcgccatcatcctgttcgtgtactggttgattgcgttgtcgcagatcgtccttcgccgccggacgccggccgagcggctgagcgtgaagatgtggttcttcccggtgctgtcggttctcaccctggccggcatcaccgcggtgctggtgcagatggccttcgacgccacggcgcgcagccagttgtggctcagcctgttgtcctgggcggtggtggtggcgctgtacttcgtggcgtgctcgcgcggccgggtcgccgcgcggtgaccgcgctcagccggtgtgcgcgccggcgcggtgccgtatacccgccccggcccgttctagcggagcccggtcagcgccaccgccgttcgatggacttgaccacggccgtcagcgtcgcattcaccggcgcgtcgacgccgacccgcgcgccctgccgcggcaccgcgccgttgatgacgtcgatctcgctgacccggcgggcctcgtgatccagcagcgccgagggtttcgcgtcgggcatctgcgccccgaacgcgcggacatgctcgaccgcgtcggcgacggcgatcgcgacaccggacgcgcgcgccaccgaccacgcctcggtggccgccgcccggctgaccggacccatctcggcgtcgtccatcacctggccgaccgtcatgccggtcagcgcgcacggcgcgctgtaggcgacgttgcagatcagcttctcccactgcatcgcggcgatgtcggtgaccgcgaccgcgtcgaacccggcgtgcgcccaggtccgggcgatcgattccaccctcgcgtgcggcagcgacgagtaggggccgaagcgcatcgcccgcatggcgttgtggtggacatggcccggcgccacccgggacgcgccgaacccgctggcgatcccgaccgcgacccgctgtgtaccgacgacgccggcgacggtctccgccgaccccaggccgttctggatggtcagcaccgcggtatccggccccagcatcggaagcgcttggcgcgcagcggcttccacgtcggccgccttgaccgccagcaccaccaggtccatcgtctcgtcgaccgcgccggtgctggcccgcagcggcaccacctggtcgcagccggggccggtgacgcgcagcccgtcccggttgatccgctccacgctgggccggtgccggtcgaccgccagcacctgctcgcccgcggcggccagcttggcggcgtagatcgaacccattgcgccgcaaccgattaccgcgatcttcatcggcgttctcccgtcagctcggcgatcagttcggccaggccgggtttctgctccaacccgaacccggcggcgtccggcggcgcgatcatgcccgacgagacgacgcagccgtccggatagccgccgaacggcgcgaacacccccgggtatgcctcgcagccacccagcccgagaccggccgcgacgtgcaggttgatcagatgcccgccgtgcgggaacgcgcagccgcggtcgaaaccatgatccgccagcacgtcgagcatccgcaggtactcggacaacccgtagctcaggcccggatccatctggaacacatcgtgatcgggccgcatgccgccgtagcggaccaggttggtcacgtcgggcaccgaaaacaggttctcgccggtggccaccgggccgtcatagcagtccgttaccgcgcggtgcagcgcgtaatccagcgggtcgcccggctcctcgaaccagcgcaggccgtagccggccagcgcgcccgcccaccggatggcctcggcccggccgaacctgccgttcgcgtcgaccgcgacccgtccggcgtcgccgacgacgtcgatgacggcctcaacccgggccaggtcctcgcccagcgcggcgccgccgatcttcatcttgaccgcccgatagcccagctcgagatactcgcccatttcccggcgcaacgcatcgacgccgcccgccgggtggtagtagccgccggcggcgtacaccggcaccgccggcgcgggctgccgcccggcgtgccgggcgatggtcacccaggcgggttcgtcgcgcagcttggcgttcagatcccagcacgccagctccagcgcggccaccgccgccgcccggtcgccgtggccgccgggtttctcgtcggtgagcgcgcacgccgccaccgcggccgggtcgaggaacccggagccgtccagcagcgcgtcgggggcggcggccagcacccgcgggatcagccggtcgcgcaggattccgctctgggcgaaccgcccgatcgagtcgaacgccacgcccgccaccggccgcccgcgccgcaccgcgtcggtgagcaccgccaccagcgagaccgtgtggccggagaagtcgaccaccgcattggccggcccgccgcggccgggcgcgtcgagacgaaccgcccgctcgacgatcccggtgatccgcaccaacgggggttcagggcgtccgggtgagcaacaccgcctgctcgaacggcagccgggcgaacacgccgcgcaccccgggccgcaggtgcgacgccgcctcggccttgctgaccacgcgcggatcggcgacgccgaacgtcttgccccggctgcgaatccggccgccgcccgccgcggtcaggttcttcagccagtcccggtccgggccgtaggtcagcaggatggccaccccgggcttgccgtcgacgtcggcgctgaacaggttgacgggggtgcggtacggcttgcccgaacgccgtcccacgtgctccacgatgccgaacggcgggagccaaccggcccacatccgctgaatcgggttggtgacgtgacggttgaaccgggcaagcccttgtgggagttgcataccgccatccaactcgcaggcgccgggcgacatcaacccgatcttttccccgccgcagcgactaaggtcaggtgatgggcgacacaccgggaaacgcggcgggccgtcgcagctcggagctgtcgcgccggggccgggacctggccgccgggaaggtcatcaccgcggccgacgtgcagtgcgccgctgagcgcgccgagacgtcccgtcagcgtgacctggatgcgcaccgccgcgacgagcaccgccactatcaggcggccatcgcccacgagcgggccgccgaggttgaggacagggccgtcgccgagggcctcggcgacgtcgccgcgcaccaacgggccgcggaccgggaacgcgaggccgcccggcgcaacttcatggcggcccagcaagccaactcctacgacgccgactagcacccttctgctacaccctgtagttggaggggtggcgaaggctgggacactggtcgtcatgggaagcagtgatcaggcgaccgcgcacgccagggcccaggctgcctcggcgcggttgttcgacgacgcctgcgccgtcatccccggcggggtgaactcgcccgtgcgggcgttcaccgcggtgggcgggacgccgccgttcatcaccgccgcgcgcggctgccggctgaccgacgccgacggcaaccactacgtggacctggtgtgctcgtgggggccgatgatcctggggcacgcgcacccggccgtcgtcgaggccgtcgccaaggccgccgcgtccgggctgtccttcggggcgcccaccccggcggaaagcgagctggccgccgagatgatcgcccgggtggcgccggtcgagcggatccggctggtcaactccggcaccgaggccaccatgagcgcggtgcggttggcccgcggcttcaccgggcgcgccaagatcgtcaagttctccggctgctaccacggccacgtggacgcgctgctcgccgacgccggctccggggtggccaccctggggctgccgtcctcgccgggcgtcaccggcgcgacggccgccgacacgatcgtgttgccctacaacgacatcgacgccgtgcggcaggcgttcacggagttcggcgaccagatcgcggcggtgatcaccgaggccagccccggcaacatgggggtggtgccgccggcgcccggcttcaacgcggcgctgcgcgcgctcaccgccgaccacggcgcgctgctgatcgtcgacgaggtgatgacgggcttccgggtcagccgaagtggttggtacggaatcgatccggtggacgccgacctgttcaccttcggcaaggtgatgagcggcggcctgccggcagccgcgttcggcggccgggccgaggtgatggaacggctggcgccgctgggcccggtgtatcaggccggcaccctgtcgggaaacccggtcgcgatggccgccgggctggccacgctgcgccacgccgacgccgccgcctacgccgcgctggacgccaacgccgatcggctggcccggctgctgtccgacgcgttgaccaatgccggtgtgccgcaccagattccgcgggccggcaacatgctcagcgtgttcttcaccgacaccccggtgaccgacttcgcctccgcgcgggccacccagacctggcgctatccgccgttcttccacgcgctgctggacgccggcgtctacccgccgtgcagcgccttcgagacgtggttcgtctccaccgcgctggacgacgacgccttcgaccggatcgcggcggccctgcccgccgcggcccgcgccgccgcgggcgccgacgaggggaattcctgatgggcgagcagacccgggtgcacgtggtgcggcacggcgaggtgcacaaccccgacggcgtgctgtacgggcggctgcccgggtttcacctgtccgaggcgggccgggcccaggcggccgcggtggccgaggcgctggcgccgcgcgacatcgtcgcggtgatcgcctcacccctgcaacgggcccaggagaccgccgcgcccatcgccgcgcggcacggcctggccgtggacaccgacccggacctgatcgaatcggccaacttcttcgagggccggcgcatcagccccggcgacggcgcctggcgcgacccgagggtgtggtggcagctgcgcaacccgttccggccgtcctggggtgagccctacaccgagatcgcggcccggatggagacggcggtggacaaggcccgcgcccgcggcaccggccacgaggtggtgtgcgtcagccaccagctgccggtgtggacgctgcggctgcacctgaccggccggcggctgtggcacgacccgcgcaagcgggaatgcgggctgtgctcgatcaccaccctggtctacgacggcgaccggctggtcgacgtcgagtactcggagccggcggcgccttgagcgcgcgggtgctggcgatggccggggcggtgctggccgggttgctgaccggctgctcgtccggtcacgatgccgtcgcccagggcggcaccttcgaattcgtctcgcccggcggcaagaccgacatctactacgacccgccgtccagccgcggccgccccggcccgctgtccggcccggacctggccgaccccgcgcacacgctgtcgctggacgacccgatcttcgccggccgggtggtcgtcatcaacatctgggggcagtggtgcggaccgtgccggtccgaggtcagccagctgcagcaggtgtatgacgccacccgcggcgccggcgcgtccttcctgggcatcgacgtccgggacaacaaccggcaggcggcgctggacttcgtcaacgaccgtcacgtcacgttcccgtccatttacgacccggcgatgcgcaccctgatcgcgttcggcggcaagtaccccaccacggtgatcccgtccacgctggtgctggatcgccagcaccgggtcgcggcggtctttctgcgcgaactgctggcaaccgacctgcagccggtggtgcagcgggtggcccagcagtgaccgggctgacccagatcgccgccgccggcccgctgctggcggccctcggcgtgtgcctgctggcgggcttggtgtcgttcgcctccccgtgcgtggtgccgttggtgcccggctacctgtcctacctggctgccctggtcggggtggaagagcagccgcaggccggcgcggtgcaggccccgccgggcgcccgctggcgggtggccggctcggccgcgctgttcgtcgccgggttcaccgcggtgttcgtgctgggcaccgtcgccgtgctgggcatgaccaccacgctgatcaccaaccagctgctgctgcagcgggccggcggtgtgctgaccatcgtgatggggctggtgttcgtcggcctgatcccggccctgcagcggcaggcccggttcagcccgcggcagctgaccaccgtcgccggggcgccgctgctgggcgcggtgttcgcgctgggctggacgccgtgcctggggccgacgctggccggcgtgatcaccgtcgcctcggccaccgacggcgccagcgtggcgcgcggcatcgtgctggtgatcgcctactgcctgggcctgggcatcccgttcgtgctgctggccttcggctcggcgggcgcggtggccggcctgggctggctgcgccggcacacccgggcgatccagatcttcggcggcgtgctgctgatcaccgtcggcgccctgctggtaaccgggctgtggaacgacttcgtctcctggctgcgcgacgcgttcgtgtccgacgtgaggctgccgatttgatggcgctcgccacccttcgcgccacggcccgcaacacctggcgggcgctgacctcgatgggcaccgcgctggtgctgctgttcctgctcgcgctgggcgccatccccggcgccctgctgccgcagcgcaacctcaacgccggcaaggtcgacgactacctgaaggcccacccggtgatcgggccctggctggaccggctgcaggcgttcaacgtgttctccagcttctggttcaccgccatctacgtgctgctgttcgtgtcgctggtcggctgcctcaccccgcggatgatcgagcacgtccgcagcctgcgcgccaccccggtggccgccccgcgcaacctggcccggctgcccaagtacgccggccaccgcatcgccgccgacgccgaagacctgaacaccctggccaacacccttgtcggccggctgcgcggctggcgcaccgccatccgccaccacgacggcgccggccccgacgccgtggaggtctccgccgagaagggctacctgcgcgaattcggcaacatcgtgttccacttttcgctgctgggcctgctggtcgcggtggccgtcggcaagctgttcggctacgagggcaacgtcatcgtcatcgccgacggcggccccggcttctgctcggcctcgccggccgcgttcgactcgttccgggccggcaacaccgtcgacggcacctcgctgcacccgctgtgcatccgggtcgacgacttcgacgcccactacctgccgtccggccaggccgtctcgttcgccgcgaacatcgactaccagtccggcgccgacctggccgccaacacctggcggcactaccggctgcaggtcaaccacccgctgcggctcggcggcgaccgggtctacctgcagggccacggctacgcacccaccttcagcgtcaccttcccggacgggcagatccgcaccgcgaccgtgcagtggcgccccgacaacccgcaaaccctgctgtcgtcgggggtggtgcgcatcgacccgcccgcgggcagctatcccaccgccgcggagcgccgccagcacgagatcgccatccagggcctgctggcgcccaccgagcagctggacggcacgctgttgtcgtcgcggttcccggcgctcaacgcgcccgccgtggccgtcgacatctaccgcggcgacaccgggctggacaccgggcggccgcagtcgctgttcaccctggatccccggctgatcgagcagcaccggctgacccgggagaagcgggtcaacctgcgcgccgggcaggcggtccgcatcgaccaggggcccgcggcgggcaccgtgatccgcttcgacggcgccgtgccgttcgtcaacctgcaggtctcccacgacccgggccagacctgggtgctggtgttcgccgtcacgatgatggccggcctgctggtgtcgctgctggtgcgccgccgccgggtgtgggtccgtctgacaccggacgccggcggcgcgcccggtacggtgaacgtcgaactgggcggcctggcgcgcaccgacaactccggttggggggacgagttcgagcggctgtcgcagcggctgctggacggactggccgagcccgcgtcccgagcgtcccaaaggagtaccgaggtggacgtcaaatgaataccgtgcacgtcaacatcgagctggcgcgctactccgactgggcgttcacgtcggcggtggtggcgctggtgatcgcgctgctgctgctggccttcgagctcgcctacgccggcggacgccgcgccgatgcgcgggcccgggtgctggccggggcggtcagcgccgactcggcgacacctggggtggtggacgaggtggcccgccggcccgtcgatgagcgcgccggccgcgccggcctggccgtggtgtacctgggcaccggcctgctgctggcctgcctggtgctgcgcggcctggccaccctgcgggtgccgtggggcaacatgtacgagttcatcaacctgacctgcctgtgcgggttggtcgccggggcgatcgtgttgcgccgcccgcagtaccgcccgctgtgggtgttcctgctgctgccggtgctgattctgctcacggtgtccgggcgctggctctacaccaacgccgcgccggtgatgcccgcgctgcagtcctactggctgcccatccacgtgtcggtggtcagcctgggctccggggtgttcctggtcgccggcatcgccagcatcctgttcctgctgcgcacctcgccgctgggcgaccccggcaacgacagcgcgccggcccggctggtgcggcggttcccggacgcgcagaccctggaccgcatcgcctaccggaccaccatcttcgcgttcccggtgttcggcttcggcgtcatcttcggcgccatctgggccgaagaagcctggggccggtactggggctgggaccccaaggagacggtgtccttcgtcgcctgggtgatctacgccgcctacctgcatgccaggtcgacggccggatggcgggaccgcaaggccgcctggatcaacgtcgcggggttcgtggccatggtcttcaatttgttcttcgttaacctggtcaccgtgggtctgcattcctatgcgggcgtgggttgacattggataaccgaggtaactagcgcacaacaagggggagtgccgtgtccgagcatccgacggcgggcgtgggggcgcccgaagaacagacaacgcaaatccccccagccgccgcagcgggcgacgagaagaaggacgccgccgaaccgcagccggagcccggcggcgacgccccgaccaaggcgttcgccgggttccgcaccgaacgccgggtccccgccccggagcgggagccggcgccacccaccgcgccgcggcccggcggcatgccgccgtgggactccaccccggtcaccggcatcccgcgcgtcgacccgacggcgtacggcgcctactacgccggcccggacgccccgccgacccagatccagggcccgccgccgcgtcaggagcacctgccgcacacgccgtacccggagctgtccaccgggatgctgctgcgcccggtgcagccgccgccgtccgagggctggcggctgctgctctacaagctgtccggcgggctgatcaacctgggcgaaagcccccgcgccgcccggtacaacaacctggtcgcccaggtgaaccggccgctgcggggttcctaccgggtggccttcctgtcgctcaagggtggagtcggcaagaccaccatcgcggcgacgctgggcgccaccttcgcctccatccgcggggaccgggtggtggcggtggacgccaaccccgaccgcggcacgctgagccagaagatcccgctggagacggcggcgacggtgcgccagctgctgcacgacgccggaaccatcgagcgctacagcgacgtgcgccgctacacctccaagggccccagcgggctggaggtgctcgcctcggagaccgatcccgcggtctcggaggcgttcagcgccgacgactacgtgcggatcctggacatcctggagcgcttctacggcctggtgctcaccgactgcggtcccggactgctgcactcggtgatgaagtcggtgctggagaaggccgatgccctggtggtggtcagctcggcgtccatcgacggcgcgcgcagcgcgtcggccaccctggactggctggacgcgcacgggcacgaggacctggtccgcaattcgatcgcggtgatcaacggggtgcggccgcggccgggcaaggtcgacatgaacaaggtgatcgaccacttctcccggcgctgccgggcggtccagctggtgcccttcgacccgcatctggaggagggcgccgagatcgacctggaccggctgcgccgcggcacccgcgaggcgctcacggagctggccgccatcgtcgccgacggattccccggcgcgcagcgcaacccgggcgtgctcggttaaccggtgcagcggggtctaaatagtcctacaaggtctaaaagggattgttgtcgccgtggcccaaccgccgcaggaaatccggatcgtcgtcgggcccgatgacgcgggtcttgggccgggcggcctgcgaccgcgccgcacgccagccgacgtagatcagcgtccccaaaatcaggacgagcagcaggtagaccacgcaaaacctcctcgggacctccatcgcgaatataccggcgccgtaggctttggctgtgtcacaacaaggtagcgacggatccaccccgggcccgggcggcgccgtcgtcccggtcctggcctacgcggcggcgcggctgctgctggcggtcgtgctcaccggcgtgatctacggcgtcgcgcggctggccggcatcaccgagttccccgtcgtggtggccgcgctgttcgcgctggtcatcgccatgccgctgggcatctgggtgttcgggccgctgcgccggcgcgcgaccgccgcgctggccgtcgccggcgaacggcggcgccgggagcgcgagttgctgcaggcccggctgcacggggacgtgccccccgaacggtgacggctcagcccggcggcagccgcaccacctgcgcggtatagctcaaccccgcgccgtagccgatcagcagcgccaggtcgccggccttggccgccccggtggccagcacctcggccatggccagcggtatcgacgccgccgaggtgttgccggtgtgctcgatgtcgttggcgatcaccgcgtccggccgcagctcgaggctcttggccaggatctcgttgatccggctgttggcctggtgcggcaggaacacgtcgatctcgtcgggccgcacccccgccgcgtccatcgcctgctggccgaccttgcccatctcgaatgcggcccaacggaataccgcgctgccctccagccgcaggaacgggcgcggcccggtgggccggtccaggtagtccatccagtcgatgtcctggcgaatcgcggtggcctgggtgccgtcgctgccccacaccgtcggcccgatcccctggggtgggcgtttnngcccaccaccacgcccgcggcgccgtcggcgaagatgaagcagttgctgcggtcggtcatgtcgaccgtgggcgacagcttctccgaccccagcaccagcaccttgccggccgtgccgccgcgcaccatgtcggccgccacccccagcgcgtagccgaagccggcgcagccggccgagatgtcgaaggcgggcactccggtggcgcccagcgcggccgcgaccgccgggccgcacgccggggtctgcaggaaatgggtgctggtggccaccacgacgcagtcgatgtctgacgcctccaggccggccttggcgatcgcctcacgtccggcctcggtcgccatcgaggccgtggactcgtcgcgcgcggcgaatcggcgtgtcttgatgccggtgcgcgaatagatccactcatcggaggagtcgatgttctggcacagctcgtcgttggtcaccacgcgctgcggccggtacgacccgacgctgagcaagccgatgttggtgggcccgctggtcgcggcaatctgcttcattgcggtccttcgctatcccccgagcagacgcaaaagtaccccaaaagcgcggtgcgcgggcgcctttgcgtctggtcgcactgtcaggtaccccacgtcaacgccgccgccaccgcgaccgcccacaccaccatcgccaggccggtgtcgcgcagcaccgggatcagctcggcgccgccgcgcccggaccgcaccggggtcgccgcgcgcagcgccagcggcgtggccaccaatcccgcggcgcaccacggcgtggccgccacgagcaccagggtcaacgcggcggcggcggaaagcagcgcctggtacagcacccgggtgcgggcgtcgcccagccgcaccgccagggtgatcttgcccgaccgggcgtcggtgggaatgtcgcgcaggttgttggccaccagcaccgacgacgacagcgccccgaccgccaccgccagcaccaggcccacccagtccacccgcagcgcctgggtgtactcggtgcccagcacggcgaccaggccgaagaacacgaacaccgcgacctcgccaaaaccggtgtagccgtagggtttcgacccgccggtgtacagccacgccccggcgatgcacgccgcccccaccgcgatcagccacggcgcgctggacagtgccaggaccagcccggcgatcgccccgacggtcaggctcacgatcgcggcgcccagcaccgcgcgcggcgccgccagccgcgagccgaccagccgcaccgggccggcgcggtcgtcgtcggtgccgcggatgccgtcggagtagtcgttggcgtagttgacgccgaccgtcatcgcgaccgccacgaccaacgccagcagcgccttccaccacaccgcggcgtgcagccacgccgccgcgccggtgccggcgaccaccggcgccagcgcgttgggcaacgtgcgcggccgcgcaccggagatccactgcccgagattggccacaccgacatcctgccaggatgcgcggccgggccctgcgatcagcccgcgctcatgcaccacaatggtcggatgctcggagtcatcggcggcagcggcttctacaccttcttcggatccgacgccgacgacgtcaccgtggataccccgtacgggccgcccagcgccccggtcaccgtcggcgccgtcggcgggcaccgggtggccttcctgccccggcacgaattctccgcgcacaccgtgccgtaccgggccaacctgtgggcgctgcgcaaactcggtgtgcgccgggtgctggcgccgtgcgcggtcggcagcctggtgcccgagctcggcccgggcgccgtcgtggtgcccgaccagctggtcgaccgcacccgcgggcgcgccgacacctatttcgactccggggccgtgcacgtcgacttcgccgacccgtactgcccggcgctgcgcgaggcggtgaccgggctgccgggggtggtcgatggcggcaccatggtggtgatccaggggccgcggttttccacccgcgccgagagccggtggttcgcctcggccgggttctcgctggtgaacatgaccggctacccggaggcggtgctcgcccgggagcttgaaatatgttatgcggcaatcgctttggtcacagatctggatgccggtgtgagcgccggtgagggagtgaaggcggttgaggtgttcgccgagttcgagaagaacatcgagccgttcaagaagctggtgcgcgacgccatcggccgggtcgccgccgagcgcagctgtacgcagtgctcaccgcacaccggggtgagcctgccgatcgagctgccatgagggtgctggtgacgggggcggccgggttcatcggctcgcgggtggccgccgcgctgcgggcggcgggccacgacgtcgtcgccgtcgacgcgttactggccgccgcgcacggaccgaacccgctgccgcccaacgggtgtcaccgcgtcgacgtgcgcgacgccgacgcgctggccccgctgctggccggggtggacgtggtgtgccaccaggcggcgatggtgggggcgggggtcgacgccgccgacgccccggcctacggcggccacaacgacctggccaccacggtgctgctggcccagatgttcgccgccggggtgcgccggctggtgctggcctcgtcgatggtcgtgtacgggcagggcggttaccgctgcgagcggcacgggccggtgcaccccgctgccgcggcggcgtgcggacctggacgccggggtcttcgagcaccggtgcccgatcggcggtgaggagctgcgctggcagctggtcgacgaggacgcctgcctgcggcctcgcagcctgtacgccgccagcaagaccgcccaggagcattacgcgctggcctggtcggaggccaccggcgggtcggtggtggcgctgcgctaccacaacgtgtacggccccggcatgccgcgcgacaccccgtactccggggtggcggcgatcttccgctcggcgctggaaaagggtgagccgccaagggttttcgaggacggcgggcagatgcgcgacttcgtccacgtcgacgacgtggccgccgccaacctcgcggcgctggcttgccgcgacggcttcaccgcggtgaatgtctgctcggggcaacccatttcgatcttgcaggtggcgaccgcgctgtgcgacgcccgcggcggcgcggtcgcgccggtggtcaccggccagtaccgcagcggcgacgtccgccacatcgtcgccgacccgtcgcgggccgcgcggctgctggggtttcgcgccgccgtccaacccggcgacgggctgcgcgaattcgcgttcgcgccgctgcggtgacggctactgctgcggcggcctgtagatctggggcttgggcaccgggatctgccgcgtcccggagtcgtcgccgcggaagatccggggcgacccggcgagcggggggatctcggtggtgggcggctcgtggtccgcgccggggccgccggtggcgatccgggtggtcgccgcggccgacggcgcggcgccctggctcaccgggatacgcgtcgtcggcgccgccgcgttcgcctgcgccgcgcgccggcgggcggagcgacgggcccggcgccgacggcccagctgcccggccaccacggcggccaccagaatgcccagggccagcccgcacagcgtcacgtcgaacacgctggtgatctgctgggccaggttgttgccgtaaaccgggtggtgcacaggcgaattgggggtatcggcgaaccgcggcgccagctgcacgccgaccaccacgcgggcgacggcgagcgcggcgaccagcccgcacagcgaggtgaccagtcgcgcggccaggttggccagccggcgccgtagccagatcgccagcaccgcggtcaccaagtcgaaggcggccagcaccaggctgtcgtaccgggagaacggatagttcagcgtcaccgcgacggccaggtcggtgatccgcatcgccatcgaccccaacgcccacaccgcgatcagcagcaggccgctgcgggccgtggcccgccacgcggattcctcggtgtgcgaaggggttcggcgttcgaacaggctgcggggggcgaacagcgccgcgccggcggcccaggccaggtagccctcgaagcccaccccggccgtcgaggtgttctgcgcgatgccgtggaaggcgtcgaggtcccgcccggcgggcaacagccacaccaggattccggcgcccagcgtggacgtgcccagcgcgatcgtcgtcagccggctcgcccggtcggagcgcagcagccaccgggaggcgaccagcaccgcgaccagcgccaccacgccgtacaccaccgcggtcgcgatgaccgcgatgttctccttgccgaattgcgctgcgccgccggaactctgcagcgcgtagcgcacccgccagtacaggttgaaaccgaagctgagcaccgccgcgagcatcgacagcgcgccgatgatccgcgcggcccgatgccaaccggtggcctcgtcgccgcccggggtgcccggcaccggcgcggccgccgtgccggccggcaccgcctgggcgctcagcagcgcgccggcgatgcccacccaggcgcccggccccaccccgcccggcacgtcgaccgtgccgccgaaacggaccgtctggacggcgtcgaacccgacgaaggcgagcaccaaaagcaggtaggggacgttgagcgccaaccgaagccgggccgcccgggccgggtcgaaccgggcgccgcccgcccgccaggaaccggccaccgcgagcgcggccagcgccagcgccgtcaccgcgaccaggaccgtgaacacgatcgggttgctgtccgggatgccgacgccgaagtagaggttccacggcagcaacaccgcggcgagcagcagcgccaccgcggtcaggtcggcggcgacgcgccggccggtggtcgccgggccgggcggcggcgtggcgccggtggcgtgcgaccggatgatgcggcgcgccgccggttgccggggctggccggcgatggggccggtcggggtgtcgtcgctgctctggctcaccatgccccccggaattcaaggacgactgctgtcggcgcggtttcgggtgttcggtccgaaagtacccggccgaaccccgtgcactgctcgcttgcgaacatattctccgttcgggtgccctggcagtggcgggcgaccggcagcgcagcggaggtgattccgcggcgaccgtccggtccttcaaaaagctggttacgctgcgctagtaggcgaagcttgtcgcccgaatgactgatactgccaacggtatcgcaagtgtagtgctgccgggacatgctggttgcggggtcgccggggtgaaggagaaccgggatggacgtggttttgggggttgcggtcaccggccccgtcgcccgcttggcgctggtcggctcgcggggcaccgacgtgatcgaccagtccgtcgtcgacctggccgacaacccgatcgagaccctcaccgagacggtggtcggcaccaatcggctgctggccggcgagaaccaccggctggtcggcacccggctgtgctggaccgatcacccgcgggccgaccaattgcgcagggcgctgggggattccggggtgcacaacgtcgcggtgctctccgagtcgcaggcggtggccgcgctgatgcgtgcggccggccagcccggtgccgcgctggtgatggacgacgcgacgggcaccctgtcgatggtgagcccggccgccggcgacccggacgcgccgccgaccctgctggcccgccagccgctgggcggcgccgtgggcggcgatgtgaccgccgcgctgcagacgatgatggcgaacctgagcgcccacccggacgcgcccggggaggtgtatctggtgggcgcctcgcccgacctggaccgggtcgccgaacagctgcgcgacgcgtcgaccatgcgggtgcaggtcgccgacgatcccaccttcgcgctcgcccggggcgcggcgatcgccgccgcgcccgcccttgccgccggggacgcgaccgcgatggcgcccgcggtcggggtgaccggggacgcgacggccatggcgccggccgcgggggacgcgacggccatggcgcccgccgcggggctgaccggcgacgagacgacggtggtgccggcaccggagctcgccgaaccgcaggaccggcagctggcctactcgatggccgacgacgccggcatctatccgggcgaaatggacgagtacgacccggaattcgacgactacgacgccgactatgacgacggcgaagaggccgccccggccaagctgtcgcggcggtcgttggtgatcggcaacgccgtcatcgccttcgccgtcatcgggttggcgtcgctggccaccgcgatcgccgtcgccgtcgagcccaccgccagccggcagccggtggtgggggtgcagaacggcaccccgggcaagttcatgccgatcctgcccagccagcaacaggcgccgctgccgccgcccccggccgacgcgcccaatgccgggttccagggcggcgtcgtccaggccccgagcaacgccccggccccgcagccggcggttcccgcgccggccaaccccgcgcccgaggcgccgagcaaccccggcgtcgtccccaatcccaaccccggttgggcgcccaacccgaatccccttgtgcccgttcccatcccgatccccgttccgatcccgggatggaacccgccctacaacccgccgtacaccccgccctacaacccgacgacgccctacacaccgccgaccaccacgtacgagccgccgacgaccacctaccagcccccgacgaccacctaccaacccccgaccaccacctaccaaccgccgaccacgacctaccagccgcccaccaccacgcacgaaccacccaccacgacgtaccagccgccgagcacccgggcgaccaccgaggcgccgctgccgacgcacacccagcagaccgtgccgcccacgcattcgcagccgctgttcccgcaggagccccacacccaccgcgggttctgacccgtgcccggcaccgacggtcgggtcacggtggtcctgccctgcctcaacgaagaggagtcgctgccgggggtgctggccaccatcccgcccggctaccgggcattggtggtcgacaacaacagcaccgacgacaccgccggcgtcgcgcggcggcacggcgcccaagtggtcaccgagacccgggccggatacggggcggccgtgcacgcgggcgtgctggcggcgacgacgcccatcgtggccgtcctcgacgccgacggctcgatggacggcgccgacctgccccggctggtcgccgccttggaggcgggcgccgacctggtcaccggccggcgccggccggtgcccgggctgcgctggccgtgggtggcccgggtgggcaccgtggtgatgagctggcggctgcgcacccggcacgggctgccggtgcacgacatcgcgcccatgcgggtggcccgccgcgacgcgctgctggggctcggcgtggccgaccggcgttcgggctacccgctggaactgctggtgcgcgccgcggccgccggctggcgcgtggtcgaactcgacgtccgctacggcccccgcaccggcggcaagtcgaaggtcagcggttcgctgcggggcagcatcaccgcgatcctcgacttctggaaggtgatttcgtgatcccggtgaccctgctggtggtggccaaggcccccgagccgggccgggccaagacgcggctcgcggcggcggtgggggagcgggccgccgccgagatcgccgccgccgccctgctggacacgctggacgccgtggccgccgcgccggtggcggcccgggtggtggcgctgaccggcgacctggacggcgccgcgcgcggcgccgagatcagggcgcggctggcgtcgttcacggtgatcgcccagcgcggcaacgacttcggcgcccggctggccaacgcgcacgccgacgccgcggacgggttgccggtgctgcagatcgggatggacaccccgcaggtgaccgccgagctgttggccggctgtgcgcgccggctgctggacgcgccggccgtgctgggcctggcccgcgacggcggctggtgggtgctcggcgtggccgcgccggtgctggccgactgcctgcgcgccgtgccgatgtcggccgccgacaccggcgagctgaccctcaaagcgttgcgcgacaacggaatcgaggtcgccacggtgcagacgctggtcgacgtcgacgtcgttggcgatgtcgcggtggtgcgcgacgcctgcccgcccgccagccggttcgcccgggccacccgggcggccggcctgtaagtacggcgctaccagtgcgtgaggatgatcgtgttgaccgccagggcgccgacggcgttgagcgccaaccagattcgatgcgtccgcaccggcagcagcgcggcggccgcggtgagccagatggtgaacggcagccagatgcgttccacctcggccttgctgagcatgctcaggtccgcgcaggcgatggcggccagcaccgccagcagcagcaacgggaaaccgctgcgccggcggatcgcggcccggtcgaacacccggccgaccccggcgacgccgcccaaaccgatcgcgcacaccacgcaggccaggttggcccagctccagtattggaacggccggtctttggcgatgccctgccaatagcgttgctgcacaagggtatagccgtcgaaccagtagaacccggcgacggcgaaggcgaccgccaccgcgatcgcgcccagcgccgcggggcccagcgcccgcagcaccgcacgccactgcgtccggccgtcgcggggtagccggggggccgcggcaagcaccgccgccgccggcagtcccatcagcatcaggccgtagttgcagaacaccccccagcccagcagcagcccggcgccggcggcggtcagcgccgggaaccgcaccggacggtgcaccgccacggccagcagcgcgatgccccacgccgccaccccggcgaagtacccatcggccgagaccgccacccagatggcggtgggcgccagcgcgacgaacggggcggcccgccgcgcggtcggctcgtcggccagcgcccgcaccccgatcagcaccgcggcggccgcgctggatccggccagtaggcacagcaacccggcccagccgccgccgtgcagccccagccggtccagccagacgaaggtcagcagcgcgcccggcggatgcccggacacgtgcgtggtccacgagtgcggctggtagtcgacgatccggctggaaaacgtgcgcaccgccgccgcgatgtcgtggatccccggcacctcccacaggtattcgtcccgggtggtcagccggccggcgaagccgcgctgccagccgtcgatcatcgccagcgcgaacgcccagccggccgcgacggcccagctgcccagcgtcaacgcccaccacgaaagccgttgcgccagaacgggtccccaggccacgaccgcggccgcgagggcgacggccgggccggttccccagccggcgtggatcagccactcaccgaagatcggcgcggccccggcgtgggtggcgaatcgctccgggccgacgtccagccgctgccgcaccccgaggttcagccgcggcagcaggaacgccgccgccaccaacgccgccccgaccgcggccgccaccgcgtcccgccgagcgattctcacggagcaacagcctattgttcgccgcccccggcgaatcggcgcaccaacgccgcccggtccaccttgccgatgccccggcgcggcagcgcggcgacaacgtgtacctcgcgcggcgcggcggtggcgtccagggtgcggctcaggtgggcgcgcagcgcgtccgggctcggcgccgcgcggccgtcgcgcagcacgatcgcggcgaccacccgctgccccagccggtcgtcgggcagcccgaacaccgcgcagtcggccaccgcgggatgcgtgcacagcgccgcctcgacgggttgcggcagcacggtcagcccgccggtgctgatcgcgtcgtcggcgcggccgaacacggtgagcacgccgtcgtcgtcgacggcgcccagatcgtcggtgaggaaccagcccggctcggcgaacggatcgggatcgaccggattgcggtagcccttggccaacgtcgcgccgcccagcgcgatgcgcccgtcgctcacccgcactcgcaccccgtccagcgggacgccgtcgtacacgcacccgccggcggtctcgctcatcccgtagctgcgcaccaccgtgatgcccgcggcggcggccgcctgcagcaccggccgcggcgcgggcccgccccccagcagcacggcgtccagttcggccagcgcggccgtggccgccgggtcacccagcgccttggccagctgcacggccaccagcgacgcgtaccggcggccggtgcccaatgcccttgtcgcagcgggcaattgggtgacatcgaagcctcgggagacgtcgagttcgacgggcgtcgagccggccagcaggctgcgcaccagcacctgcaccccggcgatgtggtgtgccggcagggccagcagccagctgcccggcccgcccagacgctcgtgcgtggccgtcgcgctcgccctcagcgcggcggcggtcagcatcgcacccttgggagcaccggtggtgcccgacgtcgccgccaccagggccacgtcgtcatcgacgggttcgccgacccgcagccccgcccgaagcgtcgccgactcgcggtcgccgggcgggccgagcaccaccagggcgggatcgcgcccgtccagcacccgccgcagcgccggcagcagcgtcgggaccgccgcgccgggcgggacgtgcagcgcgcgcagtgcggctatgccgggtccccggcctggtcggcgtcgtcgaacggccagccctgggcggccaaccgcacccggacccgctcgacgtcgtcgggggtgggcagctcgtcggtgatctgggtgatcagcacgccgatgtcgacgtcgtcgaactctccgcgccggatcagctcgctggcaacgtctttgacctcgtcgccggacagccggcgcgccagcaacgcgagcaccgggaaggtgtcggtcggcggcacgccctctggatatcccgcgcggagccaggagacgatcgaactgagaaatccgttcacgctctgacaacaccccccggtgtgtggcttagcaactcggtgggcacctatcgatgctacttggctttggctccgaggaacgggtagccggtgtggtgggcgatgaagtcccgggcgatgtagagcaaagccagcgtgatcaccgcgatgaccagcgcgtagatggcccacgccagcccggtcagcagcgggttgcgccgcgcgggcccgccgtcggcgccgtccagggtgatgtcaccggccccggccgactgcagccggatgcccagggcgaacagccccggcagcgccgcgccggccagcatggcgaacagcaggatcttcaggctggcctggtagttgaaccagtcgccgaggtggctcatgacgcgctcgccttgagcgtcgggtcgtcggactggtaccggtcgcccggcccgccgaacgggggcccggcgtccgggggcggggagtggtcgtcggcgccttccagcccggtggtcaggtcgcccttccactcggcgttgacgttgtggtggtccaccttcaccttgcgcgagcgcaggtagatggtggccgacaccgcgaccagcaacgcgaagccgatgatcgcgccggggtagccgccgatcaggtgcacgatccagtaggtgacggcgccgaccagcccggccagcggcagggtgaccagccaggccacccccatccggccggccacgccccagcggacctcgccgccgggcttgcccagcccgctgcccagcaccgagcccgtgcagacctgggtggtggacagcgcgtagccgaagtgggcggacagcaggatcaccgcggccgacgacgactctgccgccatgccctgcggcgactggatctccaccaggcccttgcccagggtgcggatgatccgccagccgcccaggtaggtgccggtcgccatggccagcgcgcagctgacgatcacccacagcggcggcatggccgcggtcttgctgaccgagccgtaggagatcagcgccaggaagatgatgcccatcgtcttctgcgcgtcgttggtgccgtgcgccagcgacaccagcgacgccgagccgatctggccgcgccggaaaccggcctcggtgcgcttcttcgggacgccgcgggtgatccggtagaccagccaggtggcgaccgcgccgaccaggatggccaggatcgccgagacgatggccgggatgatggccttggagatcacgcccttccagatcaccccgtgcgcgccgacggcggcgatcgtggcgccgacgatgccgccgatcagtgcgtgcgacgagctcgacgggatacccagcagccaggtcagcaggttccagaccacgccgccgaccaggccggcgaacaccagctccagcgtgacgatgttggagtcgatcaggcccttggcgatggtggcggcgacggcggtggacatgaaggcgcccaccagattcagcaccgccgagagcgcgaccgcggtcttgggcttgagcgcaccgctggcgatcgaggtggccatcgcgttgcccgtgtcatggaagccgttggtgaaatcgaaagccaatgccgtgattacgacaatgatcaagaggaacaattggatgttcacagcgcctgattctggtggtaggggcaatccattgtcgaatgcggcatgacccgaaacgcgggtgtaccttgagtcgtcgccagatgttacctctcagttaaccgggcttcgcttgccgttcacctcgggtgtcgcggcgcagcgggtgatctgcggggatctggatgaagatgagcgtgatgccgtccgggtcgacgacgtgcatctcgtgcaggccccacggctcctggcgcgcctcgcgggcgatggccaccccgcgcccgcgcagctcggcctgggtggcctcgaggtcgcggacctgcagccacagcgcgccgggaaacgggccgccggagtggtccggggcgccgtaaccggccagttccagcagcgactgccccgcgaaaaagactgtgccgccgctgtattcgcgggctatcgccaggccgatccggtcgcggtagaacgtcaacgactgctgatagtccgccggccggagcagcatccggctggccaggatctccatagcctcgtgtctatcacacgcgtcgaatcaggccccggcttcgcggttgggctggacggtctggcgctgcatgacggcgttgacccagcgcgggccgaaggtgtccagcgccttggcggcgatcgccatccgcggggcgatgcgcaccggccgggtgcgcgcggcggtgatcatccaccggcccgcctcctccggcgtcagcgccggcaccccctggtaggccttggtcggcgcgatcatcggggtggccaccagcgggtagtacagcgtgctggagtgcacccccttgtcgccccactcggtttcgacgacccggctgacggtggacagcgcggccttggaagcgttgtagaccgcgaacagcggcgaggcttccgagagcaccccccacgtcgagacgttgatgatgtggccgtcgccgcgctcgatcatgcccggggcgatgccgcggatcagccgcaacggcgcgtagtagttgagcaccatggtccgctcgacgtcgtgccagcgttccagcgactcggccagcgggcggcggatggaccggccggcgttgttgatcaggatgtcgacgccgccgagccgctgttgtacgtcggccaccagcgcgtcggcggcgtccaggtcggagatgtcgcagggcatcgcgatggcctcgccgccggcccgggtgatgcgctcggccagcgcgtccagcaggtccttgcggcgggcgacgacgaccacccgggcgccctcgcgggcgaactgttcggccgccgcctcgccgatccccgacgaggcgccggtgagcagcacgcgcttgccggccagctcgaccggcttgatcagcggccggttgaccagcacctgcggggccatgggcggtcgcattgtggccagcaccaactggtcggcgaaccggcgaagcggactcttgctcacgggacgcgagtctaggcggcgccgccgtgaggcccgtacggagccgagcgtcacgccagcgtgacgcgcgccgccgagcgtcacgccagcgtgacgctcgggcgccccagcgcggcgcgcgggcgcggcggccccagcgcggtgccagcgcggcgcctcagaagtagcgcgggaaccggctgtagtccggcggccgcttttccaggaaggcgtcgcggccctcgacggcctcgtcggtcatgtaggccagccgggtggcctcgccggcgaacagctgctggcccaccaggccgtcgtcgagcagattgaacgcgaacttcagcatgcgttgcgcctgaggcgatttcgcgttgatctcgcgcgcccactcgatgcccgccctttccagctcggcgtgctcgacgacggcgttgaccgcacccatgtggtgcatctgctcggcggtgtattcgcggcccaggaagaagatctcgcgggcgaacttctgcccgacctggcgggccagataggcgctgccgtagccaccgtcgaagctgccgacgtcggcgtcggtctgcttgaagcgggcgtgctcgcggctggccagggtgaggtcgcagaccacgtgcaggctgtgcccgccgccggccgcccacccgttgaccagacagatcaccaccttgggcatgaaccggatcagccgctgcacctcgaggatgtgcagccggccggcccgcgccgggtcgacggtgtcggccgtctcgccggaggcgtactggtatccgctgcgcccgcggatgcgctgatcgccgccggagcagaacgcccagccgccgtccttgggcgaggggccgttgccggtcagcagcaccaccccgacgtcgggggacatccgggcgtggtcgagcacccggtagagctcgtcgacggtgtgcggccggaacgcgttgcgcacctcgggccggtcgaacgccacccgcacggtggcgtcgtcgacgtgccggtgataggtgatgtcggtcaggtcgtcgaagccggccacgggttgccactggccggaatcaaaagggttgtcgctcatcggattacgcggggtccagccggaacaccgcgcagcggccggccagcgcctcgaactcctcgggccgcccgtcggtgaccagtcccgcccgcttcatgaaaccgacgccggtgggcacctcggtggggaaggcgcgcaggaccggccgcgcctcagccgccgacagctcggtcatccgcacccgctcgacgtggcggccgcgcgcgatggtcgcctgtttggcggcgcgggcgttggccacccagtcggcgccgggaaaaccggccacgacgtagcggcggccgtcgagggtcagcggcgtcaccggggtcgaccgcgccgcaccggatttgcggcccggcacggtcaacacgaccgggctctcgccgccgaaactcagtcccagccgcgacagtctgatgaagagcttgttggccggcttcagccaccagggtggccggacgtgttcactggtgcccacccgtgacagcgtagtcatggcccgccgccgagccgacggcgtcgagccgggcgatcgcctcggcgctcagcgtgacgccggccgcgcccatgttctcctcgagatgggtgatcgatcgagtgcccgggatcagcaacgtgtggggggcgcgcgccaggatccaggccaacccgacttgtgccggtgtgaccccgagttcgcccgcgatgtccaccacgacggcgttgtcggtgaccttcggcagacccgggaacgccgaccccagcgggaaatacggaacccatgcgatcccctcggccgcgcagacgtcgaccatcgcctcctgggagcggtccagcaggctgtaggcgttctgcacgcatacgatgccggcgggcagggcgcgccgcagcacctcgagcggcacactgctgatcccgatgccgccgatcttgccctcgtcgcgcagggcgatcatctcggcaagctggtcgtcgaggtcgacgtcctggtcgccgccggcggccgcgctggggccgaggtccatccgccgcagattgaccaccgggatgcggtccaggccgagctggctcaggtcgtcctcgacggcggcgcgcagctcggcgggtcgttgcgcggaggccagcggaatcggctgctcgcccgtgtaacgggcgccgaccttgctgacgatgacgaggtcgtcggggtagggggccagcgcggcccggacgcgccggttcacctcgccggggccgtagaacgacgccgtgtcgatgtggttgacgccgagttcgacggcgcggcgcagcaccgcggccgcctcgtcgggcgacgtgtcgaacagctgcatggcgccgtagccgacgcgcgcgacgggcaggccgccgagatcgccgataccgccggggcgtggtttgtctgtcatggtggctcctgaaggatgcggtgagacactggagaatgcggagggccctccgcattcgcagcctagcagaaacggaggatcctccgctttggttggaaggtcggacgcgcgccgcaatcgccagcggctgctggaggcggccaccgcggcgttcacggcacacggcgcatcggtctcgctcgaatcgatcgcccgcgacgcgggggtgggcatcggcacgctctaccgccatttccccaaccgggaggccctcgtcgaggccgtataccgcgccgagctcgccgaggtggccgcggccgccgcgcagctgctccaacgtcatccccccaagaccgcgctgcggcgctggatggaccgctatgcgaacttcgtcgccaccaagcgcggcatggccgaatccctgcaggcgatcttcgagtccggcgctctggtgccgagccagacccgcgacagcatcgtcggcgccgtcgagacgctgttgcgcgccggcgccgacgatgccagcctgcgcgccgacgtgcaggccgacgacgtggtgtccagcctgatcggcatcttcctggtcagcggttcaccggagcagaccggacgcatgctcgacctgctggtcgccggggtcacgcgctgacttccactcgccgggcgtcctcacccgcctcgtcctcactcgcctcggccttactcgcctcgtcctcactcgcctcggcctcactcgccgaacgtgaagctagtttcacgttcgcacgcgagcgtgaagttaacttcacgctcggcggtaggggccggccgggcgccgggcgatagcccgggcgagcccacacgccacacgctcacctagccgacggcgcggccggcgccctcccagaaccgcgcgcgcacggccttcttgtcgggcttgcccagcgcggtcaccggcacggagtcgacgacgatcacctgcttgggcgattgcaccgaacccttgcgcttcttgaccgccgcctggatctcggccgtcaccttcgccaccgactcctcgtcggagggatggtcgggccgcagcacgatcacggcggtgacggcctcgccccacttctcgtccggcgtgccgatcacgcagacctgcgcgacggccgggtgctcggcgacgacgtcctcgacctcgcgcgggaacacgttgaagccgccggtgacgatcatgtccttgacccggtcgacgatgaaccagaagccgtcctcgtcctcgcgggccatgtcgccggtgtgcagccagccgtccttgaacgtcttggccgtctcctccggcaggttccagtacccgccgctcaaaagcggcccggacacgcagatctcgccgacttcgccctgcggcaccgggttgccgtcggcgtccagcagcgcggtgcgggcgaacagggtgggccgcccgcaggaggtgagccgcttctcgtcgtggtccttcttggccaggtatgagatcaccatcggcgcctcggactgcccgtagtactgggcgaagatcggcccgaagcggcggatggcctcggccagccgcaccgggttcatcgccgaggcgccgtagtagaccgtctccagcgaggacaggtcgcgggtgtgcgaatcggggtgatccatcagcgcgtagatcatcgacggcaccagcatggtcgcggtgatcttctgctcctcgatcacccgcaacacctcggccgggtcgaacttggtcagcaccaccagctcgccgcccttgatgatggtcggcacgaagaacgcggccccggcatgcgacagcggggtgcacatcaaaaagcgcgggttctctggccactcccattcggcgagctggatcgtggtcatcgtggtgatcgactgcgcggtgcccagcacacccttgggcttgccggtggtgccgccggtgtaggccatcccgccgatgtgatcgggcggaagatcggccgccaccaacggtttcggcgcatacttggcggcctcggccaccaggtccaccgcggaaccgctcaacgcctcgggcaccgggccgatggtgaggatctgcttgaggccgggcaccttctccagcaggcccagcgcccgctcgacgaacgccggggtcgggtcaatgatcagcgacgtcacgccggcgtcgtccagcacgtaggcgtggtcgtccagcgagcccagcgggtgcagcgccacgcgccgatacccctgggtctggccggcgccgatgatcatcagcacctcgggccggttcagcgacagcaacccgacggtggcgccggtgcccgcgccgagcgcctcgaacgcctggatgtactggctgatccgctcggcgagctgacccccggtcagcgtggtgtcgccgagatgcagcaccggcttgtctttgttgcgcttgagcgcaccgacggtcaggtgtccggaatgaatgggatggcgcagcagctcgtcacccatggcgtggctcctcctcatcgcttggctctgcatcgtcgccggcgcgactcatggggccagactagaacgtgttgcaattccggtcagccgcaccctcggaccgatagcatccgtgcacatggggcaggcagatctagtcctcaccggaaccgtactgaccgtcgacgaggcgcggcccaccgccgaggcgctggccgtcgccgacggccgcatcgtcgccgtgggaacccgcgccgaaatcgcggcgcacgtcggcccgcacacccaaaccgtcgacatcggcgacggctgcgtgatgccgggattcgttgaggcgcacgggcatccgctgatggaggcggtcgcgctgtcggaccgcatcgtggacatccgcccggtcaccctggccaacgcggacgacgtcgtcgccgccgtcaagagtgaggtcggcaagcggggcgaagccggtgcctacctcaacggctgggatccgctgctgcagcagggacttccgcaaccgacgctggcttggctcgacgacatcgcgcccgacggcccgctggtgatcatccacaactccgggcacaaggcgttcttcaactcccgagccgcccagcggcacggcctgaaccgcgacacccccgaccccaagggcgcccgctacggccgcgacgcggacggcgaactcgacggcaccgccgaggagaccggcgcggtgtttccgctactcgacggcgccatcgacaccgctggctacccgcggatgctgcacgccgagtgcgcccggctgaaccgggccgggctgaccacctgttcggagatggcgttcgacccgcggtttcggccgctggtcgaacaactgcgcgggcagctgacggtgcggctgcgcagctacgagatctccaacccgcagctgcgcaccgacgccaccctgggcgagggcgacgacatgctgcgccaggtcggcatcaagatctgggtggacggctcgccctggatcggcaacatcgcgctgtcgttcccctacctggacaccgaggccacccgcaccatcggcgtcatccccggctcctgcggctgcgccaactacacgacggagcagttgcacgagatcgtcagcgcctacttcccgctgggctggcagctggcctgccacgtgcagggcgacgccggcgtcgacacgatcctggacgtctacgaggaggccctcaaacgccatccgcgcgacgaccaccggctgcggctcgagcacgtcggcgccatccggcccgatcaactccaaagggccgccgacctcggcgtcacctgcagcatcttcgtcgaccagatccactactggggcgacgtcctcgtcgacggcctgttcggcgaggaacgcggatcccgttggatgccagcgggttccgcggtggccaccggcatgcgcatctcgctgcacaacgacccgccggtcaccccggaggagccgctgcgcaacatcagcgtcgccgccacccggaaggcgcccagtgggcgggtgctggcgcccgaggagcggctgacggtcgagcaggcgatccgggcgcagaccctcgacgcggcctggcagctgttcgccgacgacgtgatcggctcgctcgaggtcggcaagtacgccgacctggtggtgctgtccgccgacccgcgcgcggtgccgcccgagcggatcgccgacctgcaggtgcgggcgacgtatctggccggccgccgggtgtacccacagtgattccgccgctgcaggacctgctggaccggctgcacgtggtcgcgctgccgatgcgggtgcgattccgcggcatcaccacccgcgaggtcgcgctgatcgacggccccgccggctggggcgagttcggggcgttcgtcgaatacgggccgcccgaggccgcgcactggctggcgtcggccgtcgagtccgcctaccggccggcgccgccggtgcgccgcgaccggatcccgatcaacgccaccgtgcccgccgtcccccccgccgcggtgcccgacgtgctcgcccgttttcccggcgcccgcaccgccaaggtcaaggtcgcggagcccggccaaaccctggccgacgacgtcgcccgggtgaatgcggtgcgcgatttggtgcccaccgtgcgggtggacgccaacggcggctggagcgtggacgaggccgcccgcgccgctcgagcgctgagcgccgacggcccgctggagtacctggagcagccgtgcgcgacggtcggcgaactcgccgagctgcgccgccggccggacatgcccgacgtgccgatcgccgccgacgagagcatccgcaaggccgacgacccgctggccgtggtccacgcccgggccgccgacatcgcggtgctcaaagtcgctccgctgggcgggatttcggccctgctggacatcgccgcccgcatcgacatcccggtcgtgatctccagcgcgctggattcggccgtcggcatcgcggccgggctgaccgccgcggcggcgctgccggtgctgggccacgcgtgcgggctgggcaccggcgggctgttcgtggaggacgtggccgacgtcgccgcgcccgtcgacggcgccctgccggtcgggccggtgacccccgacccggcccggttgcgggccctggccgcgcccccgcagcggcggcagtggtggatcgaccgggtcacggcctgccacgggctgcttgtaccgtcgtccgggtgatcaacctggcttacgacgaccgcggctccggcgagcccgtggtctttatcgccggccacggcggcgccggacggacctggcacccctatcaggtcccggccttcctggccgccggataccgcgtcatcaccttcgacaaccgcgacatcggcgccaccgagaacgcgcagggattcacgacggagaccatggtcgccgacaccgcggcgctgatcgaggggctgaatgcggcccccgcccgcatcgtcgggatgtcgatgggcgccttcatcgcccaggagctcatgctggcccggcccgagctggtcagcgccgcggtgctgatgggcacccgcggtcggatggaccgggcccggcagttcttccgcgacgccgaggccgagctggccgacggcggcgtcgcactgccggcgtcgtacgaggcgaaaatccgtctgctggaaaacttttcgcgcaagacgctcaacgacgacaccgccgtcgccgactggatcgcgatgttttccacctggccggtcaagtccacgccgggcatgcgggcccagctcgacgtcgccccctacaccaaccggttgtccgcctaccgcagcatcgcgacaccggtgctggtgatcggcttctccgacgacgtgctcaccccgccgtacctgggccgcgaggtcgccgacgcgctgcccaacggccgctacgtgcagatccccgacaccggtcacctcggcttcttcgagcgggccgacgccgtcaacgcggccatgctcaagttcttcggcgagcagcactaggcgcccaacgtcgacttgtgcggcgagatcgcgccggcgggccgcaacaactccacgttgggcgcctcatcgaccggctgtgacacgctgtatgggtgaacccctcgacgacccaggcccgcgtcgtcgtcgacgagctgatccgcggcggtgtccgcgatgtggtgctgtgccccggttcccgcaacgccccgctggccttcgcgctggccgacgccgaccgcgccggccggatccggctgcacgtgcgcatcgacgagcgcaccgccggctatctggccatcggcctggccatcgcggccggcgctccggtgtgcgtcgcgatgacctcgggcaccgcggtggccaacctgggcccggccgtggtggaggccaactacgcgcgggtgccgctgatcgtgctgagcgccaaccggccctacgaactgctgggcaccggcgccaaccagaccatggagcagctgggctacttcggcacccaggtccgggccgccatcagcctgggcctggccgaggacgcccccgagcggctggacgcgctcaacgccacctggcgctcggccacctgccgggtgctggcggcggccaccggatcccgcaccgccaacgccggcccggtgcagttcgacatcccgctgcgtgagccgctggtgcccgatcccgagccgcacggcgccccgaccccggccggcccgccccgggcggccgggcccgtgtgacctataccccgccggtcagcttcgaccagccgctggacatcgatctgtcaccggacaccgtcgtcatcgccggccacggcgccggcacgcaccccaaccttgcccagctgccgaccgtggccgagccgacggcacccgccccggacaacccgctgcacccgctggcgctgcggttgctgcgccccaagcaggtgatcatgctgggccggcccaccctgcaccggccggtgtcggcgctgctggccgacccgcaggtgccggtgtacgcgctgaccaccggtccgcgctggcccgacgtgtcgggcaactcgcaggccaccgggacccgggcggtcaccaccggggcgccgagcccggcctggctgcaccgctgcgaacaggccaaccggcacgccgtggccgccgtgcgcggccagctggcggcgcacccgctgaccaccggcctgcacgtggcggcggcggtggccgacgcgctgcggcccggcgaccagctggtgctcggggcgtccaacccggtccgcgacgcggcgttggtcgggctggacagccaccacatccgggtgcgctccaaccgcggggtggccggcatcgacggcacggtgtcgacggcgatcggcgcggccctggcccacgaggcggcgcacgacgggcgcaccgtcgcgctgatcggcgacctgacgttcgtgcacgacagctccgggctgctgatcgggccgaccgagcccaccccacgccggctgacgatcgtggtgtccaacgacaacggcggcggcatcttcgagctgctagagcagggcgacccgcggttctccgacgtgtcgtcgcgggtcttcggcactccgcacgacgtcgacgtgggggcgctgtgccgggcgtatcacgtcgagagcgcccagatcgaggtcggcgaattggccgccgccctcgacgaacccgggcccgggatgcgggtgctggaggtcaaggccgaccgctcgtcgctgcggcaactgcacgccgccatcaaggcggcgctgtgacgatatccccaaaagcgttgctgcacatcctgattcacggacgcagcgacccgccggagacaacccggggccggatcgcgttgcgctgggccaggatcgcggtgctgatcgtcaccggcctggtcacgctgcagtcggtgctgctggtcgccggggcgtggcgcaatgatctggccatcacccacaacatgggggtggcgcaggccgaggtgctcagcgccgggccgcgccgatccaccatcgagttcgtcacccccgagcgggtcacctatcgccccgaactcggcgtgctctacccgtcgcatctggccaccgggatgcggatctacgtcgaatacaacaagaacgatcccaacctggttcgggtgcaacaccgcaacgccgggctggcgatcatcccggccgggtccatcgcggtggtgggctggctgggcgcggcggtgctgctggcgctgctggcgctggcggacaaatggctggaccggcgcggcaaaggtgccggacctgcagatttcgcatgacgtatgcccgcaggcaacctttccgacaagcggcgctgacaccgtgatggtgtgcgcgttgccatcgtcgcggaatccttcctgccggaagtcaacggggtcagcaactcggtgatccgggtgctcgagcacctgcgccggaccggtcacgaggccctcgtcatcgcacccgacaccccgcccgggcagccccgggccgaacgcatccacgacggcatccgcgtccaccgggtcccgtcgcggatgttcccgaaggtgaccacgctgccgctgggggtgcccacaccgcggttggtgagcgtgctgcgcggattcgacccgcacgtggtgcatctggcctcgccggcgctgctcggctacggcgggctgcgggccgcgcgctggctgggggtgcccacggtcgcggtgtatcagaccgacgttccgggtttcgcggcctcctatggcattccgatgacggcgcgggccgcgtgggcgtggttccgccatctgcacacgctggccgaccgcaccctggcgccgtccaccgtgacgatggaatcccttgtcgcgcaccgctttccgcgggttcaccggtgggcgcgcggtgtcgacgtgctgcggttcgcgccgtccgcgcgcagcgaggcgctgcgccggcggtggtcgccgcagggcaagccgatcgtcggcttcgtcggccggctggcgccggaaaagcacgtcgagcgcctggccgggctggccgcgagcgacgcggttcagctcgtcgtcgtgggcgacggcgtcgaccgcgccaagctgcaatcggcaatgcccacagcggttttcacgggcgcgctgtacggcgacgagctcgccgcggcgtacgccagcatggacgtcttcgtgcaccccggcgagcacgagacgttttgtcaggtcgtgcaagaagcgctggcgtcggggttgccggtgatcgcccccgacgccggcggcccacgtgacctcgtcaccccgtggcgcacgggtctgctgttggccgtcgacgaattcgagaccaagctgccggccgccgtcgcccatctgatcggcgaacgccaccgctacgcgccggccgcccggcgcagcgtgctcggccgcagctggccggtcatctgcgacgagctactcggccactacgaggcggtgctgtcgccgttcgtccggcaccaggtccgcgccgggcgctacgcgcaaggcgaatgagccggcccggcgccgggcagccctgcgccagctcggcgaccggctgccattcctcccaggtgcgcagccggctttcgtagtcggccttggccgtctccagcgggcaggagccgaaaaagactcgcagcggcggcttttcggcgtcgaccaccttcatcagcgcggtcgtggacgccgccggctcgaccagcgtgacatgcacaccgaacggcgcgatctctagccacgcagaggtgcaacgctggcgtcgccgcggcattcccgcaccgggtagcgtcaagcgggtgagccgcgcggagttggacaagaatccccgggacgtcgcgtcgatgttcgacggcgtggcccgccggtacgacctgaccaacaccgtgctgtcgctgggccaggaccggtactggcgcaaggccacccggtcggcgctgggcatcggacccggccagaaggtgctcgacctggccgcgggcaccgcggtgtccaccgtcgagctgaacaaatccggggcgtggtgcgtggccgccgacttctcggtcggcatgctggcggccggtgccgcccgccgggtgcccaaggtcgccggtgacgccaccaggctgccgttcgccgacgacgtattcgacgccgtcacaatcagtttcgggctgcgcaacgtggtcgacacgcaggcggcgctgcgcgagatggcccgggtcacccggcccggcgggcggctggtggtgtgcgagttctccacccccagcaacgcgctgttcgccaccgtctacaaggagtacctgatgcgggcgctgccgcgggtggcgcgggcggtgtccagcaaccccgacgcctacgtgtacctcgccgagtcgatccgagcctggccggatcaggcggcgctggccgaccagatcgccggggccggctgggcgggggtgcgctggcgcaatctgaccggcggcatcgtcgcgctacacgccgcccaccggccgccgcgctgagcggtgcttaccggccggccgcctggacgacgtcgatgtgctcggggcagtagtggtccaccgccgcgccgaggaactgcagcgactggccctcggaggtgccgcgcggcaggttgcgctggatgaaggtcgcggactggtgggcgtcgtggtcgacgccgtggtccagccggtcgcaggtgatcttgcccagccacgccaactggtcctgcggctggtagatgccgaagccgttgacggtgttcttgaacggcgcgtcgtagtcgctcggcggcgacggtgtccgcggcgtcgggtagggcgccgtcggcgggggatccgcctgcgcgggcgcggacagctgcgcgggcgcggccagcgcgaaagcagcaacggcggcggcaccgatagtagccagcatcgttcccttcattagccggactatacacgcctggacagggtcgttcagctgaacggtgcccgccgatcgatcagccgcgacagccgcccggcgccccgccacgcccgcgccacccagtccgcgtcgtcgtcggtgaccaggttggccatcacccgcaccgcgatcctcatcagcgtcgtggaacgcatcgcgaccggccccgtcgcgggcaggaaccgctggtaggtcagcagcaacgccagccggcgcgccaccgagaagccgcgcgcgtagtgctcccgcagcagcgccggccactcctgcgacaggtccgggcaccccagcaggcccgcggccagccgtcccgtctccattccgtagtcgatgccctcgccgttgagcgggttcacacaggccgccgcgtcgccgatcagcatccagttgggcccggccaccccggacaccgcgccgcccatcggcagcagcgccgaagcgaccgcccggggtctgccgacgaagccccactcgtcgcggcgcaggtccgtgtagtggtcgatcagcggccgcagcgccagctcggccggtcgcctcgacgtcgacagcgccccgacgccgatgttcacctcaccgttgccgagcgggaagatccagccgtagccgggcagcaccttgtcccgggcgccgtcgggtccgcgcagttccaggtgcgacgtcagccaggggtcgtcggcgtgcggggtgctcaggtagccgcgggcggccacgccgtacaccgtctcctgatgccagcgtcggcccagcgcgcggcccagcgacgaacgcgccccgtcggccacgatcagctgacggcattgcaccccggtgccgtcggccaacgtcagcgccctcaccgcgcccgacgagtcacgctgcacgccaacggctttggttcccagcagcatccgcgccccggaatcctcggcgaccctgcggatccggtcgtccaactccgtgcgggccaccgcgctgccggtggacgggaacgacgggccgggccagtcgacctgcacctgggcgccgaacccgctcatccgcagcccgcggtgccggatgcggctgtccagccagccgcccaggcccaggcgttcgcactcggcgacggcgcgcggggtcagcccgtcgccgcaggccttgtcgcggggaaagcgcgccgcatcgacgaccagcacgtcatgccccgcgcgcgcggcccaggccgccgcggcggatccggcgggcccggcgcccaccaccaccagatcggctcgggtcgctgccgtcgtcatgcacaccagtatgtttggtcgggtgaatactccggcgacggtggtggcgggcgtggatttcggtgacccggctttcgcggcgaccgtgcgcgacggcgtcgggcgcatcgagcagctcatggacaccgagctgcgcagcgccgacgacatcatgaccgagtcgctgacccatctgttcaaggccggcggcaagcggttccgcccgctgttcaccgtgctgtccgcgcagatcggccccgaccccgacgccgccgaggtgaccatcgccggcgccgtcatcgagctggtgcacctggccacgctctaccacgacgacgtgatggacgaggcggaggtgcgccgcggcacccccaccgccaacgtgcgctggggcaacaacgtcgcgatcctggccggggactatctgttcgccacggcgtcgcggctggtgtcgcggctgggcccggaggcggtgcggctgatcgccgagacattcgcccagctggtgaccgggcagatgcgcgagacccgcggccgcaagcagggatcggacccgatcgagcactacctgaaggtggtgtacgagaagacggcgtgcctgatcgccgcggcgggccggttcggggccatgttctccggggccgacgccgaccaggtcgagcggctgagccggctgggcggcatcgtgggcaccgcgttccagatctccgacgacatcatcgacatcgacagcgactcgcacgaatccggcaagctgcccggcaccgacgtgcgcgaaggcgtgcacaccctgccgatggtctacgcgctgcgcgaacccgggccggacgcggcgcggctgcgcgagttgctggtcgggccgatcgacgacgacgaggtggtggccgaggcgctgacgctgctgcgggcgtcgccgggcatggccaaggccaagcagtcgctgcgcgagtacgcggcgcaggcgcatcgggagctggaccagctgcccgacgtcccgggccggcgcgcgctgcaaacactggtcgacttcaccatcagccggcacggctagcgcgtcgcggaaccaaccgggccgtctcgagcgttcaattagcgcaagtcagcaagagcgcgtgtgtgcccgtgcactgcgaggaggacagcgatgacctggcatccgcatgccaacaggttcaagacgttcgccctgttggtcggcatgtccgcgttgatcgtgttcgtggggtcgttgttcggcaggaccgcgatgttcttcgcggtgctgttcgccatcggcatgaacgtctacacctactacaacagcgacaagctggcgctgcgcgccatgcacgcgcagccggtctccgagctgcaggcgccggcgatgtaccggatcgtgcgcgagctggccaccgccgcgcaccagccgatgccccggctctacatcagcgacaccaacgcgcccaacgcgtttgccaccggccgcaacccgcgcaacgccgcggtctgctgcaccaccggcatcctgggcatcctcaacgagcgtgagctgcgcgccgtgctgggacacgagctgtcccacgtctacaaccgcgacatcctgatctcgtgcatcgccggcgcgatggcgtcggtgatcaccgcgctggccaacatggccatgttcgccggcatgttcggcggcaacgaccgcgacggcgagaatccctttgcgctgctgctggtttcgctgctgggcccgatcgcggccaccgtggtgcggctggcggtgtcccggtcgcgcgaataccaggccgacgagtcgggcgcggtgctgaccggcgacccgttggccctggcgtcggcgctgcgcaagatctccggcggggtgcaggcggcgccgctgccgcccgagccgcagctggccagccaggcgcacctgatgatcgccaacccgttccgggccggtgaacggatcggctcgctgttctccacgcacccgccgatcgaggaccggatccgccgcctggaatccatggcggggcgctgacgtcggccgcgcgtgcccgcggtcatgcgcgggcaatcgctgcgcccgccgccaccacggcagtagcatcggggatgtatgcggtcctcgagctggccgttgatggaagcggtgatggcgatgccggactctgactcactggacattcacgaggccgggctggcgctggatctgcccgacctgatcttcgagacacgcgccggcgcgggcatgaaccaggccgcgctggcgcaggcgctgggtgttccccgggcgagcgtcgccgcgtgggagagcgggaccgaggtgccgcgggtcgatatgctgcaacggctggcgcaggtgtgcggcaagcgattacacatcaggatcgacgtcgactgatcgacgagccgggccaattacgctgcggcgccgggcatttcggcttccacctgcggttcgtcgcggcggcccgtcgccaccacggcgccctcgatgcgcaccgtgccgcccgtcgcctcctgctggcgctgccagtcggtgatcgcttggtgggcggcgtgatcgaggtagtgcaccgcgatggccaccgtcaccgtcgcgccccgcggcaccgacgccagcacccgggtcagcctcggcagcgccaggaaggtgcacgccgcgccctcgatcgtcacccgccactcgccgtcgagctgggcggcctcgatcttggcccggatcacccgccagccggtcagcgcgatggccagcgccagcccgatcatcaccccgtgcagcaggttgaggaagatgacgctgacggccgtcaccacgtacaccgcgagatcgccgtgcttcattgcggtttcgatgtgcgccggcttgagcagctggatgccgatgacgatgagcagcccggccagggcggccgtggggatctcgtcgaccagcccggcgaacggaatggtgaacagcaggatccacacgccgtgcatgatcgccgaggcgcgggatcgggcgcccgcgttgacgttggtcgagctgcgcacgatgaccccggtgaccggcagcccgccgacggcgccggagatcatgttggccgcgccctgtcccaccaattcgcggttgaagtcggtgcgcggcccgttgtgcatccggtcgaccgacaccgcggacagcaggctctcgacgctggcgatcagcgcgacggtgatcaccccgacggcgacaccgctccagttgccgtgcggcaggtcgggcagctgcagcgcatccagcggcgacccgtcgaggtcgatccggcgcacgtgaaagggaaagaccaccgagatcaccgtcaccgccacgatggcgaccagcgggccgggaacgcggcgcaccttggcgggaacccagcgccaggcgaccaggatgacgatcaccagcacgcccagcagcaccccgggccggtgcgcgccgatgatctgccccggcaggccgatcaggttgtgccaggccgtgctcttggatttcccgcccagcagcacgtgcgtctgctgcagggcgatggtgatcccgatgccggccagcatggcgtgcaccaccaccggcgagatcgccagggcggcgcgcgccacccggctgagccccaacagaacctgcacggctccggccgcgacggtgatgaaacaggtgacgccccaaccgaagtcggagaccagaccggcgaccacgacggtcagcccggccgccgggccgctgacttgcagcggcgatccgcccagggcgccgacgacgattccgccgacgatggccgcgatcagaccggccagcaccggggcgttggacgcgatcgcgatgcccagcgacagcggcagcgccaccaggaacaccaccagcgaggagggcaggtcgtgccggatgacgccgcgcaaccgctcggcgcgcgacgcggtgggcagggcatcgtccgcccgttgaatgtcttgcatcggtcccgtccctcgttaggagtttgcgggggatgttccgatatgcgccccgtcttgcggccagttacgtcgtcgtaacgggttggcgtgcagcggattacagccggatgacccgcgggagcgcaccggagaaccactggctacctggactgacggtattttgctggcaaacaccggtcaagccgacgtgaccggcccatagagaacgcaaagatttgaattcggccaccgcgcgacgcccaggtcagaagccggagccgtgcacctcgtggccgggaacctcggcgatcagcccccgataggcctgctcgaccgtcgagccgtggttgatcaccgcatcgacttcgcgggcgatcggcatggtcaggccgaactccatgatcacgctggccgctttgacgccctcggcgacctggttcatcgacgcgatgatctcgtcgatcggtttgccggcgcccagttgttcgccgacgtgccggttgcggctgcgctggctggtgcaggtgacgatgaggtcgccgagtccggccagtcccgggaaggtgtcggggctgccgcccatcgccacccccagcttggtcatctcgcgcagcgcgcgggcgatcaccagcgcgatgcccagcgaataccccatgcccacggcgatggcgaacacgttcttcagcgccccggccatctccgccccgacgacgtcgtcggtggtgtagacgcggaaccgccgggtgcggaacagcccggacagccgggtcgccagatgctggtcgggcatcgccagcaccgccgcggcggcgtagccctcggccacctcgcgcgcgatgttcggcccggccaggatgcccgccggatgaccgggcagcacctcctcgacgatctgcgacatccgcatgttggtgccctgctcgagccctttgaccaaggacaccaccggcacccacggccgcaattcccgcgccagttcggtgagcaccccgcgaaagccgtgcgaggggactcccgtcaccaccacgtcggcggtgttggccgcctcgcagaaatcggtggtggcgcgcagcgtgtcgctcagcaccacgtcgttgcccagatagcggctgttgcggtggttctcgttgatgtcgtcggcggtctcccgcgagcgcacccactgcagcgtcggcccgcggcgcgcacagatcgacgccacggtggtgccccaggagccgcctccgagcacaacgactttgggttcacgcatctgagctgccatggcgatcagcgtattgccgacatctgagttttagaaggaattcaccaactcgccccggcgcccgccgatcagccggccagcgccgcccggtcggcggcccggccgaacaccatcgcctcttcgatgcggtcgaagcggtagtcgatggcgtcggcgaggtagttctgccgcacgttccagggccgcttggtgcccgacttcggcagcgcgtgcaccgagcgcagtacatacccggcgttgatgtcccacgacggcttctcggtcatcggctcgttgccgcgatgtgggtaggcgtgcgtgtagccgtgagtcgtcatgtgctccaacagttttgccgtcgcccgggcggtgatgtcggcccgcagcgtccacgacgcgttggtgtagcccacacaccagaacaggttgggcacgtcttcgagcatgtgcgccttgtagacgaaccggtcgttggtcttgatctcgttgccgtccaggctgatcgtggccccgccgagggcctgcaattgcaggccggtggcggtgatgatgatgtcggcgtccaggtgggcaccggaccgcagcgcgatgccggtggcgtcgaagtggtcgatgtggtcggtgaccacgtcggcgcgcccggcggtgatggcgttgtacaggtcggcatcggggatcaggcacatccgctggtcccacgggttgtagcgcggcttgaagtgaatgtcgacggcgtagccggggggcaggctgttgatcgccttgcggcgcagcagccagcgcaccagccgcggtgccttgcgggacagcgcgaagaacaccgcctcggtcagtgcgctgtacatccggataacgagatgagcgggcttgcggggcaacacttttcgcgccaccgcggcgaccttgccgtacttggacgccgagatcaggtaggtgggggagcgttgcagcatggtcaccttggcggcgcggtcgctcagcgacggcagcagcgtgaccgcggtcgccccgctgccgatcaccaccaccttcttgcccgtgtagtcgaggtcctcgggccagtgctgggggtgcaccacggtgccggtgaactcctcgatgcccgggaagtcgggggtgtagccctcgtcgtagttgtagtagccgctgccgaagaacaggaagcgagcgcggtagagcttgcgttcgccgtcccgcgccccgtcttcgacggtgaccgtccaggtgtcgctggtcgagtcccagtccgccgagcgcacgtagctgttgaaccggatgtggcggtcgatgccgtacttgtgcgcggtggcggtgaggtactcgcggatgtgcaccccgtcggccacgccctctttgcgggtccacggctcgaatgggaaggacagcgtgaagatgctgctgtccgagcgcacaccggggtagcggaacaggtcccacgtcccgccgatccgcgcgcgccgctccaggatcgcgtagctcagctgcggattgcgctcggtgatccggtaggccgcgtcgatgccggagatcccggcgccgacgatcaggacgtcgaaatagtcggcctcggccgcgccgtggtcggcggcttcctggggagtcacggtcatcgcgaacctcgctcgaattgtgggactggtcaccagggtagagacccaccggttggttgggctagtgaacggccgcgctcacgttcgtgcgccgggaatcaccggtagttgacgaactgcagcgccacgtccaggtcggcctgcttgagcattgcgatgacggcctgcaggtcgtcgcgctttttgctgctcacccggatctcgtcgccctggatctgggttttgacgcccttggggccctcgtcgcggatcagcttggtgatcttcttcgcgctctcgctgctgatgccctgcttgagggtgccgttgaccttgtaggtcttgccggaggcctggggttcgccggcgtcgaaggccttcatggagatgtcccggcggatcagtttctccttgaagacgtcgacggccgccttgacgcgttccccggtggacgacgtcagctcgatagcctcgtcgcccttccaggcgatggtggtgtcggtgccgcggaagtcgaagcgggtggccagctccttggcggcctggttgagcgcgttgtcgacctcctggcggtccactttgctgacgatgtcgaacgatgagtccgccatgcattccgtcctttcatcgagtgacaggcgtttgtgctttgtctactcgctcgttgtaacctgtctggcggcaggttgcccgagcggccaatgggagcggactgtaaatccgtcgcgaaagcttcacaggttcgaatcctgtacctgccaccacagggtcagagcgtatttctggccgcgccacggagccgtgaggcgctgaccgcccgcatgcttcagctggatcgcatcggtggacagtactatcgcagctcggtctcggggtttcgcagctctgcacctgccactgcgcccgaccgtttcgcaattgccggcggccagccggggagtgaatagcaccggctcggctaccgccctaaaatccggcaagtgatgacccgtggcgactaagcgcactgtcgtcaccgctgccgccgctggtgtgctgatgctcgtgatagccggggtgtcggtatggctgtatttcaggccgagacctacatcggattgcgcgaccgtcaacgacatgctcaagtactcgagatcggagagcgcgcgaatacgcgatctcattccgaccagtatcgacgacccgcaaaaactcgtggctgcgtaccaaactcgcgaaactcgtctgcgacagtacgccgaccagatccacgatcctggcttgcgtgaaaaggcttacgctctagtcaatctcgaggacaaaatgctcgccgtttggcgccagaccttttcgggacagtcacagaacggatcggagagcggttcggcaagccgcaacttccagcgcgcttacaccgactacgcggcacagagccaacagatcggccgagccctacaaggagcaattgtcaaaacctgtgaacgggagcgccgctaacgctgccggcctgtgcccagcgtcgacgtgtagtaggtgacgccattcatcgtctgtcgatcatcgtcggcacgcgcgatcgccggcaacccgtggtcggcgagcagctcggccatcggcgttgcgaccgtcgtccagccatgcgcctgcaggtacgcgccgacgtcgtggcgctcacccgcaaatgagatcacgtcgacgtcgagttcgaagccgtggtcgcgccacttggccgtcgccgcgcgcatccgttcgcgcgctgcgtgggggtccatgtcggcggtattcggcacagcttcactcccgagtcggctgcctggcgtgctcagcgcggtgacggcatcgagcagcccatcttgggcctcgggtgccagatagccgaacagaccttcggcgatccacgccgtgggtttactgctgtccaaacccgccgtcgcgagtgccgtcgaccaatcgtcgcgcaggtcgaccgcgaccgtgcgcaagtcggcttttggctcggctcccagcctggccagtgccgtggttttgaactcgatgacggcgggttggtcgatctcgaacaccgtcatgcctgcgggccagtccagtcgataggcgcgggtgtccagacccgaggcgaggatgacggcttggcggatgcccgccgctgcggcatcggcatagaactcgtcgaagtaccgggtgcgggccgcaatcgatgcaggcatctgcgccaagccccatgggctgccctcgacgtcgacatccgaggcgaccagctcaccgatagcccagcgggtcagaaaattcacaccgaccgcccgcaccaacggctcggcgaatggatcgttgatgaccccatcccgggtggcgatggcccttgccgccgccgccatcgtggccgtcgttcccacgctggtggccggaccccacgtgtcgtcgttgggtaccgtcatcgtcaacctccgaaagtcgcctggatgcggtgcaacccgttgtggtcctgatgcacccgcgcagagcccaaggtatcgggccgcaatcccgaatgggccttgtggcggacggggccggcgtcaccgtattcgttgcatgacctccaaacccgaagagcgcaggaaacctggtgatctcgggctacaccggttgccggctgccccgcgacacgaaatagggcccgactcctgcgccgtgccggcgcttcccgggaaagctccgtcggttaggtaaaccttggctatcatccacggggcggatcgcggcgcgcggccgcagtcctgggaggaagtggcaagggtgaccgagacaaccacgcagccggtggccgacgccgtcgcggatcggccgtcggtgtcattgcggacccgtggccgctggctgcggtgggggctgttgtcggtatggggtcccggcctggtcgtgatgctggccgacaccgacgccggctcgctgatcaccgcctcccagtccggcgcccagtggggttaccggatggtgctgccgcagctgatcctgatgccggtgctctacgtcgtgcaggagatgacggtgaggttgggcatcgtcaccgggcgcggccacggctcgctgatccgggagcggttcggccgcggctgggcgtggctgtcggcgttcaccctgttcgcctcggcgatcggggcgctgctgaccgagttcgccggcgtcgccggggtgggcgaactcttcggtgtctcacgctgggtgagcatcccggtcgcgaccatcgcgctgctggcgctggcgctcaccggcagctaccggcgcgtcgagcggatcggcctggccgtcggcgcggccgaactggccttcctggtggccatggtgatggcccggcccgacccgggtgcgctggcgcatggcctgacgtcgatgccgttgggcgactcgtcgtatctgctgctgatcgcggccaacgtgggcgcggtgatcatgccgtggatgatcttctaccagcagggcgcggtggtcgataaacacctgtcggagagcacgattcggcaggcccgctacgacaccgcgttcggtgcggtgctgacccagctgatcatgatcgcggtggtgatcaccatggcctccaccatcggccggcacggcgacggtgccccgctggagaccgtgggccaaatcgcccagtcgctgacgccctacctgggccacgtcggcggcacggtgctgttcggcctgggcatgctgggtgcggcgctggtggccgcgatcgtggcgtcgctggccggtgcgtggggactcgcggaggtgttcggctggaagcacacgctcaaccagcggcccaaccgcgccaccgcgaagttctacctcacctattcgctggcccacatcgtgggcgcggtgctggtgctggccagcgtcgacctggtcaacctggcggtcgacgtcgagatcatgaacgcgttgctgctgcccatcgtgctgggcctgctgctggcgctggaagcccgggcgctgcccgagcagtggcgcatgcgtggcctgcacaagcacgtcacccgcgcgctgtgcctggtgaccatcggcttcggcctgtacatggtgccgcaggcgctcggctgggcctgaggtcagaaccacggcccggggtagtggccgtcgcggtcttgcaccatgacgatccttacctttcttgaagggtgttcggggccgtcggccttaggcttcgaattgcccagggacgtcgggtatggctttcatgtggttgctgtgttggatggccgaaggagattggccgcccggcgtcccgcgacgactcgaccgctaattgagagatgcgattggatcgctgtgtaaggacacgtcggcgtggtcgtctgctgggttgatctggacaatgacggttacggaggtggttgtggcacaacctgtctgggcgggcgtggacgccggtaaggccgaccattactgcatggttattaacgacgacgcgcagcgattgctctcgcagcgggtggccaacgacgaggccgcgctgctggagttgattgcggcggtgacgacgttggccgatggaggcgaggtcacgtgggcgatcgacctcaacgccggcggcgccgcgttgctgatcgccttgctcatcgctgccgggcagcggctgctttatattcccgggcgcacggtccatcacgccgcgggtagttaccgcggcgaaggcaagaccgacgccaaagacgctgcgatcatcgccgatcaggcccggatgcgccacgacttgcagcctctgcgcgccggcgatgacatcgcagtcgagctgcgcatcctgaccagccgacgttccgatctggtggctgatcggacccgggcgatcaaccgaatgcgcgcccagctgctggaatactttccggcgctggaacgcgccttcgactacaacaagagccgtgccgcgctgatcctgcttactggctaccaaactcccgacgcgctgcgcagcgccggtggcgctcgagtagccgcgttcttgcgtaaacgcaaggcccgcaacgccgataccgtcgcagccaccgcgctgcaggccgctaacgcccaacacagcatcgtgcccggccaacaactggcggccactgtggtggcccgcctggccaaggaggtgatggccctcgacaccgaaatcggcgacaccgacgcgatgatcgaggagcgatttcgccgccaccgccacgccgaaatcatcctgagcatgcccggattcggcgtcatcctgggcgctgagttcctcgccgccaccggcggggacatggccgcattcgcctccgccgaccgcctcgccggcgtcgccggcctggcgccggtaccacgagattccggccgcatcagcggaaacctcaaacgcccccgacgctacgaccggcgcctgctgcgcgcctgctacctgtcggccttggtcagcatccgcaccgacccctcctcgcgcacctactacgaccgaaaacgcaccgaaggaaaacgccacacccaagccgtcctcgccctggcccgccgccgcctcaacgtcctgtgggccatgctgcgcgaccacgctgtctaccaccccgcaaccactaccgcggcggcttgacaacgtcattgagaatctccttgcactccccgttggcgcccggtgcggtctcgccgcggcacaccagtgtccatccggagatccgctggaacgggcgcagcgcccagttggatgcgacgggatctcccgcgggcagggcgatgacggagaacgttccgccgctgccggtgaggtagaggtggtcttcgaagaacgccaccttggcaagcgacagcttcctggcgtcgtcgcggttcttcagaaagtcccactgctggccgcgcaggttccacaccccgaacccgaattgggaattgtcgcggttgtggccgtcgacgaacagtttcccgtccgagagcgccgcggtcagcccgcctcccgaaatccgttcggagtcaccgattttgatgaccgacttggcgtcgaggtcatagaacagcgtcgacacctcggcggggttggccggatcccgacgggtgagctgcaccaatttgcttgagccgtcggtcaattcggcgtcgacggacacgacgtcgttgtcctggtagatctcttccccgccgggcaggcgcagccgggttcccggagtctgggcgggatcgccgctgcgggtgaacgccagcacgtccggccagacccgggcgggctctggatcgctccacagcgtcgacaggtcctgacccgacagcaccacggtccgcggtggcgccgcggcggcgtggccgtcggtgacggcgttcagccacgccacgcccgaggcggtcgaggccagggaccagtccttcggcgcggccagccgctgatcgggggccggtgcctgcaggtccttggtgaccagcggctggccgctcgtcaggtcgaaaacgtagccgatagttttggcggcggtggtcacgatgtacaccacccgcagctgctctgccgtgcccgtcagcgcgcagatcgcgccggtcaccgtctcgccggccggaacggacgggacaccgggcgccaggtactgtccggtcttcgggtcgaacaccttcggccggatgtcctgcagcgcggacttgctaaacgaaaaccgttgcgggcaaccgaaatacgcggtaccgccgtagcttttccagtccttttccagcgggcccgtcatcgagggtgcggcggccgaatcgggcccggctttggacgtggacttcgacgtcgaggtggtcgcgctgagcggcggcgcgggcacggtgtccgaacacgacgccagggccaggcaccccagcgccgccagcgcggcgcctcggctcgcggccggtcggcgtcgcgccgtggagcgccgggctgcgcgcatgaaaatcccccagtgagttcgtaaccacaggagcgtacggccgccccggcccgttgcgcgactcgtgcgccccgcggcgattatcggtcgaactcgatgggcaggctcgtcggcccgctcaggctcaccatcggcttccacggcgccggcccggccagccgcgggttgcgcagccggttggccagcacgttgagcgcctcggcgatctcccgccgggccaggttggcgcccaaacagtaatgcacgccgccgccgaaggtcaggatgggcggtgccgcctcgcgggtgatgtcgacccggtcggggtcgttgtagaccaccggatcacggttggccgcaaaggtattcaccagcacggcggtgccggcggggaacaggtggccgtcgagctcggcgtcctcgacgaccaggcgcagcgtcccgcacgcgatcggcgaatgccgcatggtctcctcgacggcgcgcatcgccagctccgggcgctgccgcagcagctcccactggtcggggtgctcgcagagcacctgcaccgaggcggccacctggttgcgggtggtgtccgtgcccgccagcagcaggccgcccgccagcatgcgcagctcggcggcgtcgaggcggtcgccctcgtccccgacgcggatcaggtcggagagcaggtcgtcggtcaggttgtgccggcggcgcgccaccatctcgtcgacgtagtcgtcgagctcgcgccacgcgcgcatcacgaccggctcgacctcgcgcaggtcgacggtgaagctgaacgccttgaacacgtcgtcggcccacgacgagaaccgccgccagtcctcgcgcggcgcgccgagcagcgcgcagatgatcggcacggggtaggggcgggcgatgtcggtgacgacgtcgcagcgacccgccgcggctacccggtcgaccaactcgttcatcacggcggccatggtgtcgtgcaggcgggcgacagtgcgcggggtgaacgccttggagcacaggctgcgcagtcgatggtgcgcgtcgccctccaggcacagcaggctgttggcgaccttgtcccacagcgggcccgagtcgatgccctgggccagcaaattgatgcccggcggaatctggaaccgcggatcccgcagcacggaccggaccaggtgataggagagcacctccgggccgtgcggcccgatcgccacggcggcccgccgctgcgcctcgcgcagccgcggatagacctgcgccggtgtctcgtcggagtgatagtgcagcgtcggcaggtcggagtcgaaaacgcttggcggagcggcaccgacggtcatcgcggtctcctcatcgaccccgcagcacgctgcggacgactttcagtcaatgtatggccaggtcgggggagtgtcaacgaccggcggcgccgcaggcacgaaacgccatacaccagacgaaaaatgcatggccgggattgggccgggatgggctgggacgggccgggttcggccgggatgggtcggggcggcgaattcactcgtgcgggcgaagccgcaccatccgcgtcgtcgacgtctcgtccagctcgacgacgtcggagcgcgaccgcaggaaatcgctgaacgagcggaaacccaaagacttttcgctgaacgacggatccatccgcttcatctgggccttgacggccgagttgtgcagccagtcgacgtcgtccttctcgaaaccgatctgcagcgcgcgggtcagcagcgcggtggccgcggcctgcgggtcgggttcctcgggttgggccgccttgccgcgccgggtgcgcggtttggcgggcaccgtttcggccggcgcgggggtgcggtccagcgccgttaccccgggcagcgcgtcgtagatgacgaactcgtcgcacgccgccgccagcgcccggctcgacgcgccggccaccccgatgccgaccacgtaccggcccagccgcttgcagcgctgggccaacggaatgtagtcggagtcgccggcgacgatcaccacatgcgtcaggtcgggcagccggaacatgtcctccactgcgtcgacggccaaccggatgtcggcgccgttcttgccgtaggcggcggccgggaacagctgcaccaggtcgaccgcgcgggccaccaactggccgcgatacccggcgttgatctcggccgaccagtcggcataggcgcgggtgagcaccagcgtgccgaacgacgacgcgaaatccaggatcgcgccgacgtcgaccgtcgcctgctcgagccgctcggtgaactgctcgagccccttggccttgtcccgctggaacgagttccggccgtgaatctggtcgtagcgggagatcacgatgttgtcgaagtcgaggtagacggccacgcggggggcaaccggttcggacatgccttcgatcattgccgagatagacggcctcgggtgggtatccgagccacatgagcgagctgaagtttctcgaactgcacggcgaccgcgtcgccttccgcgaccagggggagggcgaggtgctgctgctcatccacgggcatggccggcagctcggagacctggcggtcggtgataccgccgctggccaagaagttccgagtcatcgcccccgaccctgctcgggcacggcgagtcggcgaaactgcgcaccgactactcgctgggtgccttcgcggtctggcttcgtgacttcctcgacgaactcggcgtcagccgggccaccgtgatcggccattcgctcggcggcggggtggccatgcagttcgtgtaccagcaccccgattacgcccagcggttgatcctgatcagcagcggcggcctgggcccggacgtcggatgggtgctgcggctgctctccgcgcccggcgcggagctggtgttgccggtcatcgcgccgacgcccgtgctgtccgtcggcaacaagctgcggtcctggctgcgcggcgccggcatccagtcgccgcgcggggcggagttgtggaacgcctactcgtcgttgtcggacggcgaaacccgccaatcgttcctgaagacgctgcgatcggtggtcgattaccgcgggcaggcggtcagcgcgctcaaccggctgcagttgcgcgaggagctaccggtcatggcgatctggggggagcgcgacggcatcattcccgtcgaccacgcctacgccgcgcacgaggcgcgcaccgacgcccggctcgaggtgctgcccgacgtcgggcacttcgcgcaagtcgaggcgcccatgcgggtggtggagctgatcgaggacttcatcgccaccgatgagcgccgcgatgcgacgagcccgcagcccggctaacccgccggtggcaaacgtggccccgtccgtcagcgcggcgcggcggtggttgtcctgacgtcttcgtggccaccgagattggtggccgtgctgatgacggcccgctcgatctggcgcagggcgtgcacggcggtcaggaatcgccggacgtcgggccgtgtctcgccgtcaccgtcgctgtcgtgctggcgggccgcggtttccgcggcgtcgagttcgtcggccgccgagaccaacgtcggcgggtggccactgtcgatcgcctccagcaaggcgtcgaggttgcgccgcgtctgggccgcggccgccgaaaaggcttgcgccagttgggggccgggcccgggcgagccgcggtactgctcgctgctgcgcgccagcgcccggccgtaccggtcgcaggcggtgaagatccgcagcgcgcggcggatgccgcggcggcctgcgagcccggcgacaccggccagcagcggcttggcggtcacccggaactgctgcaggtcgcggtccagctgacgtgcctgctcggacgggctggccgcgctgccggacatggccgccgcgcaggcctcgatcagcgcggacaggctggtcagaaaggcccgggtgtcggcgcggatcgcggtccgggtgttggtcggcagcaccacgacggccaccgtcgcaccgatcaccgcgccgagcgcagtctcttcgatgcgaagcatcagcaccccgaacgagaactggccgagcagcccgtacagcagcgccagcatggtggtgatccagaacgtcatcaggctgtaggtcaccgtcatgaaatagaaggcacagaacaggcacacgaagatgccggccagcgcggccgcctcgtgtccggtcagcagcgtggccaccagcacgccggcgggcacgccgagcatcgtgccgagcagccgctgccagcccttggtcagggtttcgccccacgagttggtgccggcgaagatgacgaacgcggcgatcacggcccaataccagcgggccggcgacaccagctcgccggtgatgatggccagcgacgccgccaccgacacctggatggcctgccgggtggtgggccgcagacccgccggttgttcttcttcttgctcggcgggctcctcggccgcggcgccggcggccgccggcgggcgctcgctgccggcgacgtcgggcaccgcggcgccggcggccccgtcgacgatggcccgcacgtcggcggtcgccgtcgcggcgttgatgatcgccagggccagccggcgcaccgcggtgccggcgggccggtcgtcggtggccgcgtccagcagccggcgcgctcggctggcggcgtcgcgcaggccacccggttcgggcaaccggatcgcgcggcccaattgggttagcgccgagaccaattcggcgcgcgcggcctcgggtaactcggcgcccagggccgcggcccgccgcccggccgtcgccacccactcgatggccagctcggcgtccagcagccagggggccagctgttcggcggtgactccgggccacagcgtgcccgggtcggccctgtcctcgatctggctctgcaccatcagggcggtctcgttgagccggatggtgcgggcccgcatgcgccggcgccgccgctcgtccagccggccggtgcgcaccgcctcggcggtggtgtcgatcacgatcgccatgcgggcccgcagcgcccggatggtggcccgcagcacccgctccggccggtcgggcagcacatggctagtcatcacatacgtgcacaccgtgcccagcgcgcggccccgcgcgccgaagcggcgaatgtaggccgccgcgaacacaatcagcacgaacaccacgtcgccggccaccgggtgcggcgccagcaccgcagcggccgtgatggccaccgcggccggaaccggcaacagcgccatggtgatccgctgctggcgcggatcgggctcgttgaccgagcgcgacgcgaccatggtgatcaccacacccagcaacgcgacggtcaacggctgtcccgtcgccctggtcagcagccacagcgccagcagtgacagcccgagcgcggccgtggtccgagtcgccatgcgcagccgcagcaagccgggatcggagccgatcacccagttgcgggcgcgttcgtagagatccgttattccgatgaccgcctctcttgcgcgtaccccccatggttacccgaaccgcgcggcggcgaccaagctagtgttcgacatcatggggccgacgcgggcgaagctggctgacggtcgcgacctgctgttcttctcgctgcccgggcaccgcgcttcgccggtcgaagaccgccgccccctgccgccccgaaccgccgaaaccgttgcgccgggcggacagtcgcagctgcggttcgaccggtccaccgggcagtgggtgatcatcgccgcgctgcgccaggaccgcacctacaagccgccgcccgacgcgtgcccgctctgccccgggccgaccgggctgaccagcgaggtacccgccgccgactacgacgtcgtggtgttcgagaaccgctttcccagcctgtccggtgcggcaccggggctgctggccgccggcgccgacgggttcgtgtccgcgcccgcgcacggccgctgcgaggtggtctgcttctcggccgaccacaccgggtcgttcgcggggctgccacccgcgcacgcccggctggtggtgcaggcctggcggcatcgcaccgccgagctgatggacaccccgggcatcgagcaggtgttctgcttcgagaaccgcggggaggagatcggggtgaccctgacccatccgcacggccagatctacggctacccctacctgaccccgcgcaccgccgccatgctgggccaggcggacgagcatcgaaaacgccacggcggcaacctcttcggtgacctgctggcccgcgaggtcgccgacggcagccggatcatcgcgcgcgacgacctgttcaccgcgttcgtgccgttcgcggcgcggtggccggtggaggtgcacatctacccgaacaggttcgtgcccaacctgaccgcactgcgcgacgacgaggtggacgggttcgtggccgtctatctggacgtgctgcgccgcttcgaccggatgtatgacgcaccgctgccctacatttcggcgctgcaccaatacaccggcaccggtgctcaggcccagggctacttccacgtcgaactgatgtccatccggcgcagcgcgaccaagctcaaattcctcgccgcctccgaatcggcgatggacgccttcatcagcgacgtcaccccggaaagcgtggcccagcggctgcgggagctgcgatgaccgtccgctacgctgcgcccggccggatcaacctgatcggcgaacacaccgactacaacctgggtttcgcgctgccgatcgccctgccccagcgcaccgtggccagcttcacgcgcgccgacgacgatgccatcacggtggtcagcgaccgcgcggacgcgccggtgcggatcccgatcgacaccggccccggcgacgtcaccggctgggcggcctatccggccggggtgatgtgggcgctgcgcaccgccggccacccggtgcccggcggggtgatgtcgatcaccagcgacgtgccgatgggttcgggcctgtcgtcctcggcggcgctggaatgcgccgtgctgggcgcgatctcgtcggccgccgggattcgcatcgacgccaccgaacaggcccggctggcccagcgcgccgaaaacgaatacgtcggcgccccaacgggtttgctcgaccagctggccgcgctgtacggccgcccggccaccgcggtgctgatcgacttcgccgacctggccgtcacaccggtggccttcgaccccgacgccgccggggtcgccctgttgctgatcgactcccgggagcgccacacccacgccggcggcgactacgcggcccggcggctgtcctgcgagcgggcggccgccgacctgtccgcgtcctcgctgcgggaggccgccgaccgcggctgcaccgacctggccgcggtgcgcgacgccgtcgacgcccgccgcgcccgccacgtgctcaccgagaaccggcgggtcatcgattgcgttgcggcgctgaacaattcggactaccccgaggcggggcggatcttcaccgcctcgcatgcctccatgcgcgacgacttcggcatcaccaccgaacgcatcgacttgatcgccgacaccgcgctgcgcgccggcgcgctgggggcacggatgaccggcggcgggttcggcggctgcgtgattgccctggcgccggtgcagcgcgccgaggcgatcgggcacgcggtccggcgggccgcgacgcaggccggcttcgcgcaacccgtcgtcacccgaacccgcgccgccgcgggcgcgggcccgtgccggtgagcgagccggccggctacgtggaggttcgggcctacgccgaactcaacgactttctgcccgccgagtcgcgcggcgccgcggtgcgccgcccgttccgggcgcaccagaccgtcaaggatgtgttggaggcgatgggaattccgcacaccgaggtcgacctcatcgtggtgaacggctccgtccacgggttcgaccaccgcccccgggccggcgaccgcatcgccgcctacccgatgttcgaggcgctcgacatcgggcccaccgcccggctgcggccggtgccgttgcgcgatccccggttcgtcgtcgacgtcaacctgggccggctggcctggctgttgcggctgttcgggttcgacgtgtggtggtcgaacgacgccgacgaccagaccctggccgcgatcagcgccgagcagcaccgcatcctgctgacccgcgaccgcggactgctcaagcgccgcgcggtcacccacggactgttcgtgcgccccgacgaccccgaggagcaggcgctgggcgtcatccgccggctcgacctgaccgggcggctggcgccgctgtcgcgctgcgtgcggtgcaacgcgggaccctgaccgcggtcgccaaggacgaggtgagcgaccagctgccgccgctgacccggcggtactacgacgacttcagccgctgcacccgatgcggccgcatctactggcccgggtcacaccacgcgaagctgctcgccctggtggaaagactgcgacggcagctgtagcggcgaaacttactcgcccggcaatttcaccgttttggcggtgaccgctggtcagaaaatgtaacctgaccgccatgggggcagttgactcctgcacgcgccgtgccagttctccggggccgccagtggcgatccgcgccggatcgctaccgctgtgcgccgccgctctcgacccgaaatgtccgccgtggcttggaatctagacgggcaggccgcggcgctggagcggggcctggccggcgccaccccgcagcgggtgggctggttccgcttctacttcgagggcgaacgctgggtgtggtccgaccaggtgcagcggatgcacggctaccaacccggcaccgtcacccccaccaccgaactggtgctgtcgcacaagcatccggccgatcgcccgcaggtgatcgacggcatcaacgacatgatccggcgccggcaggcgttcagcacccggcaccgcatcgtggacaccgccggcatcatccaccacgtcgtcgtggtgggcgaccagctcttcgacgacagcggcgagctcgtcggcacccacggcttctacatcgaagtcaccccggccgccacccgcaaccgcgaggactcgatcagcgccaaggtctccgagatcgccgggcggcgcggcgtcatcgaccgcaccaaggggatgctgatgctggtctacggcatcgacgaggacgcggcgttcaacatgctcaaatcgctgtcccagcacggcaacatcaagctgtcggtgctggcgcaacgcatcgccgaagactttaccgcgctgggcaaggaggtcatcaccgcgcgctcgcggttcgaccagcgactgcgcaccgcccacctgcgcccgcccggcgccggcgaggccggctccggctgaacgccgccgccgtcagcccgtgatggtggtctgctcgtcgatgatgtgggtggcgtccatcaacgggccctggtcgctctccagcccgtcggcgttgagctgcagcacgtagaccgcgccctggctggggatcaccaccgtcttctgcgcgatgacgcgggtcttgccgccgcgctggtaggtgccgcccaactgccaggcctggtaaccgcccagcgtggacgccgagccgtcaccgctgccggagtacccgggcaggttctgcacctcgcccggggcgtactggatgatcttcgccgggtcgacgtcgccggtcagcttggagaacagcgccgacacggtgggcgggtcggacgggtcggcgggctggctctgcacgatgccgccgtaggaggtgccggagttctggttgagctgccagccggcgggcaccggcaggtcgacgttcgggccgggatcgccgcggtggaccggggtctcggagatgtggttgtccttcacgtagtcggcgatggtgtatttggcttgcgccgccggcgcggtgctggatttcgaggacgtcgccgtcgacgtggaggtcgaggtcgacgtcgacgacgacgttttgtcaccggatttgtgatcgtggccgcagcccaccagcgctaaactcagcgccacggaaatcgttgctagagtcaagtgtttcattaatccaatctcccgacaattggggccgttacctgcggccggccgcgctgccacgacagtagcggaaatgctttgaaagtttgccggcatcttttggactttttgctggcgcccggccgcgcgggccggccggcgatcgttatccaattagtggccgaaaacgccacggcaatacaccgccaaccaccggcgatccagtattagacaggtatgcggtcgcgaatggccccgattgcgctggtcgcgaccctggccgtggtgatgacggtgatcgcgccagcgccgccccggggctacgacggaccgccgctgttcgtggccaatcccgtcgaccacgtcgtgacgctcatcggcaccggcaccggcggcgagacggtgggggagatcaacaacttccccggcgccaccgtcccgttcgggatggtgcagtactcgccggacaccgccggcaactacgccggctacaactacgacaacccgcgggcgaccgggttcagcatgacgcacgcctcggtgggatgcgctgcgttcggcgacatctcgatgctgccggtcaccggcgggctcggcgtgcagccctggaacgccaccgaacgcatcgcccacgacgacaccgagcgcggggtgcccggctattacacggtgcgactccccggcgccggggtgaccgccgaactcaccgccaccgcgcacaccggcgtcggacggttcagctacccgggcgacggccggcccgccctgctgcaggtgcgttccggctcgtcgctggccggcaactcccgcgccaccatccagctcggcgaggacaacaccaccatcaccggctgggccaccagcggcggcttctgcgacaagcccaacgcctacaccgtgtacttcgcgatgaagttcagccggccgttcatctcgtacgggtcctgggacggcagcaccgtctaccccggggcccgcagcgcgaacgcgccgtacagcggcgggtacgtcgagttcccggccggctcggtgctcgaggcgcgcaccgcgatctcctacgtcggcatcgagggggcccgggccaacctggcggccgagggcaacgccggtttcgacgacgtccgcgccgccgcggcccggcaatggaacgccgcgctgtcccgggtgacggtggccggccgcaacaccgacgacctgaccaccttctacaccgccctgtaccgaaccatgttgcaccccaacatgttcaacgacgccgacgggcgctacgtcgggttcgacggcggcatccaccgggtggccgacggtcacgtccagtacgccaacttctccgactgggacacctaccgctgcctggcggcgttgcaggcgttgctgttcccggaccgggccgccgacatggcccaatcgctggtcaccgacgcccagcagagcggcgcgctgccgcgctgggcgttcgccaacgccgccaccggcgagatgagcggcgacagcgtggtcccgctcatcgttaacctgaacacgttcggcgccaacgacttcgacaccgccgcggcgctgcgctacatggtggacggggcgaccaagggcggggtgggcctggccggttacgtggaacgccgcggcatcgccacctacctgcggctgggctacgcgccgttcaccctggaattcggccgcaacggctggatcgcggacgcgtcgatcaccctcgaatggtcgatcgacgacttcgccatctcccggttcgccgactcgctcggcgacgccgccaccgccgccgaattcgcgaaccgggcgcagtactggcagaacctgttcaatgccagcacccgatcggtggtgccgcgcagctggagcggattcttccgccccgggcccgcggtcgtggtgtccccggacaacttcggccaggtcgggtacgacgagggcaacgccgagcagtacgtgtggtcggtgccgcacaacgtcgcgggcctggtgaccgcgctgggcgggcgcgccgcggtggccgagcggctcgaccggttcaccaagaaactcaacgtcggtcccaaccagccgtacctgtgggccggcaacgagcccagtttcggtgtgccgtggctgtacaactacatcggccaaccgtggaagacccaacacaccgtcgaccgggtgcgcgggctgttcggtccgaccgccgacggcgaaccgggcaacgacgacctgggcgcgctggccggctggtacgtgtgggcggcgctgggactgtacccggccaccccgggaacccccatcctgacggtggccgcgccgctgttcgaccgcatcgaaatcgcgctgccggcaggcaaatccatccggatcgccgcccccggcgcgtccgggccgcaccacccggcctacatcagcggcctgaaggtcgacggccggcccaccgagcacacctggctgcccgagtcgatcatccgcaccggcggcacgctggcgttctcgctcgcggcctaccccgacaagcattggggcacggccgaatctgacgcgccgccgtcgttcggggcggggagttcggcggtggcggtcaacgtgccgcaacccgtcgtcagcatcgcgcccgggcaccgcggcagcgtgaccctggacgcgcaacgcatgatcgacggcgccggtgcatacaccgtctccggcgccgcctccgaccccggcgtcgccgtgacgcccacgtccggccaattcgacgccggcggggcggcgtcggtgtccgtcccgatcaccgtggcaccgacggtgccccaggactactacctggtgtccttgaccaccaccgtcggccaaagcacccgcaccacaacggttctggtggacacccaggccgaaccggagagccgttgaccctcagaccatctcgtgcttggtcagccagcgcatcaccggccagccgacgaacaccggcagccagcaggtcagcatccgatacagcagcacggccggcaccccgatggccgccggcaccccgaacgcggccagcccaccgatcagcgccgcttcgaccgccccgacaccgccgggcgtcggcgcggccgaggccagcgtcccgccgaccatcgtcaccacggtgacggcgacgaacgtggtgtcgccgccgaaggcctgaatgctggcccacaacgccagcgccgcaccgagagtcgttcccgcgcaacccaacaggatcagagccagccgccgcggttcgcgggcgagcttggccaggtcgctcaccacctcgtccagcttcgggcgcacctcggtggccagccacctgcgcagtgtgggcacgaacaggaaggtgccgacgatgcccagcgccacacccgcgatcagatacagcatggttgcgctgggcacgaaatgcgacagattcatcgatgcgccggccgccgcgctgaacagcaccagcagcgccagatgcgcgatcacctgcaccgactgctgcagcgcgaccgccgcagtcgcccgcatcgccgacaggccgctcttttgcaggaagcgggtggacaacgccagcccgccgacaccggccggcgtggtggtcgcggcaaaggtgttggccacctgcgcgattgacagcatccagaagttcaccatgccgtcggcgcaggcccacagcgccgcggccgcgccgacataggtcagcgccgacaccagcaagcccagcagcgcccaccaccagtccgcggtgcgcagctgggagaagaacgtcggcgccgtgctgatgaacggatacgcgacgtagaccaacgccccgaacagcaccagctgaatgatctggctgcgggtgaaccgggtgatggtctgcggtttgatctggtcggcgcccgtttgccgcttcacctcggcgcgggcgcccgagatgacggcccccgagtcgggcgccgaacgccgaaccgatttgggcacagcgactttggtgagccgccgggacgccgacaaaatggtgtctgcgccgaagacgtcgatggcggcgcgcaccgcggacttcgggtcgtagtgcgccgacgtcgtcaccaacagctgcgcgatgtcggattgcagctgcgcctcggtggccccgtactcggcgctgccgaagccgccgaacaacacggccccgtcgtcgacggtgatgtggtgggcgcgcaggtccccgtgggcgatctggtggtcgttgagcacccgcaacgcctcccagagccgttgcaccggtgtggtttttgcgcatcggtcgatgggcgtgccgcgaggaggcttgtgcgagtacagcatccagccccggtccagggtggcgacggccaccgtcgcggtgttggccaggccggcctcgccgatcgcgatggccatcagcgcgcggtgctccaccgcgcggcgcatcgaggtcagcagcggcgcggtctcggcgtcgcgcagcttgagcttgccccacagctggcgcaacgccccgccgctgcgttggtgcgggccgtacaactcgatcagggccgtgtggtcggcgtcctggccgtcggcggacagaatgagcgggccgcggccggccggccggaccacggtgagccggcaaacctcgaaaccggccttggccaacgcccgcaccgcggcgtccagcggaacctcgagcgccggcgtgcccacgacgagcaccaccagcgccccgaccacccagccgaccgccaaaccgaccagcgagcgcgccgggacgatcgcgctgaccacaagatggatcggcacgaacgccagcagcagcgcccaccaccagcgccgccagcgcgccggcagccacggacccgacaccgtcagcaccgccgccagcatcccgatccagcgcgggtcatcgagcaattgcgccggcagcgtggtgagccggtcgaggacgtcgaaatgccatcgcggcgcggccaatccggtgccgctgatcgacaacaagacgatggcgctcagccccgcggcggcgtaggcgcccaacagcttccactgcccggccgcgatgagaccgatcaggatcatgaacggcaacgccacgatcgccaacccgtacaccaggtagacgacatcggattgggtgggcgagaggacaccgacgatctgggagaccgatttctccagcgcgatccactgcgggcgggtgatcaccgaacccgtgatcaccaccgccaggaagatcagcgccatcccgagccgcaggatgtcgttggtccgccgggtcagcggctgcagcaagctgccggagacgatgatgtcgcgcccgtcaactcgcatctatcaacgatcctccggattcgcccggcatcgccgacaccgcgctcacggccgctgatcggcccgccgacaagttaactcaatccccgcttggttgacagctcccactcatgcagcgcgcgtagggtcgtataggtagccgagctagcgaagtggggaggaggcgcacgtgccccggaccgacgacgacagctgggagatcaccgagagcgtgggggcgaccgcgctcggggtggccgccgcccgcgccgccgagaccgagagcgagaacccgctgatcagcgacccgttcgcgcgggtgttcctggacgccgccggcgacggcatgtggaactggttcgccgcgcccaacctgcccgcccagatcgccgaggccgaacccgacctcaagccgcggatgcagggcatggtcgactacatggccgcgcggacggcgttcttcgacaacttcttcctcgcggcgacccacgcgggcgtccgtcaggtggtgattctggcggcgggcctggactcccgggcgtggcggctgccgttcgaagacggcacgacggtctacgaactggaccagccgcgggtgctggagttcaaggcgacgacgctcgccgagcacggggcccggccgacctgccacctggtcagcgtcccggtggacctgcgccacgactggccggccgccttgcgccaggccggattcgatgcgcacgcgcccagcgcgtggtcggccgagggcctgttgccgttcctgccggcggccgcccagcagctgttgttcgagcgggtgcagaccctcgccgcgccgggcagccggatcgcggtggaggcgcccggccccgacttcatcgacgaggccgcccgcgagcggcagcgccagaccatgcagcgggtgcgcgacctgatggccgacctggagcccgaccgcgacatccccgacgtgcaagacctctggtacttcgaggaacgcgaggacgtgggcgactggctgggccggcacggctgggacgtgacggtcaccccggcgcccgaactgatggcccgctacgaccgcagaccaccgcacgacatcgaagacgccataccgcagacgcggttcgtggcggcgcaacgcacggaaaggacccgacccgaccgatgagcacagcccggagcgacgacgacagctgggagatcaccgaaagcgtgggggcgaccgcgctgggggtggcctcggcccgcgccgcggagactcgcagcgaaaaccctttgatcaaagatccgtttcgcacaggtcttcctggacgccgccggcgacggcgtgtggaactggcactccgcgccgcagctgccgcccgagctgatcgaggccgaaccgaccataccgctgcagcagcaggccatggtcggttatatggcttcgcgcacagcgtttttcgactcgttcttcctggaggcaaccggtgcgggcatccgtcaggcggtgatcctggcggccgggctggacgcgcggtcctggcggctgccctggccggccgggaccacggtctacgagctcgaccagccccgggtgctggaattcaaggagtccaccctggccgaacacggggcgcagcccgcctgcaaccgggtcgccgtgccggtggatctgcgccacgactggccggaagcgttgcggcaggccgggtttgacgcgtcggcgcccagcgtgtggtcggccgaggggctgatgccgtatctgccggcggccgcccaggacttgctgttcgaccgcattcagggcctcaccgtcgccggcagtcgggtcgcggtggaggcgttggggcccaagttcctcgacccgcaggcccgtgccaagcgccgggaacggatggaccggatccaggccctgatggcacggatcgatccggatcgggcggtgcccaggaccgacgagctgtggtacttcgaggaacgcgaggacgtcggtgagtggttcggccggcacggctgggacgtgcgcgtgacgccgtcggacgagctgatggccggctacgggcggggccggcgccggccgaggtccgcgacttcgtgccggggaacctgttcgtcgccgcgcagcggcggtagaccagaaggcctagcctttcggcagggtgaaagccgagcgcgccgccaccgacgcgatgtggcgggtcagcatggcttcgggaaccagtgcggtggcccggattgcggcagcgctcagcaccgccgggcgcaggttgaccaccctgcccaacagcgcggattctccgacgatgcgccggacgcggcgccggcggaacgcggcgaaccgggcgaacgcggtgggcaggtcgtccgcctggtcgacgcacgcggccagcaccgcggcgtcctcgagcccctggcaaccgccctgacccaggtgcgggcgcatcggatgagccgcgtcgccgaccaccacgacgggcccgcgcgcccaggtccgggcgggggtgcggtcgtaaaggtcgttgcgcagcacctcgtcgcgggccgtcgctgccagcatcctcggaatcggttcgggccaattggcgaatcttgcttgcagatagggcaattcgccgccaggcgagagctgcccttccgaagcgcgctcggtggcgaaccaatacaggcgatccgcacccatcggcacatggccggtttcgacgccgggaccaagtgtctcgccggccaactcggggtccatcgcaggtcgccacaccgcgccatgcggtgtagccgacgtaccggtcggcgagcgggccgttgaggtggcgggccaccaccgagcgggtcccgtcggccccgatcaccgcatcggttgtgcggtcgttgccgtctgacagccggacccgcacgccgtcggccgcgcgcgtgagtttgatagcggagagcccgtattcgatggtttcgggtgccagcgcgccggtcaggatgtcgcgcagtgccgagcgttgcacgatcaccaacggttcgccgagcgccttgatcaaccgctcgggggccggccgacgcagccacgagccgtctcgccaacgcaacgcgcccgccgtgatgcggccgccggcatcgcggacagcctggccgacgccgatgcggtccaacgcggccagcgcgttgggccagatgctgatcccagcgcccgaggacgtgtcggtgcgctcctcgacgacggtgactgcgtatccgcgccgctgcatcgccaccgccgtcgccaggcccgcaatgccggctccgatcaccaggatccgttgcgccatggagtcgaacctaacgccgcacggtgccggcacagaaagcagtcacccggtagaagagtatgtgtgacccggcggcgagagaaggtatcggctgctcaacggccgtccgaagcttcggtccgcttacggtcgaggaacgtgtcgaagtcgaacggcgtcgaggtgccgctgcgttcgccggcttcgagagcttcgcgcagcgcccgtagctgggtttcgcgatcctcgagcagccgtagcgcggagcgcacgacgtcactggccgaccggtagcgtcccgaggcgacctcgctctcgataaaggcgctgtagtgctcgtcgaggctgaaagacgtgtttttacccacaacgcttaccatgccaataattggtatcgcgcgcttgccggcgggttgggtgagtcgcggaaagatgcgcgacacgccggtggtctgaccacctgactggccgtcggcccgccacactggccgcatggcgctgcagccggtgattcgccgatcggtgcccgaagcggttttcgaccagatcgccaccgacgtgctcagcggtgagctgccagcgggttcggcgttgcccagcgagcgccggctggcggaggtcttcggggtgtcgcgccccgccgtccgcgaggcgctcaagcggctgtcggcagccagcctcgtcgaggtgcgccagggcggcgtcacgacggtgcgcgacttccggcggcacgccggtcttgacctgttgccgcagttggtgtttcgcgacggcgaactcgacgcgggggtgtttcgcagcattctggagacccggctgcggatcggtccgaaggtcgcggaactggccgccgaacagcacggcccggaactggctgcgctgctcgacgattcgctgcgccggctggaggcctcgcgcagcgcggtcgagtggcatcgcggcactctcgagttctgggatcacatggtcgacagctccggctcgatcgtattccggctgatgtacaaccctttccgcgcggcctatgagcgagctgtgggtgtgctggccgccgcgattcccgccgagatcaaccgcaccgacgcgtatcgtgcactggcccaggcgatctgcgccggcgatgcggacgaggcgggccgcggcgcccgcgaggtcctcgaactcgccaacgccaccatgatcggcgcgctggagcggcgatgagcagccaagccgtgatcgcgaactacctgcggggccagattcagcccgggatagacgcggtcggcggcttcttcaggacgtgcgtgctgaccggcaaggcgttgttccggcggcccttccagtggcgggagaccatcgagcagggctggttcatcaccagcgtctcgctgctgcccaccctcgccgtcgcgatcccgctcaccgtgctgatcatcttcaccctcaacatcctgctggccgagttcggcgccgccgacatctccggcgccggtgcggcgttgggcgcggtgacgcagttgggcccgctgaccacggtgctggtgatcgccggcgccggctccacggccatctgcgccgacctgggagcgcgcaccatccgcgaggagatcgacgcgctggaggtgctgggcatcgacccgatccaccgactggtggtgccccgggtggtcgccgcgaccatcgtcgccaccctgctcaacggtgcggtgatcaccatcggcctggtcggcggattcgtgttcggcgttttcatccaacacatttcggcgggcgcctacgtcggcaccctcaccctgatcaccggcctgcccgaggtggtgatctcggtggtgaagtccgccaccttcgggaccatcgccggcctggtcggctgctatcgcgggctgaccaccaagggtggtcccaagggggtgggcaccgccgtcaacgagacgctggtgttgtgtgtgatcgcgctgttcgccgtcaacgtggtgctgaccaccatcggcgtgcggttcgggacgggccgctgacatggcggcgatctccgcgcccggcgccctgcgcgcccgctacccgcgaaccgcggccaacctcgaccgctacggcggcggaaccgtccgaaggctttggcagatcggcattttcgctcggttcgcccggatcagcatcggccagaccggctgggcgttgcgccactaccggcgcgagacactgcgcctggtcgccgagatcggcatgggcaccggggcgatggccgtggtcggcggcaccgtggcgatcatcggcttcgtcaccctgtccggcggctcgctgatcgccatccagggtttcgcgtcgctgggcaacatcggcgtcgaggcgttcaccgggttcttcgccgcgctggccaacacccgcatcgccgcaccgatcgtcgccggggtcacgctggccgccacggtcggcgccggcgccaccgcccagctcggcgccatgcggatcagcgaggagatcgacgcgctggaagtcatgggcatcaaatcgatttcgttcctggtgtccacccggatcctgggcgggctggcggtgatcgtgccgctgtacgcgctggccctggacatggccttcacgtccggacaggtcgtcacgacggtgttctacggccagtcgaacggcacctacgagcactacttccgcaccttcctgcgccccgaggacgtgggctggtcggtgttcgaggtcgtcatcatcgcggtggtggtgatgatcacccactgctactacggctacaccgccagcggcggcccggtcggcgtcgggcacgcggtgggccgatcgatgcggttctccctggtctctgtggtggtggtggtcctgctcgcccagttggcgctctacggtgtcgacccgaacttcaacctgacggtgtgagcgcgatggcgacaccggtgccgcagcggggccgacgcgcctgggtgtacgtcgagggggtgttcctgctgctggtctgtgcgctggttctggccttggtatacctgcaatttcgcggggacttcacccccaagaccaagctcaccatggtcgccacccgggccggcctggtgatggagacgggatccaaggtcacctacaacggcgtcgcgatcggccgggtggccgacatctcggagatcgagcgcgacggcgcccccgcggccaaactggtgctggatgtggatccgcgctatgtcaacctgattccggcgaacgtggtggccaccatcgaggcggccacgctgttcggcaacaagtacgtgtcgttgagcgccccggaaaacccgtcgcggcagcggatctcgccccgcgacgtgatcgacgcgcggtcggtgaccaccgaattcaacaccctgttcgagacggtcacctcgatcgcggagaaggtgagcccgatcgagctcaacgcgacgctgtccgcgctggcgcaggcactggacgggctgggcggcaagttcggcgaatccatcgtcaacggcaatcagattctggcgcagctgaatccgcgaatgccgcagatccgctacgacgtgcgccgcctggccgacctggccggcgcgtacaccaaggccgcacccgacctgttggacttcctgtccaacgcggtgaccaccgcgcggacgctgacccggcaacagggcgacctggacgccgcgctgctggcggccgtcggcgtgggccatgagggcgaggacatcttcgcccgcggcggaccgtacctggcgcgcggggccgccgacctggtgcccaccgccgagctgctcgacacctacagccccgaactgttctgcatgatccgcaatttccacgacgccgcccctgaggtcgccaaagcggccggcggcaacggctattcgctggcggcggccggatcgatcgtcggcgcgccgaatccctatgtgtacccggacaacctgccgcgggtgaacgcgcacggcggcccgggcgggcggcccggctgctggcagaagatcacccgggacctgtggcccgcgccgtatctggtgatggacaccggcgccagcctggctccttacaaccacctcgagatcggtcagccgctggccaccgaattcgtctggggccgccagtacggggagaacacgatcaacccatgagaatcaccggtaccgcagtcaaactcgtcgtcttctggtccgtgctggcgatgttcacagtgatgatcatcgtcgtgttcggccaggtccgattcgatcggaccaccggctactccgcggtgttcaccgacgccggcgggttacgggccgggcagttcgtgcgcgcctccggggtggaggtgggcaaggtcgccgccgtgacgctttccgacaaggacagccgggtgttggtggagttcaacgtggatcgctcactggcactggaccagggcaccaccgcgtcgatccgctacctcaacctgatcggcgaccgctatctggaactcaagcgcggcaccagcggccgccggctgcccccgggtggccgcatcccggtcgagcacactcagccggcgttggatctcgacgcgctgatcggcggattccggccgctgttccaggctttggacccgaacaaggtcaacagcatcgcccagtccatcatcaccgtgttccagggacagggcgccaccatcaccgacatcctcgaccagaccgcggcgctgaccgccgcgctggccgaccgcgacaaggcgatcggcgaggtgatcaacaacctgaacaccgtgctggccaccaccgtcaagcacgagaaggagttcgaccgaacggtcgacaagttggaactgctgatcaccggattgaagaaccgggccgacccgctggccgcggccgcggcacacatcagcgacgcggccgcaaccgtggccgggctgctcggcgaggaccggccgtcgctgcacggcaccctcggacacctcgagggcatccagcaagcgctcatcaacgacctgcccaccgtcgacaacgtgctggagaaactgccgggcgcgttccgcgtcatcggccgcgccggcggcatctacggcgacttctacaacttctacctgtgtgatatctcgatcaaagtcaacggattacagcccggcggtccggtacgcaccatcaagctcttcggacagccgaccgggaggtgcacgccgcaatgaggacgctgaccgagttcaaccgcacccgggtcggcctgatgggcgcgctggtgacggtgctggttgtcggtgtgggacaaagcttcaccagcgtgccgatgctgttcgccacgccgacctactacgcgcaattcaccgacgccggcggtatcaacgtcggcgacaaggtgcagatcgccggggtgaacgtgggattggtgagttcgctggtgatccgcggcgaccgggtgctggtcggcttctcgatgcccggcaagacgatcggcgcgcagagccggtcggcgatccgcaccgacaccttcctgggacgcaagaacatggccatccagccgcgcggcgcggatccgttgccgccccacgggataatcccgtccgggcagaccaccacgccctaccagatctacgacgcgttcgtcgacgtcaccaaggcggccacggactggaacatcgacgtcgtcaagcggtcgttgaacgtgttgtcggagaccttcaatcagaccgcgccgcacctgaaggccgccctcgacggggtggccagattctccggcaccatcggcaaccgggacgaacagatcaagcaactgctgaccaacgccgacaagatcacgcgcgtgctcggcgaccgcagcgggcaggtcgacgccctgctggtcaacgccaacaccctgctcgccgcgttccggcagcgcagccaggcgctgagcgccctgctgagcaacgtgtcggcggtgtccacccaggtgtcgggattcatcaaggaaaaccccgatgcgcaccaggtgctgcggcagttgggcaccgtcagcgacgagctggtcaagcgcaagaaggaactctccgatgttctcgtgctggtcagcaggtacaccgcatccctgaccgaggccgtcgcctccggcccgttcttcaaggcgatcgtggcgaatctgcttccctaccaagtacttcagccgtgggtcgacgcggcgttcaagaagcggggcatcgacccggagaacttctggcgcagcgccgggctgccggcgttccgctggcccgaccccaacggcacccggttgcccaacggcgcgccaccgccggccccgccggtggccgagggcaccccggaccatcccgggccggccgtcccacccgggtcgccgtgttcgtacacgccggccgccgacagcccgccgcggccgggaaatccgttgccgtgcgcgctttccggtcaggggccgttcggcccggtccccgacggcttcccggccccgctggatgtcgagacgtcgccgccggcgccggacgggccgccgccgtcgcccggggtgccgagcgcgggacgcccgggtgaggccccgcccgacgtccccggcaccccggtgccgctgccggtgcacgccccgccgggggcgcgcaccgagaacccgcccgacgcgacaggggggagcacccgatgagcaccatcttcgacatccgaaacctgcggctgcccaaggtgtccgcccgggtgctggtgatcgcggcgctggcggcggtcttcgtcttcatcgcggccgtcgccggcgtccagctgtaccgcaagctcaccacgaccacggtcgtggcctacttctccgagacgctggcgctgtatcccggcgaccgggtgcagatcatgggcgtgcgggtgggttcgatcgacaagatcgagccggccggcgacaagatgcgagtcacgttgcactacaacaacaaataccgtgtcccggcgaacgcgaccgcgtcgatcctcaaccccagcctggtggcctcgcgcaccatccagctgtcgccgccctacaccggcgggccggtgctgcgcgacggcgccgtcatcccgatcgagcgcacccgggtgcccgtcgagtgggaccagctgcgggactccatcaacgccatcctgcgccagctcggccccaccccccagcagccggtggggccgttcggcgacatcatcgaatcggccgccgacaatctgtccggcaagggcaaacaggtcaacgagaccctgaacagcctgtcgcaggcgctgaccgcgctcaacgagggccgcggcgatttcgtcgccatcaccaagagcctggcccggttcgtcaccgcgctgtaccagcacaagcaacagttcgtcgcgctcaacgacaacctggcccagttcaccgactggttcacccaatccgaccaccaggtgagcgacaccatcgcccatctcgaccaggtgctggacgcggcccgaaagttcgtgaacgacaacggatccgcactgacccacgacgtcggcaacctcgccgacgtgaccaccacgatcctgcaacccgagccgcgcgacggcctggaaaccgcgctgcacgtgctgcccaccttcgccggcaacttcaacaacctctaccagccggcgcacagttcgctggtcggcctgttcgtgttccccaacttcgccaacccgatccacttcctgtgcagcgccattcaggccggcagccggctgggctaccaggactcggccgaactgtgcgcacagtatctggccccggttctcgacgccatcaagttcaattacccaccggccggcctgaacccgttcaactcggcggccacgctgcccaaggaggtggcttactccgaggagcgactgcgcccgccgcccggatacaaggacaccaccgtcccgggcatcttcgcccgcgacaccccgttctcccacggcaaccacgagccggggtgggtggtcgcgccgggaatgcagggcaccgacgtccagccgttcaccgccggcatgctcacccccgaatcgctggccgagctcatgggtggcccggacgccgcgccgccgccgccgggggtcaccgccgccggaccgccgaacgcctacgacgagtcgaatccgccgtcgccgccgtggttttcgcggcccacgccgccggggccgggccggtgatgcgccgggtcgccgtcgcggggcggcgcgcgctggtggtcgcgctggcggcgatgttgacgtcgtgcacctggaggggcatcgccgacgtgccgctgccggtcggccgcggcaccggcggcgaccacatgacgatctacgtgcagatgcccgacacgttggcgctgaacaccaacagccgggtccgggtggccgacgtgtgggtcggcacggtacgcgccattaccctcaaggattgggtcgccacgctgaggctggacctcgatccgggtgtgcggctaccggccaacgccaccgcgaagatcggccagaccagcctgctgggcacccagcacgtcgagctggccgcgccgaaaaacccttccgcgcaacgattgaagagcggcgacaccctcctgctgcagaactcgtcggcctatcccaccgtcgaacggacgctggccagcgtcgcggtgatcctcaacggcggcggcatcgccaacctcgacgccatccagaccgaggtgctcaacatcctcgacgggcacgccgggcagatccgcgaattcctaggccgcctggacactttcatcaccgagctgagcagccaacgcgacgacctgacccgggcgatcgattcgagcaacgaactgctgaccgtgttcgccaaccgcagggacaccctggatcgggtgctgaccgagctgccgccgctgatccggcatttcgccgacacccgcgaacttttcgccgacgccaccgaatcgctgggccgattcagcgacgcggccgaccgggcgctcaccgacgcccgggccaacctctaccgcagcctgctgtcgctgcaacggccgttgcgccagctcgtcccggccgccccgttcgtggccggcgcgttgaagctggggctgacggccccgttcaacatcgacgacgtcgcgcaggtgatccgcggcgactacgtcaacgtctcggccgccctcgacctgacgctgtccaccatcgacaacaccatgctcaccggcaccggcctgtccggcgcgctgcgcgcgctcgagcagtcctgggggcgcgaccccgccacgatgatccccgacgtccgctacacgcccaaccccaacgacgccccgggcggaccgctggtggaaaggggcgaatgaaagatgttgccccgcatgatcaaaacccagctggtgctgctgacggcggtggcggtggccgcggtggtcgtcctcggctggtactacctgcggatcccgagcctggccggcatcggccgctacaccctgtacgccgaattgccgcaatccggcggcctgtaccggaccgccaacgtcacctaccggggaatcaccatcggcaaggtcaccggcgtcgagccgaccgagcgcggcgcgcgggcgacgatgagcatcgaggacggctaccggatcccggccgatgcggccgcccacgtgcattcggtctcggcggtgggcgagcagtacgtcgacctggtctcgaccgccgggcgcgaaccgtacctggccgacgggcagaccatccacaaaagcacggtgcccagccagatcggtcccgcgctggacgccgccaaccgcggactggcggtgctgccccgggacaagatcgcctcgctgctctacgaaacctcgcaggcggtcggtggcttggggccgtcgctgcggcgcctggtggatgccacccaggcgatcgcccacgatttccggggcagcatcgacgacgtcgacgacatcgtcgagcgctcggcaccgatcatcgacagccaggccgattccgctgacacgcttgggcgttgggccgccaacctgaacacgttggccgcccagaccgcgcggcaggacccggcgctgcgcagcatcctgaccaacgcggcgccgacggccgagcaggtgcgggccacgttcggcggtgtgcgggagtcgctgccgcagacgctggccagtctcgaggtcgtgatcgacatgctcaagcgctatcacaacggcgtcgagcaggcgttggtgttcctgccgcagtccggcgcgatcgcccagtcggtgaccgcgcaatcgccgggccaggccgcactgggcgtcggcgccatctcactcaaccagccgccgccctgcctgaccggtttcctgccggcatcacagtggcgcgccccggcggacaccagcacggcgccgctgccggccggcacctactgcaagatcccgatggacgccaccaatgtcgttcggggagcccgcaattacccgtgcgtggacgtgccgggcaagcgggcggccacaccgcgggagtgccgcagcaccgagccctatgtgccgcagggcaccaacccctggtacggcgaccccgaccagatactgacctgccccgcgccgagcgcgcggtgcgaccaaccggtgaagccgggcctggtgatccccgcaccctcggtcgacaacggcctcaatccgctgcccgccgaccggctgccgggcaccccaccgccgatcagcgacccgctgcagcggccgggatcgggcaccgtggtgtgcaacgggcagcagcccaacccgtgcacgtacacccccagcgcgctctacgacgtgcgcagcggcacggtggtgggccccgacggggtggtgtattcggtggccaattcggccaccatcggcgacgaggggtggaagacgatgctgggacaggcccgctgacaacggcggtcgattagcgcgcctcgtccttgggccggccgcgccagtgtcggtagccgcgatgcgcggcgaacgcgccgacgatcgcgctcacgcaccacaccgcgaccgcggcataagccagcagcgaggaccgattcccgatcgaggcacccagcgcggtgtaggcgaaggcgcgcggggccgaaccgatgaacgcgccaacggccatctgccacaacggaactccgaacgccccgaaggcgtaggaggccagcgcatccgagatgccggggacgaagcgctgcccgacgaccgcccacaggccgccgcgcccgatcagggcgtcgacgcggtcggcccgcgccgggcccagcagcgcccgggcgctgtcgcggccggcccgccggccgacgaaactcgcggtggtcgcggtgcccaccgtcgcgcccagcgtcacgaagacgcccagcagcggaccgaacagcagcccactgccggcggccagtatcgagcccggcacgaacaacgcgccggcgagcgccgaggccaccacgtaggtcagcggcgcggccgggccggtggccgacaccacggcccggatcgcgccgacgtcgatcacccgcgccactgccaccagatagaacacgacggccagaaagccggcgaacacggcgaggcgcaggatgtgagcccgccgcgatgccggggcgtcgggagcttcctggtcgtccataccggccgtcacccgaccgcccgcagccgctgccgcagtccggtggcccggatcgcccggcgctcgatcgcggcccgcaccgacgcctcgggccccaccacccgcaccctgctcttggcccgggtcaccgcggtgtagaacagttcccgggtcagcagccgcgaatcctccggcggtatcagcaccgtcacctcgtcggcctggctgccctgactcttgtggatggtcatggcgtgcatcgtctccacctcgcccagccggctggtggcgaagtccagcgggccggccgcaccggcgatgacggcccgcagcccgtccgcaccggccaccgtcacgccggtgtcgccgttgtacagacgcagcccgtagtcgttcgccgtcaccagcagcggacgcccggcataccattgcgaccaggccggctgaccggtttcttcggcaatccagttgtgcaccaacgtgttccaccgcaccgccccgtgcggcccgtcgcggtgcgcacacagcagccggtgctcgtccagcgtggccagcgcggcctgagccgcgcccagcagcgccgccgagcgcaaccgcagcgcatgcgacaccagcacctcgcgcagccggtcggccgggcgctcggaatccacccactcgatgtgctcaccgccggccgccaacaactccagcacccggtcggcgtcgccggcccggatcgccgcggccagcgcgccgatcgcgctgccgaaccggtgcggggtggccagcgcggcgacccgcaccccggcgcggccggccagcccgtcgaccagatcggccagcacggcgcccgcctccaccgaggcccaactggtcgggatcgccgaccaggatcagccgggtgtccggccggacggcttcggccagccgggccatcatggtcaacgacaccatcgacgtctcgtcgaccacgatgatgtcgtgcggcagccggttgccgcggttgtgcttgaaccgcaccgacgtatcggggcgcggccccagcagccggtgcagcgtggtgccggtcagcccggccagccgcgcccggtcggccgggtcgaggtgctcgatctcggcggccaccgcctcggccagccgcgcggccgccttgccggtcggggcggccagcgcgatcctcggccgcggctcaccggcgcgctcggcctgctcgaccagcagggcgagcagccgcgcgaccgtggtggtcttgccggtgcccggcccgccggtcagcacggtgagcgcctgggacaccgcgatccgggcggccgcccgctgttcttcgtagccgggcgggaaaagcctttcgtagcatgaggattcgacatcgcccgccggtgccgacagtgccagcagatcggtgcacacctgctcttcctccagccagtaccggtcgaagtagagcagatcgccgaagaaccgcagcaccggcggcggcccgagcagcgggctggcccgcaccgcggccagccagtcgccggcggcgggccagggcaggtccgccgcgccgacctgtgccggcaccgcccgcagatcgacgcacaccgaaccgccccgcagcgcgcgcaccagcagggcgacggccagcgccacccgatcatcggactcgccggtgagcgcggtaagccgttgcgccacacggacatccgctgcttcgaagatgccggcgtcggcgaacgggcgcagcggcccggcgtcaaacacccgctccggcaacacgtccgccgtcacaccgccaccccctgggcatccagcaggtcggacagcgccgtgatcaacgacgacggcggtcgccaatcgaagacgcccgacgggtgaccgtcgcgcaccggcgtgtcggggccgcacatgccccgcacgaacaaatagaggatgccgccgagatggcggtccggctcgtagccggccagccgccagcgcaggaaccggtgcagcacagcgctgtacagcagcgcctgcagcggataatccgagtgcaacatcgcctccaccatccggggccggtcgtaatcggcggcggtcagcgggtgctgcgcatcaccgagccggttggtcttgtagtccaccaccaggtagcggtgccccgccccgtccgggatccgcagcacggcgtcgatcgagccggtcaggtatccgcgcagcggttcggcgccgagggagcggtccgtcagccggtcggcgtagcaggccagcacgtcgtcggccggcagatgcgcgcgcaacagcggcgacagatcggccagccgaacctccggcggggccgagcgccgatcgccgccggccagcggcagctcgaagtccagctcgcacaggcgatccgacaacccgatccggcgcagcgtcaggccgccggccagcgggcccagcggtgtgtcgtgcatcggcaccatcgccgcggccatgtcttcgggggtcgcggccaccggccaccacaccgagtgctcccggatccgggcggtcagctcggcggccaggtcgggggcgaacgggtcggccgtctgcagcacggcgtgcaccagggtgccgaaggtggcgcccgccggaaggtccgccatcggcgaggcaacatcgccgacggatgtcgccggggccagaagaatgtcgccgacctcgtcgtcgagcccggcggcctcgggttcgctgcccaccccgctgggctgggcctgccggatcaggccggaataggaggtgcgccgccaaccggtgtcgatgccgcggtggaagtggcggttctccagccgtgccggcaccggcacaccggacagcggcggcgccggcgccggcaccgactcctcgatgaccgggccgccggccgcctcccactcgcgcagccgagccagggcatccgcgtcggagatcttcgccggctcgcagcggtccggcaccaccggctcgccgggccggcggccccgcagcagccgggacaggccgccgttgggctcgtggtaggccggtgaccaccacgccaccacctgggcctgcgctcgggtcaacgcgacgtacgtcagccggctgtcgtcgctggcgtcctccttacggccaagccgctcaacggttttgaagtcggggctgtccttgccgccgacgtgcaggcagcgggtgccgtcctcgtcgtggaacagcaccacgtcgctgtcggtggtgttgcggtggaacgcgaacggcaggtacacgatcgggtactgcagccccttgctgacgaagacggtcatgatctggacggcggcggcgtcgctgtccaaccggcggttgcgttccggcgcgccgcttcgctcgtcgcgctgccggcgcagccagtcgcgcagcgcgggcaggttgtggtgttcgcggtgggccacctcgcccagcagttgggtgagatgcgccaggtccgtcatgtgccgcgccccgccctgccagccgagcacccgattgctcatccccagcagctgggcggcctcgaagatggcggcgacgccgcgttcgcgggagtgaccggcccactcccgcaaggtttgggcgatccggtcggtcagcgcgtcaccgccggccgccaacgtctcggcggtctcgccgaagaacatcgtcgccgccgccgcgcgcaccacgccgggccggtgcggctgatcgaacgcctccagcaggcacagtcaatcctcggccgcctgcgaggtgaacacgtcggagttgccggtgtagacggcgggaacgccggcgtcgcacagcgcggtgaaacaggcctgggcgtcccggtgccgttccacgatgaccgcgatgtcgcccgcccgcaacggtttcccgtcgaaggtggcgccggcggccagcagcgcacgaatgtcggcggcgagatcggcgccgatgtgctgtcgcagctcgtcgatgggaagattggcaataccgcgacgtcccaacgtgtttcgtgacaccacccgcagccggaacgggtcgttgcgcggtgccccggacagccggtgaccccggtggtgcgccgcgacgtcgttcaccgcgatcgcggggtcaccgagctgcgcgccgcgcagcaccacctgcagccgctgcagcagcgcggaatcgctgcgccagttggtgtccagcgtctttttctgccccgcggtctcggcggcccgcaggtaggtgacgatgtcgccgccgcgaaacgcgtagatcgcctgcttggggtcgccgatgagaatcagcgtcgagcggccgctgaacgcgcggtcgatcacctgccactgcaccgggtcggtgtcctggaactcgtcgaccatcacgatcggccagcgctggtgcatgcgcagccgggcgggggagtgctcggtggccagcgcgtcggccagccgggtcagcagatcgtcgtagcccagcacgccgagccggcgtttgcgcgtatccagttcggccagaacatcattggcgaagcgcaggctgaccgccgctcgcgaaccgggctcggggtgcagcggccgcagctgcgccgacgggttgttgaccacgtcgcgggccaaccgcagcgcctcccgatagtgcagcaccgggtcgtcgtggtcctgcccgaaatgtgccagatacaggtcatcgacgatctcggccaccagctcgtcgaggctgtccagcaaggtcaccccggcggcggtgtcgccggccaccccgagcgagcgcaacaccagctggcagaactgatgcgtggtggcgatcgtcgccgcgtcgaagccggccagcgcgtcgcgcaggcgttgccgccgcgcggcgagccggtcctcggtgccgtccagcaggtaggccaccagctagttgtcggcggcccgcgacgggtcggcgaaagcggctaccgcgtcgacgatttgacagcgcacccgttcccgcagctcctggctggcggcccggccgaaggtgatcagcaacatctggtccagggtcgcggcgccgtcggcgagatagcgggtcaccagcccggccaacgcgaacgtctttccggtgcccgcgctggcctcgagcaccgtggtggagcgcgcggccggcaatgcgcccaacaggtcgaagcgttccatcacgccgtcgtccgctcggcccgcaacatcggcagccacagccgggccgcgtaggcgccgagccggttgtcctcgccgtcgcactcctcgcccgggcgcaccggccgcatcaggtcgtccagcggcgcaccgcgtccccaggcccgcacatgcgccggcgcctggtcctccccggggtagcggtcgctggacttccaccggtagcgcgcctcggccaccgggtcgtcgccgccgtagcgggcggccgcccacgcgtaggaggtcttgagcggcaacggaatcggctcgcgccgcccggcgtcgtaaatgctcaccagctcgcgcagcagctcgacgggatcgtcgtccggcgacccgagccgctgcacccggatgccggtgccccggcgcatccgcccgatgcacaccgccgaccagtcgcggccgcgatcgtgagcggccaacgccagcaacggaatccacgactcgagcagatgcctgccgtccagccgcgaataggtcaccgcgaccaggcggtcgccgtagaccggggtcaccgtgccggtgagccggcgcccgcggcccagatcgatgtcgacgtcgtgggcgccgcccggctgctcggcccggtgctggtgcgcctccaatgccaatcgcgctgcctggtcgcggatctcggtcaccctgcgccagcccagctgccccggcggcagggtgccgcggcgccactcggcctgccgagcgtcctccggggtcatcccgcgcagcatgtcgcgcagcatgcgatcgccgaccgtccactcctgtagggcgtcgatgtccaccggcatcgcgtcctgcactccgtcgacgtcgtggggcagcgtgaactgcagggcccgaaagaacccctgcaccgggtctttgaagaagccgaccaaatcggccaggatcacgtcagcgggcggcgggggcggcagcggcgcggagatgaacttcggtggctcgcagtgttcgccggtggccgcgtgcgccgcgcgcagcaccgtggggtcgaaactgaacggcaccccgggcaccagctcgccggggatgatgttgcgaatgtcgaacggctgcaacggatgtcgcacgacgatgcggtcgcgcaccggctcggcggtggttatgtcgagggtgtccagcagttcggccagcggcaccgccggcgggcgtggctgacccgaatactcgttggcgccggtgtaggtgatcaccagcttctcggtggccgcgccgatcgcgtcgagcagcaattgccggtcctcggaacggatgtcgcgctccccggtcatcgggcagcgcgccagtgcgtcgtcaccgtcgacgacaccgagccgcgggaacagcccgtcgtccaggccgaccaggcacaccacccggtgcggtaccgaacgcatcggcaccatggtgcacaccgtcagcgtgccggtgcggaaattcgcgcgggtcggacgtccggacaggtgccgggtcagcagcgcgcggacgtcgggcagccgcagcacggtgtcggcgcgggatccggcctgcgcggacaccgcggcgaactcgcgctgcagctgaccgctctgccattcgtcggcatcgcgcacccgggtcagcagggcgatgccgtcggcgacggcggtgagccagtcggtcagcggccgggcaccggtgagcgagtccaggacgtgctgcagccgggcgacgaattccgcgagctggccggccaattggacacgattgctgctgacgtcgtcgagcggcagcgtcgcgtcgatccacgcgttcgagtcgtcggacatcgcgacgccggccagtatccggtcgatgccgaaacgccaggtgttgtgcacgaagtcgacgtggtagggccgccgatgctgccggtccagcccccagcggatgttggcctggcggacccatccggtgatggtgtccagatcgtcgtcggtgaagccgaaccgggcgcgcaccgccggcgtctgggccaggttgagcacctcgctggcccgcacccggccgccggctagggccagcagctgcgcggccaccccgagcagcgggttggtctggatcagggaacggtccgccagccgcacccgcagctggtgggcggggtgcgcgccgtgcaccacgtcgccgaggccgaagtcggccatgatcagcggcgcgtagctttcgatgtcggggcacatcaccaggatgtcgcgcggctgcagcgtcgggtcgtcggcgagcaggcccagcagcatctcgcgcagcacgtcgacctggcgggccggcccgtggcagttgtggatctgcaccgagcggtccccggcggccagcgagcggccaaccgggcgaacggcattggcggcgatgtcggactgcagccagcccagcagcgtgtcggggcgggcgtcgccggccaggtactcgtcggtccgcggatccgccggcaggccgcgctgcagttcgcgcagatcccgtcccagcgtggccagcagcgggtgggcgacggcgcggtggctggtgtcgtcgcgccgggggatcacgccgtgcgtgccggccagcgcgcgccacaaccggtcgctcgggtgcggcagccacaggtgcaagtcgtggtgagtggccagcgcgtccaggagctccacgtcggtgcacgccaaccgggtgtgcccgaacagcgacagccgctgcggcaggtcgctgggcgcccgccgcagccgggcgatggtttcggcgtgccgaacgtgcggtggatcggcggccacccgggccaacagcgcccgccacagcggcggttgccagcgcaggtcctcgtccagatcgcccgggtcgccgtcgagccagtcgaccagcagccgcggccgttgccgggcgtagccggcgaacagcccggccagccggcgcgccgcctcgtagcggcgggtgcggcgcagctcggcctcggcgccggtgtcgaagtggcccaggtgcgtcgccagcgtgcggcaccacggctcgtccagcgaacagtcgatcgcctccagcagcggccaggccagggcgtccggcgaccagggatcgtcgtcggccgtgccggtgatctcggcgatcagcgagccgggactgcggaattgcacgccggcgcagaccccgtccccgtcgcgggcgcggcccagcacatgcgacagccgttgactcagccagcgctccaccccacgcgcgggcaccacgacgagctcgagggcgaacgggtcggccggtggattggccaacagcgcgccgagaccgtcggccagcagatcggtgcgctcggcacggtgcaggtgaagcggcattgcgctgtcacgataaacccgggcaccgacgggcgggggttacttggccagcgtgaactggttgacgtcgatgtagccggcccggaacgcgtcggcgcagccggtcagatacctcatgtagcgctggtagacctcttcggactggatcgcgacggcctcgctgtggtgcgcgcgcaacgcatcggcccagtggtcgagcgtgcgggcgtagtgcagctgcagggactgccggcgtttgagggtgaaccccatcttcgaggagtggaactccacgacctcgatggccggcagctgcccgccggggaagatctcggtggcgatgaattcgttgaagctggtctgctcctcggtgagcggcaggccgcgctccacgatctgctccggggtcagcatggtgatggtgtgcagcagcatcaccccgtcgtcgggcagtacccggtaggcggtcgcgaagaagtcgtcgtagcggtcgtagccgaaatgctcgaacgcgccgatggagacgattcggtcgaccggctcgtcgaactcctcccagccgtgcagcagcacccgcctgctgcgcggggtgtccatcgcgtcgagcagctgctgcacgtgggcggcctggtgccgggacagggtcaggccgatgacgttgacgtcgtagttctcgacggcgcggcgcatggtggcgccccagccgcagcccacgtcgagcagcgtcatcccgggccgcagccccagcttgcccagtgacaggtcgatcttgcgcagctgcgcctcctccagcgagatgtcgcggttgcgatcccaataggcgcagctgtaggtcatggtggggtcgaggaacagccggaagaagtcgtcggacaagtcgtagtgggcctgtacctcttcgaagtgcggtgtcagattctctgccacggcggctactcgcctttctgactcggggccattggggttgtcacgaacgggccggtgagtcggttcacctcggcttccccggttccacatcgtctaaccgggcgatgcgtgttgatttgtgggccagggtgtttggctgcgcccgcacccgtctacccacgtttgtcgcgccggacggcgggcgaccgcgccatcgccatccgggaattcacgccatcctacgcgggttgagcagggagaacagtcactggaaggacgcttcatggaagcttgggacgcgatctgtgcgcgacgcaatgtgcgggagtaccagccgcgggcgattgccggggaggatctggaccgcatcgtggaggccggctggcgcgcgccgtcggcgaagaaccggcagccgtgggacttcgtcatcgtcaccgaccggacccagctgcaggagctgtccacggtgtggcggggcgccggccacatcgcgggggcgccggcggcgatcgcgatcgtggtgcccgagccgcccgacgagcgccgggtggtcaccgacaactacgacgtcggccaggccaccatggcgatgatgattgcggccacagacctgggcatcgggaccgggcattcgtcggtgggggatcaggacaaggcgcgcgccatcctcggcgtgcccgacggtcatctggtggcgttcctgctcggggtgggctatcccgccgatcgcccgctcaccccgatccgcaagccgaaccgccggccgttcaccgaggtcgtgcaccgcggccgttggtgagcgcgcagccgaaaaacgttcggcgccttgtcgagtcgtaagctgattggcgtgcatgaccaccggggcgaatacggagtcgacgggtcctttcacacggtctcggcacgcgcgcaggcgataggcatcggcgcccaggctgccggcctggcggtgtgggccgggatcagctgggcgcgcggcaagcggcgcagggccgcgctggccgcgctgtcgagcgccgggatcgcggccaacaccgcgttgtacatgtacgcgacgcgggccgggaaattcgttgtgtgggaccggattctgagcgatctgcggctcgccggcgacgaaaccctgctcgatctgggctgcggtcggggtgcggtgttgctggccgcggccaagcggttgccgcggggccgggcgatcggcgtcgacctgtggcaggcggaccagacggacaactccgagcaggccacgctggccaacgcggcggccgagggcgtcgccgaccgcgtcgagctgcacaccgccgacatgaccgcgctgcccctggccgacgagagcgtcgacgtggtggtgagtaacctcgcgatccacaacattccgacgcgcgccggccggcgccaggcgctcgacgaagcggtgcgggtgctgcggccgggtggccggctggccatcgcggatctgtgggagacgcgtcagcacgcggcccggctgcgtgagctgtgctggcgcaacgtgcggcggcgaaacctcggctggcggatgtggtacggcggcccctggttttcgacgcggatcgtcaccgccacgaaacccgaatagtcagaacagcagcgggtcaagtggctcggccatggaacggattatggctaccccccgacgcggcgtgcatgctgggacgcatgacgagaaaccaactcaccgaacagatcgtcgtcgcgcggctggccaaggggctgacctggcaggagctggccgacgccatcggccgcccgctgctgtggaccacctcggcgctgctcggacagcacccgataccggccgagctgggtcggatcctcgtcgacaagctgggcctcgacgagtcggcggtgccggtgctggcggcgccgccgatgcgcggcggcctgcccaccgccgtgccgaccgaccccaccatctaccgcttctacgaagccctgcaggtctacggcggcgccctcaaagaggtgatcgccgagcagttcggcgacggcatcatgagcgcgatcaacttcagtgtcgatctgcagaagaaaccacacccgtccggagaccgggtggtggtcaccttcgacgggaaattccttccctaccaatgggtttcatcggagcagtaggtgacgtccaagacggagccggcgaagccggtggacctagtgctctccggcggcgtcaagttcatcggtctggtgggcgccatcgtggcgctgatggatgccggctattcgatcaaaagggtctccggggtctcggccggctcggtggtggcggcgatcctggcggccggctgccacgccggcgagctgaccggcgcgcaggtcaaggaactcgccttctccgttccgctgcacaaatggcgcgacgccgggccggtgccctatctgggtgcggcgtgggggctggcgcgggacaccagcatgtaccgcggcgacgtcgcgcacgactggattcgcagcgagctgaagaacttcggggtcagcaccttcggcgacctcgtcttcgacggcgacgatctgcccgacgagcgccgccgccggctggtggtcaccgtggccgacgtcaccgcggcccagctggtgcggctgccgtgggactaccggcggctctacggcctggaccccgacgagcagccggtggccgacgcggtgcgcgcctcgatggccatcccgttcttctaccggccggtcaagctggccagagccgacgggaccgcctgcaccctggtcgacggcggggtgttgtcgaatttcccgatcgacaccttcgaccggcccgacggccgggcgccgcgctggcccaccttcgggatcacggtcatgccaagccccaccgagggcatcggtgcggtgatgccggccctgaaaccgctgcgcttcttgccgcagacggcgctgttggaaagcctgctgatcaccatgctggccggccacgaccagacccatctcagccagccgtgggtcgccgcccgagccatcgcggtggaatcgacgaacgtcggcgtgctcgacttcgacgtccccaggtctcgcctggaagagctgtacgacagcggctacgcggccgcccaggcgttcctgtcgacctgggattggcagggctacctggaccggttccggtatccgggcgggcgcgggtgaagtgacggcccggcgcgcacgtgccacactggcggcgaggaggcgagcaacgcggtggcggcgagcagcggccaccgcgttcgcctctcagttcatcaacacctgcggcgaaagctccttgagcattgcgttggcccaacgcatctggcgcagcgtctcggggtgacagcgcgacgccaggcccagcagctcggcatccttggccgcctgcgcaccttgggccagcagctcccagtccagcgacacgccggcggccagccggtggatccggcgcaggtcggccagcagcaccagcccgggttccggccggtgccgcagcagaccgctgatccgctgctgcacgacaccggtgcgcgcagcggtgcgcggatcggcggacagccgcagaccgtagtggcggccgtgccgtgcgagctcgccgaggtgccggtgcgaccagccggccaggtcgcgggccaggtggaaaatgtcctggtcgctgtggtgccgggcggccagcacggtcagttggtgggccagcttgcgttcggagcggtgcagttcgcggatcgccagcctcagtttcatgacgggctcccggccgcgacggcctcgctcaccggcgccgccctgtggctcggggccttgtcgagccgggcggcggccgttttgaagctcggctgcttggacgccgggtcccagtcggtcgccgtgagttcgttgccggcccgttgatgatccccgccatcccggtcccagtagccgtagtggaagggcacgaacagcaccccgtcgcggatgccgccgacgcgcgcggcgcaggtgattcggccgcgcggtgtgctcacgtgcaccagatcgccggcctcgatgtccaggcggcgcgcgtcgcgttcggagacctccacccacacctcgggcgcggcgtcctgaagctgttgggcccgagccgttttcgtgcgggtgtgaaagtggtagacggtgcggccggtgatcagcgcgaacgggtaatccgggccgggccgctcgtgcggcggcaggtattgcgccgccttgatgatggccttgccggacgggttcagcgagcggtactcgtcgggctgcagcggggcgcccgtgatcaggtccttgccgtacgcctcgcagtagtcgggcgcggccggaaatctcccatcctcatacagccgctcggtaccgtcgggatgatctgtgttgcacggccattggatgccgctaccgccacgcagcttcgcgtagctcaagccggtgtagtcgcacggtcggcccgcgctgcatttcttccacgcctcgaacgccgactccggatcggtccacggcggaaacggccggccgtccttgtcgcggaagtccatccggcgcgcgtagtccaggaagatctccaagtccgaacgcgcggaacccggtggctccacggccttttcggacaggtgcaccgtgcggtcggcgttggtgaaggtgcccgtcttctccgcccacgccgcggccggcaacaccacgtcggccagcgcggcggtctcggtcaagaagatgtcctggacgacgaggaacagccgctgctgcgacaggatgtcgcggatgcgcggcaactccggcagcgacaccgcggggttggtggcggtcacccacagcatgcgcagcgtcccctcctcggtgaagcggaacatctgcatggcgtgcgtgggcggaccgtagtgcgggatctgcagcggctcgaggttccacagctccgccaactcggcgacgtgggagtcgttggaccagttgcggaaaccggccaggtcgccgtcggcgccgcactcgcgggtgttctccgcggtcggctgcccgttcatctgcagcaccccgcagccgggcctgcccagcatgccgcgcaccaggtgaatgttgttgacctgcacggccgccgcgctggcctggtgcgactggtagaaaccctgcagcacggtggacagtagccgccgcgcggtgccgatcagccgggcggcccgccggaggtccgtggcggccacaccgcagatctcggccacccgctcgggcgtgaattcgcctatcctgcactgtaattcgtcgatacccacggtgtgcgcgtcgatgtagtcccgatcgatccagccgttgccgatgatctcgtgcagcaggccgttcatcagcgccacgttggtgcccggcagcggcgccaggtgcacggtggcgtgccgggcgaccggcgtcagccgggggtcgacgcagacgatggccggcgggtcgctgccggccagccggtccagcatccgcgcccacagcacggtctgcgtctcggcgacgttgtgcccgaacagcgcgatgacgtcggcgtggtcgacgtcggtgtaggacccgggctggccgtcgcagccgaacgattccttcaacgcctcggcggccgtcgcggtgcacagccgggtgttgccgtcgacgtggttggtgccgatcgccccgtgcgcgatggccgcctgggtgtagtactcctcggcgaacaactgcccggaggtgtagaagccgatcgagctggggccgtggcgctccagcagttcgcggctgcgcgcgacgatccgctccatcgcggtgtcccagtcgcacggccgcaacgcgccgcgcacccggagcagcggcgtggtgagccggtcggcggaggcgttggcctgccagccgaacagatccttgggatcgagccggccgtggttgacccggtcgacggcgcgcccgcgcacccccacgatccgtccgtccttgacggcgatgtccaaaccgtcgccgttggaatgcaataccgccgccgattgcacccagcggtccaccgactcggcggtgaccccgtcggccagataggtgtcgacgcgttccggccatcgggtgccgggcgcatagggtgtgcgcgtcccccacgggttcgcgatgcgatctgttgccacaccggtgacttccccggtcgcggcggccgaaacgccgaaatacgctgcgggcctatagaccgaattcggcttcgatgccgtcgatcccggcgcggatggccgccagcgcgtcggcgcgggcccgcaacttggtggcggcgtgggcgcgctggttcagctcggcgaattcggcggcggcctcctcggcgcggtcgaccaccacctcgggcagcacgatctcgtcgacaaagcctgcggccaaagcggtttcgccgaagaacgttttggccagcccgctggcctgctggtaggccgacggcgtgagccgcagcttcatgatctccatcgcggcatacgggatgaccatgccgatcgcgacctcgttggcctggatgttgtaggcgtgcgcggccacccggtgatcgcccgacgacaacaggaacgcgcccatcgcgatggcgtgcccggtgcaggccatcaccaccggcttgggatacgacagcaggcgataggccagctcgaacccgccgcgcagcatgtcgaccgcgggctgcacctcgccggaggtgaggatcttcaggtcgaagccgccgctgaacacccgctcgttgccggtgatcaccagcgccccggcgttgtccgcctcggcccggtcgatggcctcgcccagggcctgctgcatggtcgggcccagcgcgttgaccttgccgtcgtccatcctgatgacggcgacggggcccttggcgctgtagtggaccgggccgctcatgagttgctccttgccgtcacgccggctggctgtggtgcttgcccaggtcgtcttcggcgttgctccagcgcaggctgacatcggtgggttcgtcgagttggcggctgcgccacctgtcttgggtttcccggaccgcggcgttgatccgttcgatctcgctgcggaacacctcgggacgggtttccttgctggcgtagtggaagtaggtgagcagcccgcgcagcagctccagcttctccttctcccgcttggccaggtcgtgggtggtcatcaactcgatgcgctgcacgggcggcagggcgtcccagtccagcacgacgtcggtgtgcagcggcgtgcgttcccgctgccagaaccgccggccgccggccggcgcgggccggtcgtagtaggtgaccgtgccggtgaagcgggattcgatgccgctgccgatctcggcgcggtccagcgcggagtcccacaccgtgcgccactcctggccgggcgccagcaccggcagctggcggggcagccgcagttcgacgacgtcggcgtagccgtcggtggcgctctcgtattcggccacggtgggcggattgtcgaaggagaattcgatgtcgtaggcagcggtctggccgaagttgcggaccaccagttcgatgacgtgccagtcggccgggtgcggctccatgaacatcgcgacgtgcgggcgggtctgctcggcggccgcccggcgattgcgggcgatctggctgttggtgaagatcagcgtgatgacggcgagcgcgatcgccgcccatgctgcccacgcgatccaggtgctggacccgacgtgcgtgaccccatgccagctgtcctggatccaacccatggaatccaccctccgcttatatcacagggccggccgcggggtgatcacgatcgagcgatcaccggacggctcagccgcccatcaacatccgccattggtcaaggtcggaggcccggtagacgtagttggaccgcttcacctccgacagcgaggcgctcggctcggccgagtaccagtgcccgggaaacaccgtcgggtccccgggaagcttcgccagccgctgcaggctgcggtacatctcgtcggagtcgccgccggggaagtcggtgcgcccgcagccctccaggaacagcgtgtccccggcgaccagccggccgtccagcaggaagcactggctgcccggcgtgtgaccgggggtgtgcagcaactcgatctcgatgtcgccggcgctgaccttgtcgtggttctcgtgggcggtcaggtcgcttgcgctgatcccggtgacccgcgaaacccacagcgcctcatggctattgacgtgcaccggcaccggcgcccgctccagcagttcggccaggcccgccagcgtgaaccccatcatcgagccgcccacgtggtcggggtggtgatgggtcaccagcacgccggacaggtgcatgccgtcggcctcgagcgtgtcgagcaggtcggaggcggcgtaggcggggtcgaccaccacgcagtccccggtctgccggtcaccgatcaggtaggcgaagttgcgcatctgcgtcgcgaacatgtcgccggcggcgaagtcgcgaccggagagcagttggcggaaatacagccggtcgtcggacacctgaccagactatgacgcggccgcgggtggcccgccaccccttgcggattcggccggccggactttgccgcacacggcctgccagcaacggcttcggcgggtggtcagtgggtattgttgccgcatgaggaagaaggttgaaatcgaggtcgacctcgaattggtcgatgaggcgatccgccgcttccatctcgccgacgcccgcgaggccgtcaatctcgcgttgcggaccctgctgcacgagggcgattccgtcgcatccgaagacgagtacgacgagttcagcgacctcagcgcctggcagcctcggcggaacgccgaaagcggctgatcggcatccggcgtggtttggtgccgctgcgaaccaggctgtaccctcttctaggcccgcgcgactggtcgcttcgggtgaacggcccccttagctcagtcggtagagcgtttccatggtaaggaaaaggtcaacggttcgattccgttagggggctcggcggacgccgagcaggcgtggcggccccggccccaaaaggggtggccagaggcgatgtagctcagtcggttagagcgaacgactcataatcgttaggtcgccggttcgagtccggccatcgctacaacccaacagcacggattttttcacgaatcgaggcagaaccgtcatggcttccagtaccgacgtacggccgaaaatcaccttggcgtgcgaggtgtgcaagcaccgcaactacatcaccaagaaaaaccgccggaacgacccggaccgactggagctgaagaagtactgccccaactgcggtaagcaccaggcgcatcgggagacacgctagcggccggccgcgcgcgttcactccgattgactaggtagtttaagaaccgtgccgttaaccacaaacctcgtcgggatgcactaccgctaccccgaccattacgaggtggagcgggagaagatccgcgagtacgcggtcgccgtgcagaacgacgacgcgtggtacttcgaggagaaggcggcctccgagctcggctacaagggcctgctggccccgctcacgtttgtctgcgtcttcggctacatggcgcagtcgtcgtttttcaagcacgccaacatcgcggtgaaggacgcccagatcgtccaggtggaccaggtgttgaagttctacgccccgctggtggcgggcgacaagctctactgcgacgtctacgtggactcggtgcgggtgtcgcacggcacccagatcatcgtcaccaagaatgtcatcaccaacgaggccggtgacgtcgtgcaagagacctacacgaccctggcgggccgtgccggcgaggatggagaagagggatttactgatgccactgcgtgagttcagctccgtgaaggtgggtgacctgcttccggagaaggtctacccgctgacccgtcaggatctggtgaattacgcgggggtgtccggcgacctgaacccgatccactgggacgacgagatggccaaggtcgtcggcctggacaccgcgatcgcgcacggcatgctgaccatgggcatcggcgggggctacgtcaccgcgtggatcggcgacccgggcgcggtcaccgaatacaacgtgcggttcaccgccgtggtgccggtgcccaacgacggcaagggcgccgagctggtgttcaacggcagggtgaagtcggcggacccggagaccaagtcggtcaccatcgcgctgacggccaccacgggcggcaagaagatcttcggtagggccatcgcgtccgcgatccttgcgtaggccatggcgctcaaaacagacatccggggaatgatctggcgctatcccgactacttcgttgtggggcgcgaacagctgcgtcagttcgccctgtccgtcaagaaccgccacccggcccacttctccgaggacgccgccgccgaactcggccacgacgcgatcatcgcgccgctgaccttcgcgaccattttcgccaagctggtccagctggatttcttccggcacgtcgacatcggcatggagaccctggtgatcgtgcaggtcgaccagcggttcgtgttctccaagccgatcaaagcgggcgacaagctgtgggcgcggatggacatcgtgtcggtggacgagcggttcggcgccgacatcgtggtcaccaagaacatctgcaccaacgacgacggtgagctggtgctggaggcctacaccacgctgatgagtcagttcaacggcgaccagtcggcgaagctgcgctgggattccgagtccggccaggtcgtcagaacggcgtaattggtatctgactcccgctccgatgtacactcgggcctcggggttttcccagcgtcagcgcgctttccgtgagtcgagcaatcgggaggcgcgcgtgtcatgtaagccccggtaggtaagcgcaggttggcctgccaaccgcgaaggggcgtagctcaactggcagagcagcggtctccaaaaccgcaggttgcaggttcaagtcctgtcgcccctgctgaacagggatccgtgtcatggtggacactggaagacatgccgccactgatgggacggctcttggggtactagcaaacaaaggagcatgcggtgagcgacgaaggcgacgttgccaacgacgccgcaagcgacggcgctgacacgacggacgaccgcgccggcggtggccggaccgcggtggtgacgcggccgcagcgccctaccggcaagcggtcacggcagcgggcggcgggggacgccgacgcggagccgtcggacgaggccgaggtctccgcgccggagaaagccgagaaagccaagcgcaagaaggccgcgaagccgaagaaatccgcggacacccgggcgaacccgtttgtgttcgtctacaactacctcaagcaggtcgttgcagagatgcggaaggtcatctggcccaaccgcaagcagatgctcacctacacctccgtcgtgctggccttcctggccttcatggtggcgctggtcggcctggcggatttcggcctgaccaagctggtgctgctggtgttcggctgagcgagtgacgccgctttgaaagtgacagagaggactcaacccgtgactaccttcgacggtgacccgtccgcgggtgacgcggtcgacctgagggagaccgacgaggccaccgaggccgccgacgaggctgccgagaccaccgaggacgccgccgagtcggccgagacgcagggcgaaccggccgaagaggttgacccggccgccgcgctcaaggccgaactgcgcagcaagcccggcgactggtacgtcatccactcctacgcgggatacgagaacaaggtcaaagccaacctggaaacgcgggtgcagaacctcgacgtcggggactacatcttccaggtcgaggtgcccaccgaagaggtcaccgagatcaagaacggccagcgcaagcaggtcaaccgcaaggtgctgcccggctacatcctggtgcggatggatctgaccgacgactcgtgggccgcggtgcgcaacacgcccggggtcaccgggttcgtcggcgcgacgtcgcgcccgtcggcgctgtcgctcgacgacgtggtgaagttcctgctgccgcgcggcgcgacgaagaaggtcgccaagggtgcggccagcaccgcggccgccgccgaggcgggcggcctggagcgtccggccatcgaggtcgactacgaggtgggcgagtcagtgacggtgatggacggaccgttcgccaccctgccggccaccatcagcgaggtcaacggcgagcagcagaagctcaaggtgctggtgtccatcttcggccgcgaaacgccggtggaactgaccttcagccaagtctccaagctctgaaccggcgccggcgccgggcacaaaccaggaaggacaacaacatctcatggccccgaagaagaaagtcgtcgggctgatcaagctccagatccaggcggggcaggccaacccggcgccgccggtcgggcccgcgctcggtcagcacggcgtcaacatcatggagttctgcaaggcctacaacgccgccaccgagaaccagcgcggccaggtcatccccgtcgagatcaccgtctacgaggaccgcagcttcacgttcgcgctcaagaccccgcccgcggccaagctgttgctcaaggccgccggtgtgggtaagggctcggccgagccgcacaagaacaaagtcgccaaggtcagctgggaccaggtcaaggagatcgccgagaccaagaaggccgacctgaacgccaacgacatcgacgccgcggccaagatcatcgccggcaccgcccggtcgatgggtatcaccgtcgagtaggacccctcgtcgaaaaaacctgagcacgacggagcgggccgaggaacgaggcccagcgtaggagtgcgaagggcttattcgacgagaaacaacaccgtgggggggccagcttcggcccgccaaccacggcccaacaccagattggatgagtcaatgagcaagcgcagcaaggcatatcgcgcggccgccgagaaggtggaccgcgacaacctctacaccccgttgcaggcggccaagctggccaaggagacgtcgtcgaccaagcaggacgcgaccgtcgaggtggcgatccggctcggcgtcgacccgcgcaaggcggaccagatggtgcgcggcacggtcaacctgccgcacggcaccggcaagaccgcccgggtcgcggtgttcgccgtcggcgagaaggccgagcaggcgcaggccgccggcgccgacatcgtcggcagcgacgacctgatcgaaaagatccaaggcggcttcctggacttcgacgcggccatcgccacgcccgaccagatggccaaggtgggccgcatcgcccgggtgctcggcccgcgcggcctgatgcccaaccccaagaccggcaccgtcacccccgacgtcgccaaggccgtcgccgacatcaagggcggcaagatcaacttccgggtggacaagcaggccaacctgcacttcgtcatcggcaaggcgtcgttcgacgagaaggccctcgcggagaactacggtgccgcgctggacgaagtgctgcggctcaagccgtcggcgtccaagggccggtacctgaagaagatcaccgtgtcgacgacgacgggcccgggcattccggtggacccgtcgatcacccgcaacttcgccgaggcctaggtcccgccgcgagagtgcaactagcgacggccgttctcgggaaatgcgtcgccagttgcactttcggcagctgaagtgcactcggcgatgcgccgtctcaggaatttgcggcccggctcggaaccgttggactgcaacgcgattcggtaccagggcagcgcctcggcgggccgcccggcgcgccgcaggagatcggcgcggagcgtcgcgatgagattcgagcgttccagcttaggttcgtccacctcctccaaagcggctaagccggcgtcgggaccgtcgcgcagcccgatcgccagcgcccgattcgcggccaccaccggtgaacgggtcaattgccacagccggtcataggccgcgcagatggtgacccaatccgtctgctcccaggacggcgcggtggcgtgcagcgcggcgatgaccgcctgcggcaggtaggcgccgctcgacccctcggcataacgcaaccggtccagtccggccgtgatgcgccggcggtcccagcgcgtacggtcctgctcctcgagcggcaccggcacaccgcgggcgtcgacccttgtggcgcgccgcgaatcatgcagcagcatcagcgcggacagcgcgtgtgcctcgcgctcgtcgggcagcagcgcgcacaactcggcgcccagccgaatgccttcgtcgcacaggtcgtcccggatcgccgacggccccgcggtggaccagtagccctcggtgaacaccgagtacacacagcccagcacgtgcggagtgcgctcgcccagcagctcggcgggcggcaccctgagcgggatgttggcgtggcgaaccttgttcttggcgcgggtgattcgctgaccgatggcggcctcggactgcagcagcgcccgggcgatctcggcgacggtcagcccggacaccaagcgcagcgtcagcgccagctgcgacggccggtccagggccgggtgcgcgcaggtgaacatcatccgcagctcgtcgtcgcgcaccggatgcgggtcggcggcatcggtgcgcgcccgaatgtcgtccagcacggcggccaattcctttccgggacgcgcggattcgcggcgcagccgatcgcgggcgcggttgcgtgcgacggtgaccagccagccgcccggattggcgggcatcccgtcgcgaggccagacgcgcagcgcctcggcgcaggcctcctggacggcgtcctcggcgacggtgaggtcacccgaccaccgcgccagcgcggcgacggcgggtccccactcccggcggaagacgccgtccaggtcggccatgcgcctacaggccggagactcccgccagctggcgcagctgcaccgtcgacgcgggaatcatggacgcgatcttgacggcctcgtcgcgatcggcggcgcccagcaggtagatcccggtggcgatctccgcgctctccacatacggcccgtcggtgatcagcacctcgccgtcgcgcacccgcaccgtggtggcggtggacttgtcgtgcagcgcggcgccgccgatgatgtggtcgccggcggccgcgtgcagctccgcgtgcttggcggccaccgcctcccactccggcgtgccgggcgtgtgggcggattcggccggttccagcagcagcgccagccagtcgttgccggtgatcctgcgggacggctcgaccgcgtgcaccaccggccacagctccaccgccccgaacgcggcgaccggcacgtcgcgcgccagcgccagcgcctcgtcgaggttttcggcctcgaaaatgtagtagccgcaggccacctccgcggtctcggcgaacgggccgtcggtcaccaccggcgcgtcggggccgccggtgatgacagccgcggccgcggcgggcgccagcgcgtcaccggccttgatcgccggccctgccttggcgtggaagctttcccacgccgccatcgcggcggccgcgtcgtcgggcttgcgctcccgctccctgctgatcaacagcgcgaagtactgcatgtcgtcacctccaggtggtgagcggaaccgtgtgttccactctctacctactcgacgaacggcgcagccctaatccgacagccgccgcgaaaatcaggcggccgcccccggcttgaggtaggtcaccaggctgcagtcgagcatctcctcggtgaagtagtgctcgcagccgcgcaggtacttgatgtagcggttgtacacctcttcggaggtgacctcgatggccttgtcccggttcgactccagcgtgtcgccccagatgtgcagcgtcttgatgtagtgcggccgcaacgaaagaggttcgggcacaacgaatcccgccttctcgccgtgatcgaccatcatctgggtggacggcagccggccgccggggaagatctcggtgacgatgaacttgatgaaccgcgccgtctcgaagctcagcttcttgccgcgggcggccaggtcgtaggggtggtagctgacgctactctgcacggtcatccggccatcgtcgggcatgatgtcgaaggtccgcttgaagaagtcgtcgtagttctcgtggccgaagtgctcgaacgcctcgatggacacgatgcggtcgaccggctcgttgaagtcctcccagttctgcagccgcacctggcgggagcggttgctgtccagcgaggcgagcagctcctcgcagcgggcgtgctggttcttggacagcgtcaggccgatcacgttgacgtcgaaccgctccacggcgcgcttcatggtggtgccccacccgcagccgatgtccagcagcgtcatgcccggtttgaggtccagcttgtccaggttgaggtcgatcttggcgtactgcgcctcttccaggctcatgtcgtcgcgcgcgaagtaggcgcagctgtaggtccgggtcgggtcctggaacaggccgaagaaatcgtcggagacgtcgtagtgcgcctggatgtcctccgaacgtgtccgggtcttggtcgggctactcggttgctcagccatgttcgtcctgttctcctggaggaggcgttcctgacggtgcgagtgcgcgtcgcgggcccgaccgcggatgcaaagtctactgcgctacttggtcagggtgtattgggccacgttggagattcctttgcggaacagctccgcgcagccggtcaggtagcgcatgaagcggtcgtagacctcctgcgactggatggcgatggcctgctcccggttggcctccaggttggctgcccaggtgtccagggtccgggcgtagtgcggccgcaggtactggacctgctccagcgagaagccgctggcctgggacaggtcgacgatgtcggcttcgccgcacatctgcccgccggggaagatctccttgcccaggaagtggaagaaccgcagatccgacatggtgatcgggatgccgcgttccttccactgcgactgcgggtaggtgaagatgctgtgcatcagcatccggctgtcgttgggcaggctcttgtaggcccaatcccagaacgcgggccagcgttcctttttgaacgcgtcgaaggcctcgaagctgatgatctggtcgacgggctcgtcgaactcttcccaaccctgcagccgcgcctcggcgcgtcgggtggtcgggatcgcggccagcctctccttggtgcgcgcatagtggttgcggctgagcgtgataccgatgacgttcacgtcgtatttttccagcgcccgcaccacggccccaccccagccgcagccgacgtcgagcagcgtcatgcccggttcgaggttcagcttgtccagccccagatccagcttggccagctgcgcctgttccagcgtcatgtcgtcgttttcgaaataggcgcaggtgtacaccatgttggggtcgaggaacaacgcgaagaagtcgtcggaaatgtcgtaggttgcttgcgactcttcgtaatacggcttcagcttggccatcggttacacccaccctccttcgacaaccgtacaactctgtgacttggactgaaaattgcggggaaccgtttctaccgagagtttttggctcagctggccttggcgaagttgttcgccagcacgccgatcacctgatcccacaactgctgtggcagatcatgacccatcccgtcgaataacaccaatcgggcgccgtcgatggcgcgggccaccgcgcggcccccgaacggccgcatcagcttgtccgcccggccgtggatcaccacggtgggcgcggtggtccgacggttgtagcggcgcaggctgccgctgcccagcacggcggaaaagtgtcgggcgacgccctgtgggtagtagttgcggtcgtagccctcggcggcctcggcgcgcgcctgctcctcgggcacccggtagcgcgggctgccgatgatcctgccgacccgcaccgcgttgtcgatgatcacctcgcgcggcgagtcgggcggcggccccttcagcagcgccagcagcgcccgcggcgccggcggcggcagcagcgcggaattgttgctggagaagatgaccgccagggttttggtgcgctggcggaaccgggcggcgaaaatctgggcgatcatgccgcccatcgacgcccccacgatgtgggcgtcgtcgatgcccaaatggtccagcacggccgcggcgtcgtcggccatgtcctcgagccggtacgccgattggctgggcaggcccagccaggaccgcagcagccgggtgaccagcggttgccccgagctgcggtgctcggtcttgctggacagccccacgtcgcggttgtcgtaccggatcacccgcagcccgcggcccaccagcttctcgcagaacgcggtccgccacagcagcagctgggcgcccagccccatgatcagcagcaccggcgggtcgtcgatgtcgcccatgtcctcgtagtagagcttcaggtcgcctgatatggcgtgccccgtgcggacctgcaccatcgaaggcccctagacctcgacgtcggattcgaactcggaggagtgctcgcggctgacctcgaccatgaagttggcgaaatacccggtcagttgaggatccgacatcatctgccacttgggtgccagcagcttcatgtagcgctcgacgtagaggaactgcttgccgatcagcaccagctcgcggggcagcttgacgtcgtaggcgtcggccagcgccgacagctggcggccgatgtcggcataggacatgtcgcccagggtctgcatggtcagcggggtggcgaatttctccaggtccttggcggcctgggcttcgggtttcacggtgcccacggcgcccatcagcaccacgatcttgccggccgcggcgtggtccttcttgaccagcagcgcatacacgagctcgcgcagcagccagcgggtgcgcgggtcgatgcggcccatgatgccgaagtcgaagaacacgatgcggcccgcctcgtcgacgtagaggttgccggcgtgcaggtcgccgtggaacaggccgtgccgcagcccgccctcgaacaggctgaacagcagcgccttgaccagctcaaccccgtcgaacccggccttgcggaccgcggcgacgtcgtcgatgcggatcccggacacccgctccatggtcagcacccggtcggtggtgaagtcccagtacacctgcggcacccggatgtttttgcccagcggcgaggcgtgcaggtgcgacacccaggcctccatcgactgggcctccagccggaagttcagctcctcggccaggttgtcggagaagtcggcgaccacgtcctgggcggacagccggcggccgagcttggccagctcgacggcctgggcgaagcgcttgaggatctgcaggtcggcggcgacccggcggcggatgcccggccgctggatcttgacgacgacctcctcgccggtgtgcagggtggcgtagtgcacctgggcgatggacgccgaggcgaacggggtctcgtcccagctggcgaacagctcggacgggtcggccccgagctcctcgaggaacagcttgtgcacctcgtcggggtcggcgggcggcacccggtccaacaggccgcggaactcccgggacagcgattcgccgaacgcgccggggctggacgcgatgatctgcccgaacttgacgtaggtgggccccaggtcggcgaacgtctgggggagctgcttgatcactttctgctgccacgggcccttggccggcagcttggtgaggacgcgagcggcggagcgggtgacctgccaaccggtcgccgctacccgggccgcctcgaccggcaacggcacccggtcgagcttggccacctctcgatgtttggtagagctcatcagtgcagtgtgccaaatcggcgctggcgagtcccaatccgctagcgacgatcgccgccgcccttccagggctgcacccagccctcgatggcccagccctcccgcgcggcgatcaactcgtacatggtggcgccgtcgatcgtctcccggatgatgtcggcgtgcccggcgtgccgggccagctcgttgatgacgtgcaggatcacccagcgcaccgaccaggcctgcaggtccttgggaaaccaagggatgtcgtgcggcaccggcaccgcggcgtccaggtcggccgtctgcgccagccgcagcgattcggcgttctgggcctcgaacgcgtccagcagctcttgcagcgtctcgtcgggccgcatcacgtgctggtcggcgaactcggcggcgacctgctcgaacgggcgggtgtccttcgggggtgcgccgggcgcggcggcgacgcgggccatccagctgcgttgcatgccggtggcgtgcttgatcagcccgccgatcgacaaggcgctgaccgacggcgccgagcgggcctgcccgtcggtcaggccgtgcgacaccgcgaagtaggcactttggtgatacgccaggaattcgcacagggcactgcgttcgtcggccaccggacgggcgagagcgggcatcggtcgatcttaggtcgtgcgggccgtaaagtgcggggatgcaggtggtttcggcatggaaataacgtcggcgctctcgaccgagctgttcgtcgggccacccgaggcgccgctgcagctggtccgcgtcgccgtcgccggctgcgccgagcgcaccccggtccgcgtcgacggccccggtctgcgcgggcgcgcgctcgccgaagccggcgccgaggtcatcgaggtggcggtgacggtcgacgaacccgtcgtcgggcagcgccggcccgcgcgggcgggcgccggagaggcggagctgccgttcgaatttaccgtggccgagcccggctggacgatgttcatggtcagccacttccactacgacccggtgtggtggaacacccagggcgcctacaccagcgagtggaccgaggacccgcccgggcgggcccggcagaccaacggcttcgacctggtgcacgcacatctggagatggcccgccgcgagcccgagtacaagttcgtgctggccgaggtggactacctcaagccgtactgggacacccgccccgaagaccgcgccgacctgcgccggttcatcgcgcagggccgggtcgaggtgatgggcggcacctacaacgaacccaacaccaacctcaccagcacggagacgaccatccgaaacctggtgcacggcatgggttttcagcgcgacgtgctgggggccgacccggccaccgcgtggcagctggacgtgttcggtcacgatccgcagttcccggggctggccgccgacgccggcctgacgtcgagctcctgggcgcgcgggccgcaccaccagtggggcccggcgaccggcgacggctccgacggcggcgtcgagcgcatgcagttctccagcgaattcgagtggatcgcgccgtcgggccgcggcctgctcacccactacatgcccgcgcactattcggcgggctggtggatggattcggcggcgtcgctggccgaggcgcaggacgccacctacgcgctgttcgtccagctgaaaaaggtcgcgctgacccgcaacgtgctgctgccggccggcaccgactacaccccaccgaacaagtgggtcaccgccatccgccgcgactgggcggcccgctacacctggccccgcttcgtgtgcgcgctgccccgggagttcttcgcggcagtgcgcgccgaactggcgcagcgcggcggcgcgccgtctccgcagacccgcgacatgaacccgatctacaccggcaaggacgtgtcctacatcgacaccaagcaggccaaccgggccgccgagaacacggtgctggccgccgagcgcttcgcggtgttcgccgggctgctggccggcgccgaatacccggaggcggccctggccaaggcctgggtgcagctggcctacggcgcccaccacgacgccatcaccggctcggaatccgaccaggtctacctggacctgctgaccggctggcgggacgcctgggagctgggccgcaccgtccgcgacgacgcgctggcgctgctgtctcgccgggtcgacggcgccgacgtggcggtgtggaacccgctcaacggccggcgcaccgacgtggtcaccgcgcggctggacgcggcgccgggcgccggggtgcgggtgctcgacgcggacggcgtcgaggtgcccgcgcacgtcgagcacggcgggcgctcggtcagctggctggctcgcgacgtgccgtcgctgggctggcgggcctaccggctggtcgcgggcgaggcggcgagcgggtgggcgccgctgcggggcagcgcgatcgccaacgagcactaccggctggcggtcgacgccgagcgcggcgggacagtggcgtcgctgatcgccgacggtcgcgagctgatcgccgagggccgggtgggtaacgagctggccgtctacgaggagtacccgtcgcacccgagccagggcgagggcccgtggcacctgctgcccaaggggccggtggtgtgctcgtcggcgacgcgggcgcgggtgcgggcctaccggggcccgctcggggagcgggtcgtggtgcacggccggatcggcacgctgctgcgctacacccagaccctgacgctgtggcgcggcgtcgcgcgggtggactgccgcaccaccatcgacgagttcaccggcgccgaccggctggtgcggctccgctggccgtgcccggtgccgggggccatgccggtcagcgaggtcggcgacgccgtcgtcggccggggtttcgcgctgctgcacgacggggaccgggcgctggacaccgcccggcacccgtggaccctggacaacccggcctacggctggttcggcttgtcctcggtggcccgggtccgcatcagcgacggcggcctccggtgcctgtcggtggccgaggtggtgtcgccggcggagacgacgtccggcccgctggcccgggagttgctggtcgcgctggtccgggcgggcgtcacggccacctgcagcgccgccgacgggccgcgctacggccacctcgaggtcgactccaacctgcccgacgtgcgtgtcgcgctgggcgggccgcgccgcaacgccttcaccgcggccgtgctggccgacgccgacccggcctacgccgacgagctgcggcgtcagctggcggcgaccggccgggccaggctgtgggtgccggcccgcgcgccgctggccgcggtgtggctgcccgacgccgacctgcgcgacgcgcgggcgctgccggtgctggtggtcgacggccgcgacgagcgcgagctgcgcgcggcgatcgccgcgctggtcgacgacctcggcgacgccgagatcaccgtcacccagcaatcgccttcgcggacagagggtttcgacgattacaccgtcgcgctgctgaaccggggtgtgcccagcttcgcggtcgacaccgcgggcaccctgcacaccgcgctgctgcggtcctgcaccggctggccgtcgggcatctggatcgacgacccgcgccgcagcgcgccagacggctccaatttccagctgcagcactggacccaccatttcgactacgcgttggtcagcggccccggcgactggcggcgcgccgaaatccccgctcgcagcgcgcaattcgggaatccgctgttagccgtcgcggcgggcggcggcgcgggcaccgggcccggtctgccgccggccggttcgctgctgcgggtgcagcccgccgaatcggtccagctggccgccctcaaggcggccggcaacccgctggcgtcgggcagcgcggcacggcccgacccgaccgcggtggccctgcggctggtggaaaccgccggggcgggcacccgcgtcgccgtcgactccgacgtggcgacggtgagcgatctgcacgccgccgatctgctggaaaagccgtcccgccaagtgaattcgatcgacctgcacggctaccaggtggccacggtgctggcccgcctgcacgcgccggccgccccggccggcgccgccgcgctcgcgccgcacgccgaggccgcccagccgctctacgcgcgctactggctgcacaaccggggccccgcgccgctcggcgggctgcccgccgtcgcccacctgcatccggcgcgggcgtcggccgacccggacagcagggtcacgctgcggctgtcggcggccagcgactgcaccgacgccacgctggccggcgcggtggtgctgcgctgcccggacggctggtcggccgacccggccgagctgccgctgcggctgtgcgccggccagcacctgcaggccgacatcgcggtgtcggtcccggcccgcgccgcaccggggctctatccggtccgggccgaactgcgcctcaccggggagcacctcccggcgtcctggcgccagggcgtcgaggacgtgtgcgtggtggcggtgggcgacggcgagcgggcgccgctgatctacctggctgacgagccggccgaggtcacgctggaacccggcgaggccgcggacctgaccgtcaccgtcggcagccacgcccgcgccgagctggcgctggaggcccacctgatcagcccgtggggcacctgggactggatggggcccgccgcggtcggcgccgtcctgcccgcccgcggcgccgtcgacctcggcttccggctggccccgccggcctggctggaccccggccagtggtgggcgctggtccggatcggctgcgcgggcgaactgctctactcgccggcggtgcgggtgacggtcacatgagcggccacccggttgcgaccgttgccggcgtcccggtttcctccgtcgaggtcgacgccgccgaggcccggttgcgcggcgggcgcggggcggcggcgctgccgacgcccggcaccagcgagggccggcaactgcggcgctggctgacccaactgatcgtgacccgccgcgtcatcgccgccgaggcggccgcccgcggcctgaccccggccggcgcgccgaacgaggccgagctgttgcccgacgtgaccgcccggctggagatcggcagcgtggccgccgccgtgctggccgacccgctggcccgagcgttgttcgccgacgtcaccgccgcggtggacgtcgccgagcgggagctggccgcctaccacgcccgcaacccgctccggttcgccccatcgcggcccgtccaaaatgtttggcgcacaacggctttggttgccccgccgctggacgaggtgcgaccggtgatccgcgagcagttgcgcggcgcggcgcggcggcgggcgtttcggctgtggctggacgaacgccgcgccgcgctggtgcggctcgcgcccggctacgagcatcccggcgacccccgccaacccgacaacacgcatcggcactgatcggcatgctcaccctcggcctggacatcggcggcaccaaaatcgctgccgcacttgttgattcggtcggcacgctggtccacaccgctgtccgccccacccccaacccggccccggccgacgatgtgtgggatgtggtgcacgccctgatcgccgaggtggtgcgggcggccggcgccccgatcgcggccgtgggtatcgcgtcggcggggcccgtcgacctgcccagcggatccgtcagcccgatcaacatcgccggctggcaccgtttcccgttgcgcgacaaggtcgccgcggcggtgcccgcgacaccggtggtgctgggcggcgacgggctctgcatggcgctgggggagcagtggctgggcgcgggacgcggcgcccgtttcctgctgggcatggtggtctccacgggggtgggtggcggcctggtgctcgacggcgccccctacccgggccgcaccggcaacgccggtcacgtcgggcacgtggtggtcgaactggacggccggccctgcacctgcggcgggcatggctgcgtggagacggtggcctccgggccgtcgatggtgcgctgggcgcgcgaaaacgggtggtcggcggcgccgggggccggcgcccgggacctggccgccgccgcggcctcagacccgttggcgcagaaggcgtttcaccggtcggccgacgcgctcgcggcgatgatcgcctcggtcggtgcggtgtgcgatctggacgtggtggtgatcgggggaggcgtcgcccagtccgggccgctgctgttcgacccgctgcgcgaaaggctggcccactacgccgggctggacttcctgtccgggctgacggtggtgccgggggaactcggcggcaatgccgggctgatcggcgcggcccggctggcgaccctggcgcgacccgccggctcctaggctgacccaatggaccacagcatcgacgcgctcgcggtcgtgatcatggggctgatggtcggcgtggagctggcggtcgcggtgttcttccacccgctcatcgcccggctgcccgacgacgccttccgcaccgcccgcggcggcgccgcgcgggcgctgggcacggtgatgccgttctggtacgcgatgacgttgttgctgctgggctcgctcgccgtgcaggaacggggcgccccctacgactggctggtcggcgtcgccgccggcctgatggccgtggtggtgctggtgacggtgaccatgctggtgccgatcaacaaccggatcgcgaaatggccggccggcgggcagctgtcgcgcgaactggcggcgcgctgggaccggcgccaccggctgcgggtggttctgctgctgggtgcctatgtgctgctcaccgtcgcggtcaccggagccgtcacctgagccgtgaaccgagccgtgacctgagcccgtgaagacgccgttttggctgatcgcgcggcccgcgctatggtgttagccgatccaccgaagaccgtcggtcaccgagcaatcggtcgaaggtccgggaacatcccggcggcccacgcaggaggacgaggcagcagcgccggcgtcagcgccggttgttcgttacgccccggccgtgtcctgcgccggggcgttcgtcgttttcgggggacacgagacgacacgtcgcactgactttcacttcaggagcaggaggtaggcatggccagggctgacaaggccaccgccgttgcagacatcgccgagcagttcaaggaggcgaccgcgaccctgatcaccgagtaccggggtctgacggtcgccaacctggccgagctgcggcgctcgctgagcggggcggccacctactcggtggccaagaacacgctggtcaagcgggcggcgtcggaggccggcatcgagggcctggacgagctcttcgccggcccgacggccatcgcgttcgtcaccggggaaccggtcgacgcggccaaggccatcaagaccttcgccaaggagcacaaggcgctggtcatcaagggcggctacatggacggccgggcgctctcggtcgccgaggtggagcgcatcgccgacctcgagtcccgcgaggtgctgctggccaagctggccggcgcgatgaagggaaacctggccaaggcggccgggctgttcaacgccccggcctcgcaggtcgcccgcctggcggccgccctgcaggagaagaaggccgccgaaggccccgccgaggccccgcaaccagctaccgaaccacccgccgaggcccccgaggccccggccgacgccgaataaccaccaaacccggaacttgggaagaacaaggaaggacccacacccatggcaaagatgtccaccgacgacctgctcgacgccttcaaggagatgaccctgctggagctctccgacttcgtgaagaagttcgaggagaccttcgaggtcaccgcggccgccccggtcgccgtcgccgcggccggcccggccgccggtggcgcgcccgccgaggccgccgaggagcagtcggagttcgacgtgatcctcgagtccgccggcgacaagaagatcggcgtgatcaaggtggtccgcgagatcgtctccggcctgggcctcaaggaggccaaggacctggtcgacggcgcgcccaagccgctgctggagaaggtcgccaaggaggcggccgacgacgccaaggccaagctcgaggccgccggcgccaccgtcaccgtcaagtaagccggttcgcgcgaaacccccgggatgcctgcccgcgcaggccccgggggtttcgtgtgctcagctcccgagcatcgccgagcgcatcgactgcgacacccgcttgggtgaatcaccaagcgcgacaagcagattcgaggtcatcgagccgagcaccggcagcaccgccgagccgtcgtcgctgcagtagccggccagctcgagcatcacgaacccgtggatggacgcccagaactgggccgccgtcgccaccaccgcgccgtcgtcgtcggccgggccggcggtgatccgcccggcccgcatgcaccggtgcaccgcgcgcaccacgtgcgcgaagctggggtagttctgctcgatctcggccaccgtcagcgtcagcacgttgtgggcgggcgcgttgatgccgtgcgcgctggtgctgccgaacatcagccgatacatgtgccgatgtctgatcgcgtagcgccggtaggccgcgccgatcacgaacaggtccgcgaccgggtcgtcggtcggcggcaccgtcagcgcggcgtcgaactgccgtagcccctcctcggccacctcggcgatcagcccccgcatcccgccgaaatgggtgtacaccgccatcgtcgaggtgcccgccgccccggcgaccttgcgggtctgcagcgcgtcgggaccgtgctcgtgcagcagcgccacggccgcggcgagcatgccgtcgcggacgttgcgctgcggggctggttgcgaagtcatcgttgcgatcgtcccttccccggcgtaccgtcgcaataacagcgtaatatcaatgttataggagtcgggcatgacctccacgcgcaccgtcgccaatcccctatctggacggcttcctggcgccggtgcgcgccgaagtcaccgcgttcgacctgcccgtcaccggacgcattcccgaccacctcgacgggcgctacctgcgcaacggccccaacccggtcgccgaggtcgacccggcgacctaccactggttcagcggcgacgggatggtccacggcgtggcgctgcgcgacgggcgggcccgctggtatcgcaaccgctgggtgcgcaccgcgcacgtgtgtgccgcgctcggcgagcccgcgcccggcgggctggacccgcgcgccggaatgctgtccgtcggacccaacaccaacgtgctcggccacgccgggcagacgctggccctggtcgaagggggcggcgccaactaccggctcaccgaggacctggacaccgtcggcacctgcgacttcgacggaaccctgttcggcggctacaccgcccacccgcaccgcgacccccgtaccggcgaattgcacgccgtctcctactcgttcgggcgggggcgccgcgtgcagtactcggtgatcgacaccgccggccgcgcgcggcgcaccgtcgacatcgaggtgagcgggtcgccgatgatgcacgacttctcgctcaccgacgagtacgtggtgatctacgacctgcccgtgacgttcgaccccgtccaggtgatgccggccgacgtgccgcgctggctgagcgcaccggcgcggctggtcgtgcagtcgctgctcgggcgggtgcagctgcccggcccgatggccacggcgatgaaccgcaatcggcagccgctgcaccggatgccctaccggtggaacgacgcctacccggcgcggctgggcgtcatgccccgcgacggcggtaacgacgaggttcggtggttcgacatcgagccctgctacgtctaccacccgctcaacgcctactccgaaatacgtgacggcgcaaaggttttggtgctcgacgtggtgcgctactcgcggatgttcgaccgcgacctgcgcggtcccggcgacacccgcccgacgctggaccgctggaccgtcaacctgacgaccggggcggtcggcagcgagctgcgcgacgaccgctcgcaggagttcccccggatcaacgaggccctgctgggccggcggcaccgcttcggctacaccgtcggcaccgacggcggctacccgtccgacggcgcctcggagatgtccaccggcctgtacaagcacgactacgccaccggctcgcgccgggtcgcgccgctggaccccgaccttttgatcggcgagatgtgcttcgtgcccaacccggccggcggccaagacggcgcggaggacgacggcatcctgatgggcttcggctatcaccgcggccgcgacgaaggccagctggtgttgctggacgcccagagtctcgagcaggtggcgaccgtgcacctgccgcagcgggtcccgatgggcttccacggcaactgggtgcccgctggctaacacgtgcgtcaaataagttgtgccgcgcgcggttccgggtgatctcgggacggccaaatttgcacggcggtgccgcgcaaccctgatgccgtgtggcaggcgtgcgctacagtgactcatgccacagaaaagggcaggtggcgggcatgagcgtcgacggaaggatctcccatgggcgtcgctattgaggtgaacggcctcacgaagtccttcggatcgtcacgaatttgggaggacgtgaccctggaaatccccgccggggaggtcagcgtgctgctggggccgtcgggtaccggcaaatcggtgttcctgaaatcgctgatcggtctgctgcgccccgagcgcggctcggtggtcatcgacggcaccgacatcctgcagtgctcggccaaggagctctacgagatccgcaccctgttcggcgtgatgttccaggacggcgccctgttcggttcgatgaacctgttcgacaacgccgccttcccgctgcgcgagcacaccaagaagaaggaaagcgagatccgtgacatcgtcatggagaagctggaactggtgggtctgggcggcgacgagaagaagttccccggcgagatctccggcggtatgcgcaagcgcgccagcctggcccgcgccctggtgatggacccgcagatcatcctgtgcgacgagccggactccggtctggacccggtgcgcaccgcctacctgagccagctgatcctcgacatcaacgcccagatcgacgccaccgtcctgatcgtcacgcacaacatcaacatcgcccgcaccgtgccggacaacatgggcatgctgttccgccgcaagctggtcatgttcggcccccgcgaggtgctgctgaccagcgacgagcccgtggtcaagcagttcctcaacggccgccgcatcgggccgatcggcatgtccgaggagaaggacgaggccaccatggccgaagagcaggccgcgctggaggccggtcagcacgccggcggtgtggaggagatcgagggcgtgccgccccagatcgtcgcctcgccgggcatgccggagcgcaaggccgtcgcccggcgccaggcccgggtgcgcgagatcctgcacaccctgccgcagaaggcgcaggcggcgatcctcgacgacctggagggcacccacaagtaccgggcacacgaggtcggtgactagcgcggccggcccgaaagttcgcgataacttcgcgtaacttggcggcccgccctcttgacgacgggccgtaaacgggccagtctgttgggcagcatgtatccagcggaaactcgagacgccagccagcgccgatgtccctggattgcttgtgctggacagttgaggaatgcgccgccctgcgctattgttggacgttgcgctggctacctcctgcccacctcacccgccacttgacaccgtggtctaagcctgagcccgttgatgtggcttagttctttagttgcgcgcgtgagatccggacagttcgtttgccggccgaaccgacacaattcgcggcgaacgcagccggtggtcccggccttcgtgagtcgcacgaggtgctggaaggatgcatcttggcagatttccgccagagcaagacggatcgcccacaaagttcctcaaacggatcaagttccttgaacggctccgtgcccggagcgcccaaccgagtttccttcgccaagctgcgcgaaccgctcgaggttcccggcctgctggacgtgcagatcgactccttcgagtggttgatcggcgcgccgcggtggcgtgaggccgcgatcgcccgcggcgacgcggagcccaagggcgggttggaagaggtgctcgacgagctgtcgccgatcgaggacttctcgggctcgatgtcgctgtctttctccgacccccgcttcgacgaggtcaaggcgccggtcgacgagtgcaaagacaaggacatgacgtacgcggccccgctgttcgtcacggccgagttcatcaacaacaacaccggcgagatcaagagccagacggtgttcatgggtgacttcccgatgatgaccgagaagggcaccttcatcatcaacgggaccgagcgcgtggtggtcagccagctggtccgctcgccgggcgtgtacttcgacgagaccatcgacaagtccaccgagaagacgctgcacagcgtcaaggtgatccccagccgcggcgcctggctggagttcgacgtcgacaagcgcgacaccgtcggcgtgcgcatcgaccgcaagcgccgccagccggtcaccgtgctgctcaaggcgctgggttggaccaacgagcagatcaccgagcggttcggcttctccgagatcatgatgtcgacgctggagaaggacaacaccgccggcaccgacgaggcgctgctggacatctaccgcaagctgcgcccgggcgagccgccgaccaaggagtccgcgcagaccctgctggagaacctgttcttcaaggagaagcgctacgacctggcccgggtgggccgctacaaggtcaacaagaagctcggcctgcacgccggtgagccgatcaccagctcgacgctgaccgaggaagacgtcgtcgccaccatcgagtacctggtgcgcctgcacgagggtcagcccacgatgaccgtcccgggcggcatcgaggtgccggtggagaccgacgacatcgaccacttcggcaaccgccggctgcgcaccgtcggtgagctgatccagaaccagatccgggtcggcatgtcccggatggagcgcgtcgtccgcgagcggatgaccacccaggacgtcgaggccatcacgccgcagaccctgatcaacatccgtcccgtcgtggcggcgatcaaggagttcttcggcaccagccagttgtcccagttcatggaccagaacaacccgctgtcggggctcacccacaagcgccgcctgtcggcgctgggcccgggtggtctgtcccgggagcgggccgggctggaggtccgcgacgtgcacccgtcccactacggccggatgtgcccgatcgagaccccggagggtcccaacatcggtctgatcggctcgctgtcggtgtacgcgcgggtcaacccgttcgggttcatcgagacgccgtaccgcaaggtggtcgacggcgtggtcaccgacgagatccactacctgaccgccgacgaggaggaccgccacgtggtggcgcaggccaactcgccgatcgacgacaagggccggttcgccgaggcccgggtgctggtccgccgcaaggcgggcgaggtcgagtacgtgccctcgtccgaggtggactacatggacgtgtcaccgcgccagatggtgtcggtggccaccgcgatgatcccgttcctcgagcacgacgacgccaaccgtgccctgatgggcgccaacatgcagcgccaggcggttccgctggtgcgcagcgaggcgccgctggtgggcaccggcatggagctgcgtgccgcgatcgacgccggcgacgtcgtcgtcgccgagaagtccggggtgatcgaggaggtctccgccgactacatcaccgtgatggccgacgacggcacccggcacacctaccggatgcgcaagttcgagcggtccaaccacggcacctgcgccaaccagagcccgatcgtcgacgccggcgaccgggtcgaggccggccaggtcatcgccgacggtccgtgcaccgagaacggcgagatggcgctgggcaagaacctgctcgtggcgatcatgccgtgggagggccacaactacgaggacgcgatcatcctctccaaccggctggttgaggaggacgtgttgacgtccatccacatcgaggagcacgagatcgacgcccgcgacaccaagctgggcgccgaggagatcacccgggacatcccgaacgtctccgacgaggtgctggccgacctggacgagcgcggcatcgtgcgcatcggcgccgaggtccgcgacggcgacatcctggtcggcaaggtcaccccgaagggggagaccgagctgacgccggaggagcggctgctgcgcgccatcttcggcgagaaggcccgcgaggtccgcgacacctcgctgaaggtgccgcacggcgagtccggcaaggtcatcggcatccgggtgttctcccgcgaggacgacgacgagctgcccgccggggtcaacgagctggtccgcgtctacgtggcccagaagcgcaagatctccgacggtgacaagctcgccggccggcacggcaacaagggcgtcatcggcaagatcctgccgcaggaggacatgccgttcctaccggacggcacgccggtggacatcatcctgaacacccacggtgtgccgcgacggatgaacatcggccagatcctggagacccacctggggtgggtggccaagtccggctggaacatcgacggcaatcccgagtgggcggtcaacctgcccgaggagctgcggcacgcacagccgaaccagatcgtgtcgacaccggtgttcgacggcgccaaggaagaggagctggccggcatgctgtcgtgcacgctgcccaaccgcgacggcgaggtcatggtggacggcgacggcaaggcggtgctgttcgacggccggtccggggagccgttcccgtacccggtgaccgtcggctacatgtacatcatgaagctgcaccacctggtggacgacaagatccacgcccgctccaccggcccgtactcgatgatcacccagcagccgctgggcggtaaggcgcagttcggtggccagcgcttcggtgagatggagtgctgggccatgcaggcctacggcgcggcgtacacgctgcaggagctgttgaccatcaagtccgacgacacggtcggccgggtcaaggtgtacgaggcgatcgtcaagggcgagaacatcccggagccgggtatccccgagtccttcaaggtgttgctcaaggagctgcagtcgctgtgcctcaacgtcgaggtgctctcctccgacggcgcggccatcgagctgcgcgaaggcgaggacgaggacctggagcgggccgcggcgaacctgggaatcaacttgtcccgcaacgaatccgcgtccgtcgaggacctggcttaaccaactttttcactaaccaaacccgcaaggggaaagggagttacgtgctcgacgtcaacttcttcgatgaactccggatcggtctggccaccgcggaggacatcaggcaatggtcgtacggcgaggtcaagaagccggagaccatcaactaccgcacgctcaagccggagaaggacggcctgttctgcgagaagatcttcggaccgactcgcgactgggagtgctactgcggcaagtacaagcgcgtgcgcttcaagggcatcatctgtgagcgctgcggcgtcgaggtgacccgcgccaaggtgcgccgcgagcgcatgggccacatcgagttggccgcgcccgtcacgcacatctggtacttcaagggcgtgccgtcgcgattgggctacctgctcgacctggcgcccaaggacctcgagaagatcatctacttcgccgcgtacgtgatcacgtccgtcgacgaggagatgcggcacaacgagctctccaccctcgaggccgagatgatggtggagcgcaaggccgtcgaggaccagcgcgacgccgacctggaggcccgcgcccagaagctggaggccgacctggccgagttggaggccgagggtgccaaggccgacgcgcggcgcaaggtccgcgacagcggcgagcgggagatgcgccagatccgcgaccgcgcccagcgcgagctggaccggctggaggacatctggaacaccttcaccaagctggcccccaagcagctgatcgtcgacgagaacctctaccgcgagctggtcgaccgctacggcgagtacttcaccggcgccatgggcgcggagtcgatccagaagctcatcgagaacttcgacatcgacgccgaggccgagcagctgcgtgacgtcatccgaaacggcaaggggcagaagaagcttcgcgccctcaagcggctcaaggtggtcgccgcgttccagcagagcggcaactcgccgatgggcatggtgctcgacgccgtgccggtgatcccgccggagctgcgcccgatggtgcagctcgacggtggccggttcgccaccagcgacctcaacgacctgtaccgccgggtgatcaaccgcaacaaccggctcaagaggctgatcgacctcggtgcccccgagatcatcgtcaacaacgagaagcggatgctgcaggagtccgtggacgcgctgttcgacaacggccgccggggccgcccggtcaccgggccgggcaaccgcccgctgaagtcgttgagcgacctgctcaagggcaagcagggccggttccggcagaacctgctcggtaagcgcgtcgactactccggccgttcggtcatcgtggtcggcccgcagctcaagctgcaccagtgcggtctgcccaagctgatggcgttggagttgttcaagccgttcgtgatgaagcggctggtcgacctcaaccacgcgcagaacatcaagagcgccaagcggatggtggagcgccagcgtccgcaggtgtgggacgtgctggaagaggtcatcgccgagcacccggtgctgctgaaccgcgcgcccaccctgcaccggttgggcatccaggccttcgagccgatgctggtggagggcaaggcaattcagctgcacccgttggtgtgtgaggcgttcaacgccgacttcgacggtgaccagatggcggtgcacctgccgttgagcgccgaggcccaggccgaggcccgcatcctgatgctgtcctccaacaacatcctgtcgcccgcgtcgggccggccgctggccatgccgcgactggacatggtgaccgggctgtactacctgaccaccgaggtcgaaggcgacaagggcgaatactcgccggccgcgaaggatcgtccggagacgggtgtgtactcctcgccggccgaggccatcatggccgccgaccgcggggtgctctcggtgcgggccaagatcaaggtgcggctgacccagttgcgtccgcccgccgagatcgaggccgagctgttcggcgccaacggctggcagccgggcgacgcctggatggccgagaccacgctgggccgggtgctgttcaacgagctgctgccggtgggctacccgttcgtgaacaagcagatgcacaagaaggtgcaggcgtcgatcatcaacgacctggccgagcgctacccgatgatcgtggtcgcgcagaccgtggacaagctcaaggacgccggcttctactgggcgacccgcagcggtgtcaccgtgtcgatggccgacgtgttggttccgccgcgcaagaaggagatcctcgaccagtacgaggagcgggccgagaaggtcgaaaagcagttccagcgtggtgctttgaaccacgacgagcgcaacgaggcgctggtggagatctggaaggaagccaccgacgaggtcggtcaggcgctgcgcgagcactacccggccgacaacccgatcatcacgatcgtcgactcgggcgccaccggtaacttcacccagacccggacgctggccggcatgaagggtctggtgaccaacccgaagggtgagttcatcccgcgtccggtcaagtcgtcgttccgcgagggcctgaccgtgctggagtacttcatcaacacgcacggcgctcgaaagggcttggcggacaccgcgttgcgtactgccgactcgggttatctgacccgtcgtctggtggacgtcagccaggacgtcatcgtgcgcgagcacgactgcgagaccgagcggggcatcgtcgtcgaactggccgagcgtcagcccgacggcaccctgatccgtgacccgtacatcgaaacctcggcgtacgcacggactttgggcaccgacgcggtcgacgaggccggcaacgtcatcgtcgcccgcggcgaggacctcggtgacccggagatcgacgccctgctggcggccggcatcacgtcggtcaaggtgcgctcggtgctgacctgcaccacgggcaccggcgtgtgcgcgacctgctacggccggtcgatggccaccgggaagctggtcgacatcggcgaggccgtcggcatcgtcgccgcccagtccatcggtgagcccggtacccagctgaccatgcgtaccttccaccagggtggtgtcggtgaggacatcaccggcggtctgccccgggtgcaggagctgttcgaggcccgcatcccgcgcggtaaggcgccgatcgccgacgtcaccgggcgggtccgtctcgaggacggtgagcgcttctacaagatcaccatcgttcccgacgacggcagcgaagaggtcgtctacgacaagctgtccaagcggcagcggctgcgcgtgttcaagcacgaggacggctccgagcgggtgctctccgacggcgaccacgtcgaggtgggccagcagctgatggaaggctcggccgacccgcacgaggtgctgcgtgtgcagggcccgcgcgaggtgcagatccacctggtccgcgaggtccaggaggtctaccgcgcacagggtgtgtcgatccacgacaagcacatcgaggtgatcgtccgccagatgctgcgccgcgtcaccatcatcgactcgggctcgacggagttcctgcccggctcgctgatcgaccgcgcggagttcgaggcggagaaccgccgggtggtggccgagggcggcgagcccgcggccgggcgtccggtgctgatgggtatcacgaaggcgagcctcgccaccgactcgtggctgagtgcggcgtcgttccaggagaccacgcgagtgctgaccgacgcggcgatcaactgccgcagcgacaagctcaacggtctgaaggagaacgtgatcatcgggaagctgatcccggccggtaccggcatcaaccggtaccgcaacatccaggtgcagccgaccgaggaggcccgggccgccgcgtacacgatcccgtcctacgaggatcagtactacagcccggacttcggccaggccaccggcgccgcggtgccgctggacgactacggctacagcgactaccgctagtcagtgcgaaaagcccccgccgtgtgcgggggctttttcgtgccgcccggcctttccgccgagcgtgaaattaacttcacgctcggcgcccagcgtgaaactaccgtcacgctcggcgggcgtcgccgagctcgcgggcgtcgccgtgcacgctcggcgtcgccgggcgtcggggcatctcactagactggccgacgtgctcatcggttcacacgtccgcaacgacgacccgctggccgccgcgcaggcggacggcgcagacgcggtgcagttcttcctctccaacccgcagagctggaagaaacccaaaccccgcgacgacgccgaggcgctcaaggcgtcgagcgtgccgctgtacgtgcacgcgccgtatctcatcaacgtcgcctcggcgaacaaccgcgtgcgcatcccgtcgcgcaagatcctgcaggacacctgcgacgccgccgcggagatcaacgccacggcggtcatcgtgcacggcggccacgccgacgacaacgacatggaggccggtttcgaacgctgggtgaaggcgctcgactacctggaaaccgacgtgcaggtgtatctggagaacaccgccggcggcgaccacgcgatggcccgccacttcgacaccatcggccggctgtgggatcgcatcggcgacaaggggattggcttctgcctggacacctgccacgcctgggccgcgggtgaggcgctgatcgacgccgtggaccggatcaaggcgctgaccgggcgcatcgatttggtgcactgcaacgactcccgggacgcggcgggctcgggggccgaccggcacgccaacttcggcaccggccagatcgaccccgacctgctcgtcaccgttgtcaaggccgccgccgcgccggtgatctgcgaaaccgccgacgagggccgcaaggacgacatcgccttcctgcgggagcacaccaagagctgagcaccgcggcgcgctgttacacctcttgtgcaactgtcggaaaaatgtaacattggtggcatgtcggacacgcatgtcgtcaccaactaggtgccacccctggacaactacaaccccgccggctccccggtgctcgtcgaggccctgatccgcgagggtgggcagtggggcctggacgaggtcaacgaggtgggggcgttgtcggccagccgtcaggcgcagcgctggggcgagctcgccgaccgcaaccggcccatcctgcacacccacgaccgcaacggctaccgcgtcgacgaggtcgagtacgacccggcctaccacgagctgatgcgtaccgcgatcgcccacggcctgcacgccgcgccgtgggccgacgaccggccgggggcgcacgtcgtccgcgccgccaagacctcggtgtggacggtcgagccgggacacgtctgcccgatctcgatgacctatgccgtggtgcccgcgctgcgcttcaaccccgagctggccaaggtgtacgagccgctgctgaccagccgcgaatacgacccggaactcagggtggccaccaccaaacccgggatcaccgcgggcatgtcgatgaccgagaagcagggcggctccgacgtgcgtgccggcaccacccaggccgtcccgaacggcgacggctcctaccgcctgaccggccacaagtggttcacctcggcgccgatgtgcgacatcttcctggtgctggcccaggcacccggcgggctgtcttgcttcctgctgccgcgggtgctgcccgacggcacccgcaaccggatgttcctgcagcgtctcaaggacaagctgggcaaccacgccaacgcgtccagcgaggtcgaatacgacggcgccgtcgcctggctggtcggcgaggagggccgcggcgtgccgaccatcatcgagatggtgaacctgacccggctggactgcacgctgggcagcgccaccagtatgcgcaccggcctgacccgcgcgatctaccacgcccagcaccgaaaggcgttcggcgcctacctgattgaccagccgttgatgcgcaacgtgctggccgatctggccgtcgaggccgaggccgcgaccatggtcgcgatgcggatggccggcgccaccgacaaggcggtgcgcggcgatcagcgcgaggccctgctgcgccgcatcggcctggcagccagcaagtactgggtgtgcaagcgttccaccccgcacgccgccgaggcgctggaatgcctgggcggcaacggctacgtcgaggactcgggcatgccgcggctgtaccgggaggcgccgctgatgggcatctgggagggctcgggcaatgtcagcgcgctggacacgttgcgcgccatggcaactcgcccggaatgcgtcgaggtgctgttcgacgaactcgccgaggccgccggtcaggatccgcgcctgggcggccacgtcgaccggctgcgggccgacctggccgagttggacaccatccagtaccgggcccgcaaggtggccgaggacatctgcctggccctgcagggctcgctgctggtgcgccacggccatccggccgtcgccgaggcgttcctgaccacccggctggaccgccggtggggaggcgccttcggcaccatgcccgacgggctggagctggcgcccatcctcgagcgggccctggtcaagggctgaaccacaacatgacttgcgccggcgacgatgcagagcacggcgatggggaggagcggcgccgatgacccacgcgatcaggccggtcgacttcgacaacctgaaaacgatgacctatgaggtcaccgaccgggttgcccggatcaccttcaaccgcccggagaagggcaacgcgatcgtcgcggacaccccgctggagctctccgcgctggtggagcgggccgacctggatcccaacgtgcacgtcatcctggtctccggccgcggcgcgggtttctgcgcgggcttcgacctgagcgcctacgccgatcgcaccggctcggccggcgggaccggtgcctacgcgggcaccgtgctggacggaaaaacccaggcggtcaaccatttaaccgatcagccgtgggacccgatgatcgactatcagatgatgagccgtttcgtgcggggcttctcctccctgatgcacgccgacaaaccgacggtggtcaagatccacggctactgcgtggccggcggcaccgacatcgcgttgcacgccgaccaggtgatcgccgccgccgacgccaagatcggctacccgccgacgcgggtgtggggcgtgccggccgccggcctgtgggcgcaccggctgggcgatcagcgcgccaagcggctgctgttcaccggcgattgcatcaccggcgcgcaagccgccgaatggggtctggccgtcgaggcgcccgatccggccgatctcgacgagcgcaccgagcggctagtgcagcggatcgcggcggtgccggtcaaccagctgatcatggtcaagctcgcgctgaattccgctctgctgcaacagggggtggccaccagccggatggtcagcacggtgttcgacggcgtcgcccggcacaccccggagggccacgccttcgtcgccgacgccgtgaagcacggattccgtgaggcggtgcggcatcgcgacgaaccgttcggcgaccacggccggcaggcctcgcaggtgtagcgatgccggatctgacagcgcggtcggtggtgctcagcgtgctgctcggtgcgcaccccgcgcacgcccgggccagcgaattggtcaggctcacttccgatttcggcatcaaggagtcgacactgcgggtggcgctgacccggatggtgaacgccggcgacctgatccgctcggccgacggctaccggctctcggatcgcctgctcgcgcgccagcggcgacaggacgacgccatcgaccccaaggtccgtccctggcgcgggcagtgggtcacgctgatcgtgaccagcgtgggcgacgacgcgcgtacccgcgctgcgctgcgaaatgccatgcacgacaagcggttcagtgaactgcgcgagggcgtgtggatgcgcccggacaacatcgacacccagctcggaccggacgtcaccgaccgggcgcgggtgatcaccgcccgcgacgacgaccccgccgacctggcggggcggctgtgggacctactcggctgggcccgggccgggcatcggctgctcgacgagatggccgcggcgccagacgttcccggccgtttcgtggcggccgcggcgatggtccggcacctgctcaccgacccggtgctgcccgacgaactgctgcccccggactggcccggcacccggctgcgggcggcctaccacgacttcgccgcggagctgatggcgcggcgcgacccactatttgcggaggcgacatgagcgatccggtgcgaatcgaacgcaacggcccggtcaccacggtgatcatcaaccggccggcggcgcgcaacgcggtcaacggcccgacggcggccgcgctgtacgcggcgttcgaggagttcgaccgcgacgactccgcgtcggtggccgtgctgtggggcgagggcggaacattctgcgccggagcagatttgaaggcgttcggcacgcccgaggccaacgccgtgcaccggagtggccccggcccgatgggcccgacccggatggtgctgtccaaaccggtcatcgccgcggtcagcggctacgccgtcgcgggtggtctggagctggccatctggtgtgatctgcgggtggtcgagcaggacgccgtgttcggggtgttctgccggcgctggggggtcccgctgatcgacggcggcacggtgcggctgccgcggctgatcgggcacagccgcgcgatggacatgatcctcaccggccgcgccgtggccgccgacgaagcccaggccatcggcttggcgaatcgcgttgtccccaaaggtcaatcgcgccgggcggccgaggaattggcggcgcaactggccgcgctgccgcagcagtgcctgcgctcggaccggctctcggcgctacatcagtggggcgcaacggaatccgaggcactcgacttcgaattcgccagcatctcccgggtggccgccgaggccaacgagggcgccggccggttcgccgcgggcgcgggacggcacggcgcctccgcggtttgagggtcagccgcccttgttgatggtgttgctctggccgatcttgtcgaccttggggtcaccgtccttgtaggtgatcgtgttgttcatccccagcacggtgatgcgggtgttgaccttgtcgaaggtgatcttgttgttggtgccgctgacggtcgccgactcgcaggtgccggtgacggtcagggtgttgtccgagccgcccacgttcagcgacttgccgccggcgcagtccagggtggtggtggtgcccatcgacccgtaattgatcgtgttaccgatctcgatggacgcggtggtgctcgccccgcccgatcccgtcgtcggcgccgcgccggcactcgtcgtggcggtgctcttggtggtggtcgtcgacgagcccgccggcgggttggccgtcgaactgcagccggccaacagcagcgccgcggccggtgccacggtcaggcgcagccagcggtcacggacaggtgtgggcgtacgggcgggcatggttcctcgttcccccttgattcgaattatgttgtgctgctgtgctttaaccaggcacctgttggagccggttggtcatgcccaattcgcggccgcggtcccacaggaacggctgaccgctcttgtagaacaccgtctggtcatagccgtacacggtgatgtcgtgcgaaacggagtcggcgataacggtgttcgacgaacccatcaccgtcacggcatagcagttgcccagcgcggtgacgacgttgccggtgccgttgaccagcagggtggcgtcgttgcagtcgatggtctgctcggtgtcctgcccgatgatgtgggtgtcgccgttcttggcctgcgcgacccgcggcggggcaaccgccccggcgaggacggcaagcgcgcaggcggccagtgacccggcgacggtcgtccacttcacggcgggcccccttttgtcacgcggctcgaagatgctcgaacgaggcaagcatgacattacgtgcagatgcccgccggagggcagagtttcttttccttcggcgcgcgtcaactagagtcattagttgatccgtacccgatcgaagggcgaccgcatggcagctcaacccgaaccgccgacggcggccgggcggcagcgcgcgggacggcccgccgcccgcccggccaagctgagccgcgaggggatcatcgacggcgcgctgacgttcctggatcgcgagggctgggacgcgctgaccatcaacgccctggccacccagctgggcaccaaggggccgtcgctgtacaaccacgtggacagcctggaggacctgcgccgcgccgttcggatccgggtcatcgacgacatcatcaccatgctcaaccgggtcggcgagggccgcgcccgcgacgacgcggtgctggtcatggccggcgcctaccgcagctacgcccaccaccaccccggccgctactcggccttcacccggatgccgctgggcggtgacgatcccgagtacaccgccgccacccgcggcgcggccgcgccggtgatctcggtgctgtcctcctacgggctggacggcgaggaggcgttccacgccgcgctggagttctggtccgccctgcacggcttcgtgctgctggagatgaccggcgtgatggacgacatcgacaccgacgccttgttctccgacatggtgctgcggctggcggcgggtctggaacggcggaccgcgcacggctagttcgccgctttgacctgcgagaccggcggcgggtattgtggttcctcgtgcctggcggcttacggcgcctaaccgtaaggaagtgaatgccgggcgaattcgcgtgtccaggatgcatcggaccccggtccggtgcgcagcgcatgcgacacacccggccgcggggcgacccgaacggtcataactgcactatgaagacttgaacaccgcccaaaagacgccaacaccaacacagaaagccgcctagatgccaaccattcagcagctggtccgcaagggtcgtcgggacaagatcggcaaggtcaagaccgcggctctcaagggcagcccgcagcgccgtggcgtatgcacccgcgtgtacaccaccaccccgaagaagccgaactcggcgcttcggaaggtcgcccgcgtgaagctgacgagccaggtcgaggtcaccgcctacatccccggcgagggccacaacctgcaggagcactccatggtgctggtgcgcggcggccgggtgaaggacctgcccggtgtgcggtacaagatcatccgcggctcgctggacacccagggtgtcaagaaccgcaagcaggctcgcagccgttacggcgccaagaaggagaagagctgatgccgcgcaaggggcccgcgccgaagcgcccgttggtcaacgacccggtctacgggtcgcaactggtcacccagctggtgaacaaagtcctgctgaaggggaagaaatcgctcgccgagcgcattgtgtatggtgcgctcgagaacgcccgggagaagacaggtaccgatcccgtgatcacgctcaagcgtgctctcgacaacgtcaagcccgccctcgaggtgcgcagccgccgggtcggcggtgccacctaccaggtgcccgtcgaggtgcgtccggaccggtccaccacgctggcgctgcgctggcttgtcagcttctcgcggcaacgccgggagaagaccatggtcgagcggctggcaaacgagatcctggatgccagcaacggcctcggggcctccgtcaagcggcgcgaggacacccacaagatggccgaggccaaccgcgccttcgcgcactaccgctggtgatcaacgccgcgcgcacagtggcggcgacgacagcgaactaaccgagcaatcgaaagagtgggaagacttctgtggcacagaaggacgtgctgaccgacctgaccaaggtccgcaacatcggcatcatggcgcacatcgacgccggcaagacgacgacgaccgagcgcatcctctactacaccggcatcagctacaagatcggtgaggtgcacgacggcgccgccaccatggactggatggagcaggagcaggagcgggggatcaccatcacctccgcggccaccacctgcttctggaacgacaaccagatcaacatcatcgacaccccgggccacgtcgacttcaccgtcgaggtggagcgcagcctgcgcgtgctcgacggcgccgtcgcggtgttcgacggcaaggagggcgtcgagccgcagtccgagcaggtgtggcgccaggccgacaagtacgacgtcccgcgcatctgcttcgtcaacaagatggacaagatcggcgccgacttctacttctccgtgcgcaccatggaggagcggttgggcgccaacgtcatcccgatccagatccccgtcggctccgagggcgacttcgagggcgtcgtcgacctggtcgagatgaaggccaaggtgtggagcgccgaggccaagctcggcgagaagtacgacgtcgtcgacatccccgccgacctgcaggagaaggccgaggagtaccgcaccaagctgctcgaggccgtcgccgagactgacgaggcgctgctggacaagtacctcggcggtgaagagctcacgatcgaggagatcaagggcgccatccgcaagctgaccatcagctcggaggcctacccggtgctgtgcggcagcgcgttcaagaacaagggcgtgcagcccatgctggacgccgtcatcgactacctgccgtcgccgctggacgtcccgcccgccgagggccacgtccccggcaaggaagaagagctgatcacccgcaagccgtcgacggacgagccgttctccgcgctggcgttcaaggtcgccacgcacccgttcttcggcaagctgacctacgtccgggtgtactcgggcaaggtcgactcgggcagccaggtcatcaactccaccaagggcaagaaggagcggctgggcaagctgttccagatgcactccaacaaggagaacccggtggagaccgcctcggccggtcacatctacgcggtgatcgggctcaaggacaccaccaccggtgacaccctgagcgatccgaaccaccagatcgtgctggagtcgatgaccttccccgacccggtcatcgaggtggccatcgagcccaagaccaagagcgaccaggagaagctgagcctgtcgatccagaagctcgccgaggaggaccccaccttcaaggtgcacctggaccaggagaccggccagaccgtcatcggcggcatgggcgagctgcacctggacatcctggtggaccggatgcgccgcgagttcaaggtcgaggccaacgtcggcaagccgcaggtggcctacaaggagaccatccgccgcaaggtggagaacgtcgagtacacccacaagaagcagaccggtggctcgggccagttcgcgaaggtcatcatcaacctcgaaccgttcaccggcgaggacggcgcgacctacgagttcgagaacaaggtcaccggtggccgcatcccgcgcgagtacatcccgtcggtcgacgccggcgcgcaggacgccatgcagtacggtgtgctggccggttacccgctggtgaacctcaaggtgaccctgctcgacggtgccttccacgaggtcgactcgtcggagatggccttcaagatcgccggttcgcaggtgctgaaaaaggctgcggcgcaagcccagccggtcatcctggaaccgatcatggccgtcgaggtcaccacgcccgaggactacatgggcgacgtgatcggcgacctgaactcccgccgtggccagatccaggccatggaggagcgcagcggcgctcgcgtggtcaaggcgcacgtgccgctgtcggagatgttcggctacgtcggcgacctgcggtccaagacccaaggccgggcgaactactccatggtcttcgactcctacgccgaagtgccggccaacgtgtcgaaggagatcatcgcgaaggcgacgggtcagtgagtgtcaactcactggctcggagccgagcaatcggctcagcgaaggcgacgggtcagtagctactggcagcggagtaatcttgccgggtcattggaatgccttgggcgcggcacaactgaaaacaccaacactgctttaacaagcaccaactagtccaggaggacacagaagtggcgaaggcgaagttcgagcggacgaagccgcacgtcaacatcgggaccatcggtcacgttgaccacggcaagaccacgctgaccgcggctatcaccaaggttctgcacgacaagtacccggacctgaacgagtcccgcgcgttcgaccagatcgacaacgcgcccgaggagcgtcagcgcggtatcaccatcaacatctcccacgtggagtaccagaccgacaagcggcactacgctcacgtcgacgccccgggtcacgccgactacatcaagaacatgatcaccggcgccgcccagatggacggcgcgatcctggtggtcgccgccaccgacggcccgatgccgcagacccgcgagcacgtgctgctggcccgtcaggtcggtgtgccctacatcctggtcgcgctgaacaaggccgacatggtcgacgacgaggagctgctcgagctcgtcgagatggaggtccgcgagctgctggccgcccaggagttcgacgaggacgccccggtggtgcgggtgtcggcgctcaaggcgctcgagggcgacgccaagtgggtggagtccgtcgagcagctgatggaggccgtcgacgagtcgatcccggacccggtccgcgagacggacaagccgttcctgatgccggtggaggacgtcttcaccatcaccggtcgtggcacggtggtcaccggccgtgtcgagcgcggcgtgatcaacgtgaacgaggaagtcgagatcgtcggcatccgcccgtccagcaccaagaccacggtcaccggtgtggagatgttccgcaagctgctcgaccagggccaggccggtgacaacgtcggtctgctgctgcgtggtatcaagcgtgaggacgtcgagcgcggtcaggtcgtcaccaagcccggcaccaccacgccgcacaccgagttcgagggccaggtctacatcctgtccaaggacgagggcggccggcacacgccgttcttcaacaactaccgcccgcagttctacttccgcaccaccgacgtgaccggtgtggtgacgctgccggagggcaccgagatggtgatgcccggtgacaacaccaacatctcggtgaagctgatccagcccgtcgccatggacgagggtctgcggttcgccatccgcgagggtggtcgcaccgtcggcgccggccgggtcgtcaagatcatcaagtagttcgctcagtcggttcaaagcccggattgcccacgcggcgatccgggctttgttctgctgtgcgccccgcggacccggatcgacgccggagaaataatgcgccggcggcgcggcctgcactaggattttgcggtagttgtccctcggggaccgtaggacgtggcggggtggtgccgatgtcgttcgttcaagcgactccggaattcgtcgcggctgccgcgacggatctggcccggatcgggtcgacgatcagttccgcgaacaccgcggcgctgggtcccacctccggggtgctcgctcccggcgccgacgaggtgtcggccagcatcgccgccctgttcgacgcccactcccaggtctatcaggcgctgtccgcccaggccgccgccttccacagccagttcgtgcagttgatgaacggcggcgcgctgcagtacgccgtcaccgaggccgccaacaccacgccgctgcagagcgcggccggcccggcatcggtggccgcgcagctgccggcggtcagcggcgcggtgggcggttcggcgccgtacggtcacccgacggcccccctggcggcggcggctggagccagtaggtacacccgggacggagccgggagcgagcaccccggaggtgggacccagcgccgcggtgttctcggaactgatagtagacccgatccgggccagatccgtcgcggcagccgcgacgaattccggagtcgcttgaacgaacgacatcggcaccaccccgccacgtcctacggtccccgagggacaactaccgcaaaatcctagtgcaggccgcgccgccggcgcattatttctccgagagtcgatgccacccccggcccggccggcccggcccgggtggcgacgcccgcgtacgcgccggccggttccccgtcccccgtgcagccggcggcttcgtcggcgccggcgccggccggcacgcccgcggcggccgcgcagcccgaggcggcgccgcagacctcggccggcccggcgctgcctgtctcggcgcgccccgcgccgcacgcccccgcgcaggcgcaacccgcgaccgccccggtgcgccgagtgcccatcgtgccgccggagtccgggtaagcggtttgcgcgtatcgccgccgcggcgacgccgtgagcgctaatctgacacggattccccagcaaaaccgaggaggggcaagtgttagcgcgctacctgaaagcacagttggtggttttgctgtgcggcggcctggtcgggccgatcttcttggtcgtgtacttcacgctggggctcggcagcctgctgcagtggatgttctacgtcggcctgctcatcaccgtggccgacgtgctgatcgcgctcgcgctggccaactacggggcgaagtcgtcggagaaactggccgccctcgagcagaacggggtgctggcgctggcccaaatcaccggcatcaccgaaaccgggacctgggtgaacaaccagcaggtcgtcaaggtgcacctgcacatcgccggccccgggctggtgccgttcgacagcgaggaccgcgtcatcgccagcgtcacccggctgggcaacctcaacgcccgcaaggtggtggtgctggtcaatcccaccaccaacgaataccgaatcgactgggagcgaagcgctttggtcaacggcctggtgccggcgcagttcaccgtcgccgaggacaacaccacctacgacctgagcgggcaggccggcccgttgatggagatcctgcagatcctcaaggccaacaacatccctttgaaccggatggtcgacatccggtcgaacccggcgctgcgcgcccagatccaggcggtggtgcgccgggcggcccagcagcaggcgccggccgggcaacccgcgccggcggggcaaccggcgaccgggcagccgtcggcgccggtggccgccccgcccggaccgtcgatcgccgcgcggctgcaggagctcaacgatctgcacgccagcggggcgctgaccgagcaggaatacaacagccggcgggccgccatcatcgccgagatctgacgcggttccggcaaccgccgggcgaattagaacacgtttcagttccgctgctagcctggcttggtctactggcggtcgaagggatgagctgtggcgggacaggccggatcactgcagggacgggtggcattcatcaccggggcggcccgcgggcaggggcgctcgcatgcggtgcggctggccgccgagggcgccgacatcatcgcgtgcgacatctgcgcgccggtgtcggccagcgtcacctacgccccggccagccccgaggacctcgacgagaccgcccggctggtggaagatcagggccgcaaggccttgacccgcgtcctcgacgtccgcgacgacgccgccctgcgggagctggtcgccgacgggatggagcagttcggccggctggacgtggtggtggccaacgccggcgtgctgagctggggccgcgtctgggaactcaccgacgagcagtgggacaccgtcatcggcgtcaacctgaccggcacctggcgcaccctgcgcgccaccgtgccggcgatgatcgaggcgggcaacggcggctccatcgtggtggtcagctcctcggccgggctcaaggccaccccgggcaacggccactactcggccagcaaacacgggttgaccgcgctcaccaacacgctggccatcgagctcggcgaatacggtatccgggtcaactccatccacccgtactcggtcgaaaccccgatgatcgagcccgaggcgatgatggagatcttcgcccgccatcccagcttcgtgcacagcttcccgccaatgccggtgcagcccaacggtttcatgaccgccgacgaggtcgccgacgtggtggcctggctggccggcgacggctcgggcacgctgaccggcacgcagatccccgttgataagggcgccctaaagtactgagcggccatcgtgctaagaactccacgtgagtagtgacgcaagcgccagcaacggaatcgtgatcgtcggcggcggcctggccgccgcccgcaccgccgagcagctgcggcgctcggagtattccgggcccatcaccatcgtcagcgacgaggtgcacctgccctacgaccgcccgccgctgtccaaagaggtgctgcgcaaagaggtggacgacaccgcgctcaaaccccgccagtggtacgacgacaacgacatcacgctgcggctggggtcggccgcgcgcagcctggacaccgcggcgcagacgctgacgctcgaggacggcaccacgctcggctacgacgaactcgtcatcgccaccggcctggtgccgcggcgcatcccgaccatcccggacctggacggcatccgggtgctgcggaccttcgacgagagcctggcgctgcgcgagcacgcgtccgcggcgcagcgcgcggtgatcatcggcgccggcttcatcggctgcgaggtggccgccagcctgcgcagcctgggcgtggacgtggtgctggtcgagccgcaaccgaccccgctggccgcggtgctcggcgagcagatcggcgagctggtggcccggctgcaccgcgccgagggcgtcgacgtgcgcctcggtgtcggggtggcacaggtgcgcggcgacacgcacgtcgaggcggtggtgctgaccgacggcaccgagctggcggccgacgtggtggtgatcggcatcgggtcgcgtccggccaccgattggctcgagggcagcggcgtggcgatcgacagcgtcgaccggggcgtcctgtgcgacgaggccggacgcaccagcgcccccaacgtgtgggcgctcggcgacgtcgcgtcgtggcgcgacgcgacgggacaccaagggcgggtggaacattggagcaacgtcgcggaccaggcccgggtggtggtgccggcgatgctgggcaaggaggtgccgccggtggtggtggtgccctacttctggagcgaccaatacgacgtcaagatccagtgcctgggcgaaccggaggccgacgacatcgtccacatcgtggaggacgacggccgcaagttcctggcctactacgaacgcgacggggccctggtcggggtggtcggtggcggcatgccgggcaaggtcatgaagacccgcgccaagatcgccgcggccgtgcccatcgccgagatgctcggctgagccgacggcgggcgttcagccgacggcggccgcgtaccggtcgctggggacctcggtgttgcggatcacggtggccagctgctcggcgatgcccggcgcggcgacgacggtcgacgcggacttgtgagtgtgcgggttgccctgcgcgtcggtcagccgcgctccggcttcgcgggcgatcagcgtccccgcggcggtgtcccacggcttgttggacatcatcacgcaggcgtccagggcaccctcggcgacgaacgccaggtcgagcgtcgcggcgccgatcatccggatccgctccgcccggggcaccagctcggcggtgagcgccagccggtgcgcgttgagccggcccgcatcgtggccgacggcgtagtcgccgagcgagacgatcgccccgctgaggctgtcggtggcgctggcggtgatccgttccccgttgacgaacgcgcccttggactcgatcgcgtggtaggtcttgcccagcaggggagcgtgggtgacggccaccacggtgcggccggcgtgcagcagggccagcgacaccgcgcacagcggcagcccgtgcacgaaattcgacgtgccgtccaccgggtcgagaacccagagccactcggcggtttcgatgtcgggttggtggtcggactcctcggccagcagcgcgacgtccggcgtggtctgggacaggtagttggcgatgtcacgctggatggtcaggtcgacatcggataccaggtcgcggtcacccttgtgctgcaccgagctcggctgcgttttcttcaacgtggtggcaccgatttgcgttgcctgccaagctatttcaaaaagctcttgcattgacttcatgggagaggcttgcctcgcttccagtggtggcgtgcgttcggcgttgttcgatcatacgggctcggcgatttcgcgtctcgcgcaccccggcgtcgtgctgaactaacgcgaaaaagcttaagccatcgacactttcgacggtgatgcagttcactccaggtgaatgtttgagcccgctcgtcgtggggagcgtgacgccgctgtagcgcgggtcacaaaattgccaacgaccgcacgccaaaaccattgcgctggaaaagcgtaacgctgacccgcgacgatttttgctgtggccgcatcggttctcgggttcggtgcagcggttgccgagctcggttagggtctgctgtcgggcgatatcgaggggccttcgggcaagtcggctccgaatcgttctcatcgaaggaaaatccagcacgcgacttggcaggcaggtgattgaccagtgacagtgattgatgagatatacagctcttccagcgcgattccgaccgtcgctctcaatgacgaggcgaagaagccagtactcggcttgggggtggccaagctgtccgatgaggagacggaaagctcggttctcgcggcgctggaagccggctgccgcctcatcgacaccgctgcctcctacggaaacgaagccgccgtcggccgggccatcgccgcgtcgggcatccctcgcgaggaactgttcgtcaccaccaaactgggcacctcgcggcagggcttccatagtgcccaggagtcgtgcaaggagagcctggacaggttggggctggactacctcgacctctacctgatccactggccggccccgacgctgggtaagtacgtggagagcttcgagggcatgatcgaggcccgcgagcggggccacgtgcgctcgatcggcgtctcgaacttcaccgaggacctgctggccacggtgatcgaggagaccaacgaggtgcccgcggtgaaccaggtcgagctgcacccgcggctcaaccaggccgagctgcgtcaggtgcacgcccagcacgacgtgaccacgcagtcctacagcccgttgggcgtcggccggctgatcgaggagccgaccgtgacgacgattgcggccgagtacggccgcacgccggcgcaggtgctggtgcggtggaacctgcaactggacaacgtggtggtctcgcggtcgtccaagccggagcgggtcgccgaaaacctggacgtgttcgacttcaccctggagcccgagcacatggaggccatcgagggactgcacgacggcacccgggtgctgcacgacccgatgaccttcatggggacctgacggtttcgcgaaaaccccagcgccccttggcttttagagccagtcgaccggcgggccgtgcggatggcactgtgccagcacgcgcggcccgccgtccggccagccgcgggcgcgcaccaggaacctgatcggtgcgcccggcccgtcccgggccggctccatggtcaggtggaccaacggggcggacgcgccggcccgtgcgcccagcgcgtccaccccggcgcacaccgcggcgcgttccccggcggacaggtactgccaggtgatcgagtgccacagcacggtcaacgcgccctcggcgaggctcaggcgcccgacggcgtcggccgccgtccggcgctcgagggtggccgggacccggcgggcgacctcgatggcgccgcgcagccgcgccagccgcgcggcctggtcgggccagacgtagctcagcaccgtcagctcaccgtcggggttcccgacgtcgacgggcgcgatgtcgaagccgtgccgctcgacgatccgcaccccgcgcgccggcggcagcgcgccgcgccaggcgtcgtcgatgcaaaccggcgagtcggccggtccccacccgccgccggcataccggtaccggtagtggtcggcccgcaggttcagccccgcgctcgacccgatctcgaaaagtcttaccggcaaacaggattcattgatgtgcagcagcccgccgatcagcgcggccgaccggcccacctcgttggtctgcggtgggcggtccagcgccgcgcgcagcgcggcggcgtgctcggccgcggcggccaggatcggcggccacgccgccccggcgtcccagctgccgccggtgctgggataccagcggcgcagggagccggcgcggccatcgagcaccagtcggtgcaggccaccgagcagccgcagcggaatcgcgtcgcgcgacggggcgtcccggtgcccggacaggatgtcggcgaacaccccgccggcctcgacgtcggaggccaccagttcgaacaggtcgccgtacatcggcgagcccgaggaggcgcagaagctgccctgcgcccgcagcatgtgcaccaggtgctcgacgctcaccggtccagcccgttcagcccggcgccgaccacgtcgaaggcgttgcccagggccaccggcaacggcactgactcatcgcccagccaatgctcgtaggccgacagcgccacccccagcatcatccaggcgacggtctggggcgccaggtcggtcgtcttgcactcgcagcggcgggccacgaacccggcgatcacctcgcgccatccggcgtacatcgtcatcgaatacgcttgcagctcagcggtttgcaggatgacgcgcatgcgctgtcggtgccgcgcggtctcggattcgtcaaaggtgttgaaggccaacaacgcggtgcgcagcgcatcgcccagcggtacccgggattcgacgttgtccagcaactcgcgcagccgggccaaatgagtgtcgaaatcgccccaggggatggcgttcttggaggcgtagtagcggaacagggtgcgccgcgagatgccggcggccgccgcgacgtcgtccacgctgacctcggcgaaaccccgggcggtgaacaggtcgatggcgacgtcggtgatgtggtgcggcgtggtcgagcggcgcctgcccacccgctgctgcggcatcccggaccccggcccttccatttcggcactcgatgccatattctggccgcgagtgtgactcagacccatcgtcgtcaagaccgcaggaaaggcaaggccccgtggagcacgagaccgaaaccgacgcccaactcgtcaccgagaccctggtcgaagaggtgtccatcgacggcatgtgcggggtctactgaccgtgccggcgcccgcgcaggctcgcgcggccggtgccgccttcgatcctgaccgcggctggcgactgcacccgcaggtggcggtgcggccggaaccgttcggcgcgctgctctaccacttcggcacccgcaagctgtcgtttctgaagaaccgcaccatcctcacggtggtgcagtcgttggccgagtacccggatgtccggtgcgcatgccgcgcggcgggcatcgacgacgccgggcaggcgccgtacctgcacgcgctgggcgtgctcgccgactccaacatgctggtgccccgggaggaccatccatgaccacagtggcccctgtgccccggctgatcgagcagttcgagcacggcctcgacgcgcccatctgcttgacctgggagctcacctacgcctgcaacctggcctgcgtgcactgcctgtcctcgtcgggcaagcgcgacccgcgcgagctgtccacccgtcagtgcatggacatcatcgacgagctggaacgcatgcaggtcttctacgtcaacatcggtggcggggaaccgactgtgcggccggacttttgggagttggtcgactatgcgaccgcacaccacgtcggcgtgaagttctccaccaacggggtccggatcacgcccgaggtggccgcccggctggcggccagcgactacgtggacgtgcagatctcgctggacggcgccaccgccgaggtcaacgacgcggtgcgcgggcccggctcgttcgacatggcggtgcgggcgctgcagaacctcgccgacgccggcttcacccagaacgggggcgccaagatctcggtggtcgtcacccggcacaacgtcgggcagctggacgaattcgccgcgctggcaagccgttacggggccacactgcgcatcacccggctgcgcccgtccggccgcggcgccgacgtctgggacgagctgcaccccaccgccgaccagcaggtgcaactgtatgactggctggtcgccaagggggaacgggtgctcaccggcgactcgttcttccacctggccccgctcggccagtccggcgcgctggccggtctgaacatgtgcggcgcgggccgcgtcgtctgcctgatcgacccggtcggcgacgtgtacgcctgcccgttcgccatccacgaccgcttcctggccggaaacgtgttgagcgacggcggttttgacaacgtgtggaagaacgccccgctgttgcgcgagctgcgcgaaccgcagtcggcgggcgcctgcggcagctgcgggcactacgacagctgccggggcgggtgcatggcggccaagttcttcaccggcctgccgctggacggcccggaccccgagtgcgtgcagggccacagcgcggcggcgctggcgggcgaccgcgaggcgccccgaccccgggccgaccattcccgcggcaagcgcatccgccaacccgtgccgctcaccctctcggtgcggccgccggtcctgacccccgccgcgccgccggcccggttgtgcaacgaaagcccggtctgaccgtggccgacgaatggtttgaaaccgtcgccatcgctcagcaacgggccaagcggcggttgccgaaatccgtttatgcggccctgatcgcggccagcgaaaagggaatcacggtctccgacaacgtcgaagcgttcggcgaactcggtttcgccccgcatgtcgtcggcgccccggccaagcgtgagctgacgacaaccgttatgggacaagagatctcgatgccggtgctgatctcgccgaccggtgtgcaggccgtcgacccggacggcgaggtcgctgtcgcgcgcgccgccgcggcccgcggcaccgctatgggcctgtcctccttcgccagcaagccgatcgaggaagtcatcgcggtgaaccccaaggtgttcttccaggtgtactggctgggtgggcgcgacgcgatcgccgagcgggtggagcgggcccggcaggccggcgcggtcgggctgatcgtcaccaccgactggtcgttctcgcacgggcgggactggggcagccccaagatccccgaggagatgaacctgcgcaccatcctgcggttgtccccggaggcggtgttcaagccccgctggctgtggaagttcggcaagacgctgcggccgccggagttgcgggtgcccaaccagggccgccgcggcgagcccggcccgccgttcttcgccgcctacggcgagtggatgggcacgcccccgccgacctgggaggacatcgcctggctgcgtgagctgtggggcgggccgttcatgctcaagggcgtgatgcgcgtggacgacgccaaaagggcggtggatgccggggtttcggccatctcggtgtccaaccacggcggcaacaacctggacggcacgccggcgtcgattcgcgccctgcccgcgatcgccgaggcggtcggcgaccagatcgaggtgttgctggacggcggtgtccggcgcggcagcgacgtcgtcaaggcggtggcgctgggggcgcgcgcggtgatgatcggccgggcctacctgtggggcctggccgccgccggccaggccggggtggagaacgtcctcgacatcctgcgcgggggcatcgactcggcgctgatgggtctggggcattcctcggtgcacgatctcgggccgagcgacatcctggtgccgcccgggttcacccgggcgctgggcgtgccgccggccggctgagcaaagccgggccatccggggcggcttggccgggattatttgacggccgcggtaatcctggtacgggcggggtaaccgtgacgaacgagcccaccgttcgaacgcccgatgaacggccggagaaaaaaagttattttcccgcctcaacaattggtgcacgccaggtgaattcgtcctaccatcaccgagtgtccgtactcggcgaattgggaaccgtgacgtcgagccagctgtccggcacggcggtctcgctgctggttccgctggggtcgaccgagcaacacggcccgcacctgccgctggacaccgacacccgcatcgcgtcggcggtggccggccgggccgtgccgcggctgggggacgactggctggtggcgccggccatcgcctacggcgccagcggcgagcaccagagcttcgccgggaccgtctccatcggcaccgaggcgctgacgctgctgctgatcgagtacggccgctcggcggccggctgggcgcagcgcgtcgtcttcgtcaacggccacggcggcaacgtcgccgcgctgggccgcgcggtgggcacgctgcgcgccgagggccgcgacgccggatggtgtccgtgtgtggccgccggcggggacgcccacgccggtcataccgaaacatcggtgttgctgcacatctcgcccgccgaggtccgcaccggggcgtggcaggccggcaaccgggcgccgctgcccgagttgctgggatcgatgcgccgcgggggagtggcggcggtcagcccggtcggcgtgctgggcgacccgaccaccgccaccgccgccgagggcgagcgcatcctgtccgagatggtgaacgagtgcgtccgccgggtcgcccggtggcggcccgggcccgacgggatgctcgcatgaccgcgccggcgccgcggttgccggacgggttcgccgtccaggtcgatcgccgggtgcgggtgctcggcgacggctcggcactgctcggcgggtcgccgacccggctgctgaagctggccccggccgcccaggacctgctgtgcgacggccggctgaaggtccgcgacgacgtcagcgcgcagttggcccgcaccctgctggacgccaccgtggcgcatccgcggcccgcgggcgggccctcgcaccacgacgtcaccgtggtaattccggtgcgggacaacctttctggcgtgcgacggctggtgagctcgctgcgcggtctgcgcgtggtggtggtggacgacggatcgttcccgccgatcgagccggaagacttcgtcggcgcgcactgcgacatcgaggtgctgcgccaccaccgcagcaagggaccggcggccgcgcgcaacacggggctggcggcctgccgcacggacttcgtcgccttcctggactccgatgtcgcgccgcgccggggctggctggaagcgctgctcggccacttctgcgacccgaccgtcggggctggtcgcgccgcgcatcgtcggcctgtcgcacagcgagaacgtggtggcccgctacgaggcggtgcactcctcgctcgacctcggtgagcgcgaggcgccggtgctgccgcacagcacggtgtcctacgtgcccagcgcggcgatcatctgccggtgctcggcgatccgcgagatcggcggattcgacgagacgctgcagtccggcgaggacgtcgacctgtgctggcggctgatcgaggcgggggtccggctgcgctacgagcccatcgccctggtgggccacgaccaccgcaccgaattgcgggattggcttgcgcgcaaagcgttttacggcggatcggcggccccgctgtcggtgcgccacccggacaagacggcgccggtggtgatctccggctgggcgctgatgacctggatcctgatggccttcggctccacgctgtcgcggctggcctccctgctgctggccgtcctgacgggccggcggatcgcccgggcgatgcgcagcgccgagacgtcgatgaccgacgtggtgacggtggccggccgcggcctgtggtcggcggcgttgcagctggcctcggcgctgtgccggcactactggccgctggcgctgctggccgccaccatgtcgcgccatttcagacgggtggtgctggtggcggccgtgatggacggggtggtcgactggctgcgccgccgcgacgccgtcggcgacgacgtcgaaccgatcgggctgccgacctatctggtgctcaagcgggtggacgacctggcgtacgggctcgggttgtggtggggtgtgctacgggagcgcaacgcgcgcgccctcaaaccccagatccggagttagcccccgcccttgaagaacgccgtctcgcacagcgatgtgctgatagtcggcgtcggcagcgccggatcggttgtcgccgaacgtctttccgctgatccagggtgcacggtgaccgtggtcgaggcgggcccggccctcgacgacccggcgctgctcgcccggaccgccaacgggctgcaattgccgatcggcgtcggcagcccgctggtgcgccgataccagacccagctcaccgagcggcccgcccgccgacacccgctggtgcgcggcgccaccatcggcggctcgggcgcgatcaacggcggctacttctgccgcgggctgccccgcgatttcgaccgcctcggcctgccgggctgggcatggtcggacgtgctggacagcttccgcgccatcgagaccgacctggacttcgacggacccgcgcacggccgcagcggccccatcctggtccgccgcacccgcgaaatgaccggaaccacagagcgtttcatcgacgccgcgcggcgcgccggattcggctggatcgacgacctcaatgatgctgcggcccaaccggtttcggggatcggcgcggtcccgctgaacatcgtcgacggcgtccgcaagggctcgggtgcggggtatctgatccccgcgctgagccggcccaacctgcgcgtgcaggcgcacagccgggtggcgcggctgcgtttggccggcaccgtcgcccggggcgccgacgtggtcggcccgcacggccgggctacgctgaccgccgaccgaatcgtgttgtgcgccggcgccattgaaacggcgcacctgctgatgctgtccggcatcggcgagccgggcatgctgcgcgccgccggggtgccggtgcgcgtggcgctgccggtggggacgtcgttcagcgatcacgccgaatgggtgctgcccaccgattggccggtggctcccggacggccggtgctcgaggtggtgctcagcaccgccgaccatctcgagatcaggccgtacaccggcgggttcgtggcgatgaccggcgacggcaccgccgggcacgccgactggccgcacctcggggtggcgctgatgcaaccccgcgcgcggggttgcctgacgctggtgtcggccgatcccgccgtgccgccccgcatcgagcaccgctacgacagcgagcccggcgacgtcgccgcgctggcccgcggcgccgagttggcccgcgaattggccggcggcacaaccgatgccgcggcggtcatctggtcgacctcccaacacctttgcggcacggcgccgatgggggtcgacggcgacccgcgggcggtcgtcgacccgcggtgccgggtccgcggcatcgacaacctgtgggtgatcgacggctcggtgctgcccgccatcaccagccgcggcccgcacgccaccatcgtgatgatcgggcaccgggccgcggaattcgtgcggtgacgccccacccgggagctatcgccgggcccatccagaccgatagtctcgtagctcgaccgatgttctcgttggcaatacggttcgcaatacgggaggtggcgcacaatttccgccgcgacgtccgatccacggcccgcccggtcgcgggcccggctgctcgaagccgccgtcacgctgctgcgtgccggtggtcccagcgcggtgacggtcgacgcggtcacccgcaccgccaacgtggcccgggcgacgctgtaccggcacttcccgagcggaaacgatctgctggcggcggcgttcaacagcctgatcccggcctcgccgaccccgcccgccgaggggtcgctgcgcgaccggctggtcgcggtggtactggcccaggccgaggccgtcgcccaggccccgaccatgatgacggccatgacctggctggcgctgggccgcgacctggaggcgtggccgcaaccccgcgccgacgacagcgtggccatcaccacgctgcgcgagcgcatcgcccagcagtactcggagccgttcgacgtcatcttcgacagcccggaggccgccgaactgggggaggtggaccggtcccgggcgatcgccctgctgatcggcccgctggtgctgggccggctgtccaccctgcccgatttcgactaccgcgagtgcgcgctggcggcggtggacggcttcctgcacgtccagcgcgcccgggccagggcggcgagggtcgaatccgcaggtgcctgacggccgaattttgttcgggccgggatctgaggcatactgttcaggttgccttgagccgggttttgcgcctggtcgggcatacgaccagcgtccaaacgggcgcgtccggtcccatcctttgagagcgacgaatttcgaatcccgaaatttgcgccgatgaggctgcgtgagggtgacacgcccgaccgcgggggccggtggaccacgacaggtaaacagcggcgcacaatccggcgcaacgctcgatcggcccagagttggccggcccgatcggcgcgccggtggcactgaggacacggattagttgagcccggacaccgggcctcaacgcggagtgagggtaggagaagcgtggcgggacagaagatccgtatcaggcttaaggcctacgaccatgaggctatcgacgcctcggcgcgcaagatcgtcgagaccgtcgtccgcacgggtgccagcgtcgtagggccggtgccgctgccgaccgagaagaacgtgtattgcgtcatccgctccccgcacaagtacaaggactcgcgggagcacttcgagatgcgcacgcacaagcggctgatcgacatcctcgacccgacgccgaagaccgtcgacgcgctgatgcgcatcgaccttccggccagtgtcgacgtcaacatccagtagggagttacagagcaatggcgcgtaagggcattctcggtaccaagctgggcatgacgcaggtattcgacgagaacaacagggtcgtgccggtgacggtggtcaaggccgggccgaacgtggtgacccgcatccgcacgcccgagcaggacggctacagcgcggtgcagctggcgtacggcgagatcagtccgcgcaaggtgaacaagccggtgaccggccagtacgccgcggcgggcatcaacccgcgccggtttctggccgagctgcggctggacaacccggacgcggcggccgaataccaggtcggccaggagctgacggcggagatcttcaccgacggcagctacgtcgacgtcaccggaacctccaagggcaagggcttcgccggcaccatgaagcggcacggcttccgcggtcagggcgccagccacggcgcccaggcggtgcaccggcggccgggttccatcggcggctgcgccacccccgcccgggtgttcaagggcaccaggatggccggccggatgggcaacgaccgggtgacggtccagaacctgttggtgcacaaggtcgataccgagaacggcgtgctgctgatcaagggcgcggtccccggccgcaccggcggactcgtcatggtccgcagcgcggtcaaacgaggtgagaagtaatggcactcaagcttgacgtgaaggcgccgggcggcaaggtcgagggttcgatcgagctgccggccgaattgttcgacgcccccgccaacatcgcgctgatgcaccaggtggtgaccgcgcagcgggcggcggcgcgtcagggcacgcattcgacgaagacgcgcggcgacgtcagcggcggtggccgtaagccgtaccggcagaagggaaccggccgggcccgtcagggttcgacgcgcgctccgcagttcaccggcggtggcgtggtgcacggccccaagccgcgcgactacagccagcgcacgcccaagaagatgatcgccgccgcgctgcgcggcgcgctgtccgaccgggcccgcaacgggcgcatccacgcgatcaccgagctggtgtccggccagaccccgtcgaccaagagcgccaaggcgttcctgggcgcgctgaccgagcgcaagcaggtgctggtggtgatcggccgcagcgacgaggccggcgccaagagcgtgcgcaacctgcccggtgtgcacatcctggctcccgaccagctcaacacctacgacgtgctgcgggccgacgacgtggtgttcagcgtcgaggcgctgcgcgcctacatcgcggccaacaccggtactcccgaggaggtttcggcctgatggcgaccgtcacggacccccgcgacatcatcttggctccggtgatctcggagaagtcctattcgttgctcgacgacaacgtgtacacgttcgtggtgcaccccgactcgaacaagacgcagatcaagatcgccatcgagaagatcttctcggtcaaggtcgcctcggtgaacaccgcgaaccggcagggcaagcgcaagcgcacccgcaccggtttcggcaaacgcaagagcaccaagcgggccatcgtcaccctggcgccgggcagcaagccgatcgatctgttcggggcaccggcgtagcgagagaaagacctgattagacatggcaattcgtaagtacaagccgacgagcccgggccgtcgcggcgccagcgtgtccgatttctccgaggtcactcgttccaccccggagaagtcgctggtgcgtccgctgcacggtcacggtggccgcaacgcgcacggccgcatcaccacccgccacaagggcggcggccacaagcgcgcctaccgggtgatcgacttccgccgtaacgacaaagacggcgtcaacgccaaggtcgcgcacatcgagtacgaccccaaccggaccgccaacatcgcgctgctgcacttcctggacggcgagaagcgttacatcattgccccacagggactctcgcagggcgacgtggtggagtcgggtcccaacgccgacatcaagcccggcaacaacctgccgttgcgcaacatcccggccggtaccgtgatccacgcggtggaactgcggcccggcggtggcgccaagctggccctgtcggccgggtccagcatccagctgctcggcaaggagggcagctacgcgtcgctgcggatgccgtccggcgagatccgccgggtcgacgtgcgctgccgcgccaccgtcggcgaggtcggcaacgccgagcaggccaacatcaactggggcaaggccggccgcatgcggtggaagggcaagcgcccgtccgtccgtggtgtggtgatgaacccggtggaccacccgcacggtggtggtgagggtaagacctccggtggtcgccacccggtgagcccgtggggcaagccggagggccgcacccggcatccgaacaaggccagcaacaaactcatcgtccggcgccggcgcaccggcaagaagcacggtcgctagcgcgagatggaagttcaggagtagcacatgccacgcagcctgaagaagggcccgttcgtcgacggccacctgctcaagaaggtggacgcgcagaacgagaagaacaccaagcaggtcatcaagacatggtcgcggcgttccacgatcattcctgacttcatcgggcacaccttcgccgtgcacgacggacgcaagcacgtgccggtgttcgtcaccgaggcgatggtcggccacaagcttggtgaattcgcgcccacccgcaccttcaaggggcacatcaaggacgaccggaaggccaaacggcgatgaccacaacggaattcccttcggcggtggccaaggcacgcttcgtgcgggtgtcgccgagaaaggcacgccgggtgatcgacctggtgcgcggccgctcggtgaccgacgcactcgacatcctgcggtgggcgccgcaggccgccagtgaaccggtggccaaggtgatcgccagcgccgcggccaacgcgcagaacaacaatgggctggacccggccaccctggtggtcgccaccgtctacgccgacgagggcccgaccgccaagcgcatccgtccgcgcgcgcaggggcgtgcgttccgaatccgcaagcgcaccagtcacatcactgtggtggtggaaagccggccggccaaggaccagcggtcggcgaagtcgtccaggacccgccgcgccgaggccagcaaggccgccgccaaggcgccggccaagaaggcaccggccaagaaggcacccgccaagaaggcacctgcgaagaccgcggccaagaaggcaccggcgaagacgtctgagacttctgacgcgaagggaggctcagactagtgggccagaagatcaatccgtacggcttccgcctcggcatcaccaccgactggaagtcccgctggtatgccgacaagcagtacgcggactacgtcaaggaggacgtcgccatccgccggctgctgtcgaccggcctggagcgggccggtatcgccgacgtggagatcgagcgcacccgcgaccgggtccgggtggacatccacaccgcgcgtccgggcatcgtcatcggccgccgcggcaccgaggccgaccggatccgcgccgacctggagaagctgaccggcaagcaggtgcagctcaacatcctcgaggtgagaaaccctgagtcgcaagcacaattggtggcccagggcgtggccgagcagttgagcaaccgggtggcgttccgtcgcgcgatgcgcaaggccatccagtcggcgatgcgtcagcccaacgtcaagggcatccgggtgcagtgctccggccgtctcggcggcgcggagatgagccgctcggagttctaccgcgagggccgggtgccgctgcacacgctgcgcgccgacatcggctacgggctgtatgaggccaagaccaccttcggccggatcggtgtgaaggtgtggatctacaagggcgacgtcgtcggcggcaagcgcgaattggccgctgccgccccggcgggcgccgagcgtccgcgtcgcgagcgcccgtcgggcacccgcccccggcgcagtggcgcgtcgggcaccacggccaccggcaccgaggccggccgcgcggccgcgagcgccgacgagagcaccgcggccgggcaacccgccgaggccgcgcccgccgccgaaccgcaaagcacggagagctgaatcatgttgattccccgcaaggtcaagcaccgcaagcagcaccacccccgccagcgcggcatcgccagcggcggcacggcggtgaacttcggtgactacggcatccaggcgcttgagcacgcctacgtcaccaaccggcagatcgagtccgcgcgtatcgcgatcaaccggcacatcaagcgtggcggcaaggtgtggatcaacgtcttccccgaccgcccgctgaccaagaagcccgccgagacccggatgggttcgggtaagggctcaccggagtggtgggtggtcaacgtcaagccgggccgggtgctgttcgagctcagctaccccaacgagcagaccgcccgggcggcgctgacccgcgcgatccacaagttgccgatcaaggcccgcatcgtgacccgagaggatcagttctgatggcagtgggaatttcgcctggcgaactgcgtgagctcaccgacgacgagctgaccgagcggttgcgcgaatccaaggaagagctgttcaatctgcgtttccagatggcgaccggccagctgaccaacaaccgccggctgcgcacggtgcgtcaggagatcgcgcgcgtctacaccgtgctgcgggaacgtgaactgggcctggcaagcgggccggacggtaaggaatcgtgatggcagaagcgaagaaggccgcccccaagaaggccgctaccgccgcgtccaaggacgcagatgccaaggggcccaagcacactccgcccaaccccaaggtgcggggccggcgcaagacccgcatcggctacgtggtgagcgacaagatgcagaagaccatcgtggtcgagctggaggatcgggtgaagcacccgctgtacggcaagatcatccggaccaccaagaaggtcaaggcgcacgacgagaacagcatcgccgggatcggcgaccgcgtctcgctgatggagacccgcccgacgtcggcgaccaagcgttggcggctggtcgaaatcctggaaaaggcgaagtaacccctccccgcaagaggcaccgaaacgcccggccccgggtgtagtctgcacgcgacgcgcggcgagtccgcgacgagagtgaggctgacgatggtggctggttcggggcaatccgcggaattttccggccgggtcgagctcgacatccgggattccgaaccggactggggtccctacgccgcgccgaccgccccgccgaacgcgcccaacatcctgtatctggtctgggacgacaccgggatcgcgacgtgggactgcttcggcggtctggtggagatgccggccatgtcgcgcatcgccgaacgcggcgtccggctctcgcagttccacaccaccgcgctgtgctcgccgacccgggcggcgttgctcaccggtcgcaacgccacgaccgtcgggatggccaccatcgaggagttcaccgagggcttccccaacgccaacggccgcatcccgttcgacaccgcgctgctgtccgaggcgctcgccgaacacggttacaacacttactgtgtcggcaagtggcacctgacgccgctggaagaatccaacatggcctcgaccaagcggcactggccgacctcgcgcggcttcgagcggttctacggcttcctgggcggcgagaccgatcagtggtaccccgacctggtctacgacaaccatccggtgagcccgccggccaccccggaggacggctaccacctctccaaggacctcgccgacaagacgatcgagttcatccgcgacgccaaagtgattgcgccggaaaagccttggttctcctatgtgtgtccgggcgccgggcacgcgccgcatcacgtgttcaaggaatgggccgaccgttacgccggccgcttcgacatgggttatgagcgctaccgcgaggtggtgctggagcggcagaaggcgatggggatcgtgccgtccgacaccgaattgtccccggtgaacccgtatctggacgtgacggggccgcgcggcgagccctggccgttgcaggacacggtgcggccgtgggactcgctgaacgacgaggagaagaagctgttcgcccggatggccgaggtgttcgccggcttcctgagctacaccgacgcccagatcggccggatcctggactatctcgaggaatcgggccagttggacgacaccatcatcgtggtgatctccgacaacggcgccagcggtgagggtggcccgaacggatcggtcaacgagggcaagttcttcaacggctacatcgacaccgtcgaggaaagcatgaagctgttcgatcagctcggcgggccgcagacctacaaccattacccgatcggctgggcgatggcgttcaacaccccctacaagctgtacaagcggtacgcctcgcatgagggcggcatcgccgacacggcgatcatctcctggcccaacggaatcgccgcgcacggcgagatccgcgacaactatgtcaacgtctgcgacatcaccccgaccgtgtacgacctgctgggcatgtccccgccggaaaccgtcaaggggatcgcccagaagccgctggacggcgtgagtttcaaagcggcccttgacgatccgaacgccgacaccggaaagaccacccagttctacaccatgctgggcacccgcggcatctggcatgagggctggttcgccaacaccgtgcacgcggccaccccggccggctggtcgcacttcgacgccgaccgctgggagctgttccacatcgaggccgaccgcagccaatgccacgacctagccgctgaaaacccggacaaactcgaagaactcaaggcgttgtggttcgcggaggcggccaggtacaacgggctgccgctgtcggacctgaacatcctggagaccatgacccggtcccggccgtacctggtcggcgaacgggacagctatgtctactaccccgactgcgccgacgtcggcatcggcgccgccgccgagatccgcggccgatcgttctcggtgctggccgaggcaaccgtcgacaccaccggcgccgagggggtgctgttcaagcagggcggggcgcacggcgggcacgtgctgttcatccaggacgggcggctgcactacgtctacaacttcctcggcgaacgccagcaggaggtctcctcgtcggtgcccgtgccgctgggcaggcatctgttcggcgccagctatgcacggacggggacggtccccgacagccacaccccgctcggtgacctgacgctgttcatcgacgacgaggtcgtcggcaccctggccggggtgagcacccacccggggactttcgggctggcgggtgccggaatcaccgtgggccgcaacggcggatcgggggtgtccagccggttcaaggcgccgttcgtgttcaccggcggcaccatcgcccgggtcaccctcgacctgtccggccggccctatcgcgacgtggaaaccgagatcgcccttgccttttcgcgggactgaagccgcgacggtcagtccgggttgggcgcctgcggtgagctgatcgcgtcgacggcgccggacaccttggcttgaaagtccgccgacagcgggatgtagccggtcctggccaactcgacctgcccgggcccgatggcggcctgcaggaacgccttgaccgccttggccacgtcgaagcccgggtatttcgagcacacgatctcgtaggtggccagcacgatcgggtagacgtcgggctgggcggggttgtagaacgacgacaggtcgagcaccaggtcgttgccggtgccgacgatccgggcgcccttgatcgtcttgccgaagatgtcggtgccgatccgcaccggacgcagcgatcggcggctcgccggcgtcttgatctcggcggcgaacaggccctgctgcagcgcgaaggacaattcgttgtagctgatggcaccctcggtgctcttgacggccgcggcggtgccggtgttgccgacggcgccggtgcccacgccgccgttgaaggtcttgcccgcgcccttgttccacactccgccggcggccgactgcaggtaggcctggaagttgtcggtggtgcccgagccgtcgctgcggtagacgacgcgaatgtcctcggccggcatggaggcgttgagcagggccagggccggatcgtcccagcgggtgatggtgccgttgaagatcttggccagggtgggcgcgtcgagcaccagcgagtcgaccgcggccaggttgtaggtgatggccagcggaccgaacaccaccggcaggttccaggcgtcggctccgccgcagcgtcgcttggcggcggcatactggtcgcccgacaacggtgtgtccgaccccgcgaaatccgttctgcccgcgaggaagtcaccgattccgttgcccgacccgttggcggtgtagtcgagcgtctgtcccgggcacgcggtccggtaggcggcgatgaaccgggtcatcgcgttggcctgcgcggtggagccgctggcggacagggtctgcttgccgccgcaatcgaccttggcgccggcggtgtagggcaggctggcgggcgtctcgccgcacgccgagaccaccagggtggttgccatcagcacgccggcgatgaccgccgatcgggtgcgcatcacgacgagggctccttgacagtccgggtaccgagatgtaccgcgaccggatgaacaggcaaacaaacgtcggatgaacgagtgcgccgtccccgccgggcggcgggcccggtctggtcgggcggtgcggtttcgctgggcagtgtgcccaagcgcggcgtgcgggcgaaaattacctacacatgacgaaattcccaagcagccgcgcaccggggccgagttcgctagcatccctgctctagggcccgaattcccctctggaggtatgacatgacccatcaagcgccccccgcgccgccgccttcggtgccctccgagcaaccgcccgcggcaccgccggacgccccgcccgcgcggcggcgccgccgcccggtcatcgccgccgccgtcgtgctgggattcgttgccgtgtacgttctttcgctgttcggtgtgcacctgctggccaagacggccgggccgctcaagccgccggacctcaacgccaccagcgacacggtggtgctggtgcggttggagaagctggacaccatcgccaaccggttgacggtcaaggtgctggtgatccccgaggagtcgatgttcgacaaacgcctcgacgtgctgaccaccgacaccgcggtgcggatggacccgccgaacgacctgggcgacctgcagtatccggccggcaagtcaccggcgcaggtggcgaccaccatcgaggcgcacggcaaccccaacaactggccgttctactcctaccgcaccgacaccatgtccgccgaagttcttgtgggacaaggggatacgcgccactacatcccggcgcgggtggaggtcaccggcgggctggacggctgggacgtcagcgtgcagcgggtcggcgaagccagtcaggaatcggaccgcgccgacaacgtcatcatcacgctgcaccggtcgaagagcacgctgatcttcgacgcgggaatctgcctggtgctgttcgccctgcccgccatggcgctgaccatcgcgctgctgatgctgaccggcaagcggggcttcctgccgccgttcgtgacctggttcgcggcgctgctgttcgccgtcatccccatccgcaacttcctgcccgggtcaccgcccgccggagcctgggtggaccaggcgctggtgctctgggtgctgatcgcgctggtggcgtcgatggtcctgttcctgatcacctggtaccggcgcacggactgagttcccgtcagggtcctaccctggtggggtgcgcagcgagctggcggacctgccgggcgggtcgttccggatgggctcgacgagcttctatcccgaagaggcgccgatccacacggtgacggtggagcccttcgcgatcgaacgccacccggtgaccaacgcgcagttcgccgagttcgtcgccgccaccggctacgtgacggtggccgagcaaccgatcgacccggcgctgtacccgggcgccgacccgtcccaattacagccgggtgcaatggttttccggcccacaccggggccggtggacctgcgcgactggaggcagtggtggcactgggtgcccggggccagctggcgccaccctttcgggccggacagcgacgtcgccgatcgcgccgaccatccggtggtgcaggtggcctaccccgacgccgcggcctacgcccgctgggcggggcggcggctgcccaccgaggccgagtgggaatacgccgcccgcgcaggggccaccaccacctacccctggggcgacgagcccaccagcgacggccggctgatggccaacacctggcagggccgcttcccgtaccgcaacgacggggcgctcggctgggtgggcacctcgccggtcggcgtcttcgcgcccaacgcgttcggcctgctcgacatgatcggcaacgtctgggagtggaccaccaccgagttctccacccatcaccggatcggggcggcgaccaagccctgctgcgccccgtcgggccccgccgacccgagcgtcaaccagaccttgaagggcggcagccatttgtgcgcgccggagtactgccaccgctaccgcccggcggcgcgttcgccgcagtcgcaggactcggcgaccacccacatcggctttcgctgcgtggccgaattgggttcgaactagcaaacccggcgaggcgtgaacggcggatggcggcacggtgacgcccacgtgatgccttggtggacaagagatttcaccgcgcgccggacccctgcgttcgctagcatctgacgacatgtcgcaccgcgcaacccaaatggtgttggcctgatgacagcaacggcggtggcagcccaagcgcccgtgacgaagaagcgggacaggccgcggatcgcgatcggggtgtgcatcctggcgggcgtcgtcatcgtctacgtgctgtcgctgttcggggtgcatttcctgcagcgctccgaggggccgctgccgccgctggatctgagccagggcggcggggacgccaccatcgtgcagttgcgcctcgaggagctcaagcccgtcgcgaatcggctctcggtcaacgtcctggtctatcccggagttgcccagtacgacaaccgattcgacgtcctggccaatgacgtggcggtgcgcctttatcccacaagcgatctgggcgatctgcactaccccaagggcaaggcgccggcgcaactgagcaccaccgtggaggcgcacggcgatcccgggaactggccgttcgactcctaccgcaccgagccgatctccgcggacgcgttcgtcggctccggggacaacctgaagaaggtgcccgcccgggtggaagtcaccggggccctggacggttggcagatcaccgtcgaccgcgtccgcgaccccgcggcgctgccgacgcaacggggcagcgacaacggcgacgtcgtcatcacgctgaagcgggccaaggggccgctgatcttcgatctcgggatctgcctggtgctgatcagcctgcccaccctggcgctgctggtcgcgattcccatggcgatgggccgacgcaaattcctgccgccgttcgccacctggtacgcggccaacctgttcgccatcgtgccgctgcgcaacatcctgcccggggcgccgccgcccgggtcctggatcgaccaggcgatcgtgcagtgggtgctgatcgcgctggtggcggcgatgaccctgtacatcatcgcgtgggtgcggcagggcgactgaccgccgcgtacgccaggtgcgccggttatccacaggtcgcggtcctgccaagcgcccgagtcggcggacagtgctactctcgcacatatgttcgaagacgcggtcgcctggttcgacgagctgatggagcggtgctacccgtcggcgacgccggagtcggcggcgctggtgcagcggatcggtgtcttcgcgcgggtggagaatcgggcggcggccgagcagttggcggccattggggagctgttcgcctatcggctgtcgcgctgctcggagtgcgaggactgggcggtcgacaccgaggccgcggtgagcgcggaggtggcggcccagctgcggatcgggcaggggttggccgccgccaaggtgcgctacgcacgggcaatgcgcgaacggctgccccgggtgggtgaggtctttcgggccggggagatcgacttccggctgttcgcaacgatcgtgtatcgcaccgatctgatcaccgatcgccgggtgctggcggccgtggacgccgagttggccgcgacggcggcgcgctggccgtcgatgacccgggcgcggttggccgcccgggtggacgcggtggtggccaaggccgacgccgacgcggtgcggcgcgccgagaagcaggcggcgacccgccacgtctggatcgccgagatgggtgagggcctgtcgcatctggagggcacggtgtcgagtcccgacgcgcacgcgctggacaaacggctggatgcgttggccgccacggtgtgcgagcacgacccgcgcactggtgagcagcgccgcgccgacgcgctgggggcgctggccgccggggccgaccggttgggctgccggtgtggccgcgccgattgtgcggccggtacggggcccgccgccgggccggtggtgatccacgtgatcgccgagcgggccagcgtcgagggcaccggcggcgggccggcggtcgaggtcggcgccgagggtctcctcccggcgcagctggtcgccgagctggccgcgtcggccaggctgatgccgctggtccaccccgccgattcgtctccggagaaccggtacacgccgtcggcggcgctggccgacttcgtgcgctgccgggatttgacctgccgctggcccggctgcgaccgcccggccaccgagtgcgacctggaccatacgattccctacgccgagggcgggcccacccacgcgtcaaacctcaagtgctactgcagaactcaccatttggtgaagaccttctggggctggcgggaacaacagctgccggatgcgacgctgatcctgacctcgccggcggggcagacctatgtcaccaccccgggcagcgcgctgctgttcccgtcgttgtgcgtgcccaccggtgagccggcccggccggtcgcggccggatcccagccctgcggtgagcgcaccgcgatgatgcccacccgccggcgcacccgcggccaaaatcgcgccgcccgggtggccgccgaacgccgggccaaccgcgccgcccggctggcccgggcaactcggccggcccctgcggcgagccagtcctggccggccggccatgggcccgacgccgacccgccgccgttctagctgctctagctgcgaaatctcgccggctgagaaccctgcacccggaatttggctctgagctggtcgtcccctagactctaggggttgccttgggcagacctcggccggtgcgaatcggccccgcgtgcccttcggtgactaaccgctttacaagaccgcgcacgtcaggttttttggtgggtcatgctcgccgaatgcccacttcggtgggttctcctgccgtgcacacgcaaccaggtcaggagatcgagtgattcagcaggaatcgcggctgaaggtcgccgacaacaccggcgccaaggagatcttgtgcatccgtgtgctcggcggttcgtcgcgacgctacgccggcatcggtgacgtcatcgtcgccaccgtcaaggacgccatccccggcggcaacgtcaagcgaggggacgtcgtcaaggccgtcgtggtgcgcaccgtcaaggagcgcaggcgtcccgacggcagctacatcaagttcgacgagaacgccgcggtgatcatcaagcccgacaacgacccgcgcgggacgcgcatcttcgggccggtcggccgggaactgcgcgagaagcggttcatgaagatcatctcgctcgccccggaggtgttgtaaatgaaggtccgcaaaggcgacaccgtcctggtcatcgccggcaaagacaagggcgccaagggcaaggtgctcaaggcctacccggaccgcgagcgcgtcctggtcgagggcgtcaaccggatcaagaagcacaccgcgatctcgaccaaccagcgtggcgcccagtccggtggcatcgtcacccaggaagcgcccatccacgtctccaacgtcatggtggtcgactccgacggcaagcccgcccgggtcggctaccgcctcgacgaggagaccggcaagcgcgtccgtatctccaagcgcaacggcaaggacatctgagatgaccacgacagagaaagttcagccgcgcctaaaagagcgctaccgcaacgagattcgcgattcgctgcagcagcagttcggatccgccaacgtcatgcagatcccgacggtgaccaaggtcgtggtcaacatgggcatcggtgaggcggcgcgcgacgcgaagctgatcaacggtgccgtcaacgacctggcgctgatcaccggacaacggcccgagatccgccgggcgcgcaagtccatcgcgcagttcaagctgcgcgagggcatgccgatcggcgcccgggtcaccctgcgcggggaccggatgtgggagttcctcgaccggctcacctcgatcgcgctgccccgtattcgcgacttccgcgggctctcgtccaagcagttcgacggtgtcggcaactacaccttcgggctggccgagcagtcggtgttccacgagatcgacgtggacaagatcgaccgggtccgcggcatggacatcaacgtcgtcacctcggcgacgactgacgacgaaggacgagcgctgttgcgggccctcggctttcccttcaaggagaactgagcagatggcaaagaaggcactggtcaacaaggccgcacgcaagccgaagttcgcggtgcgcggctacacacgctgcaacaagtgcggccggccgcgcgcggtcttccgcaaattcggtctgtgcaggatctgcctgcgcgagatggcgcatgcgggcgagctgcccggcgtgcagaagagcagctggtgacgggacacaggggctaaaccatgactatgacggacccgatcgcagacttcttgacccgtctgcgcaacgccaattcggcgtatcacgacgaggtgacgttgccgcactccaagctcaaggccaacatcgcccagatcctcaagaacgagggttacatcagcgacttccggaccgaggatgcccgggtcggcaagtcgctgatcgttcagctcaagtacggcccgagccgggagcgcagcatcgccggcttgcgccgcgtgtccaagcccggtttgcgggtgtacgcgaaatccaccaacctgccgcgcgttctgggcggcctgggcgtggcgatcatctccacctcctcgggcctgctcaccgatcgccaggcggcccggcagggcgtgggcggcgaagtcctcgcgtacgtgtggtgagggggtagacatgtcgcgtattggtaagcaaccggttccggtccccgccggagtcgacgtcaccatcgacggccagaaggtctcggtgaagggacccaagggcaccctggatctgaccgtcgccgagccgatcaccgtgtcgcgcaacgacgacggcgcgatcgtggtgacccgccccaacgacgagcggcgcaaccgctcgctgcacgggctgtcccgcaccctggtgtccaacctcgtcaccggcgtgacccagggctacaccacgaagatggagatcttcggcgtcggttaccgggtgcagctcaagggctccaacctcgagttcgcgctgggctacagccaccccgtggtgatcgaggcgcccgagggcatcaccttcgccgtccagtccccgacgaagttctccatcagcgggatcgacaagcagaaggtcggccagatctcggcgaacatccgccgcctgcgccgccccgacccgtacaagggcaagggcgtgcgctacgagggcgagcagatccgccgcaaggtcggaaagacaggtaagtaaccatggcgcaaacacaagctgacaccgccgcgcgaaagccggtggggcagagcgtatccgcgacccggcgcgtctctcggctgcgccggcacgcgcggctgcgcaagaagatcgcgggtacccccgagcggccgcggctggtggtcaaccggtcggcgcggcacatccacgtgcaactggtcaacgacgagaacggcaccacggtggccgccgcgtcgtcgatcgaggacgacgtgcgcagcctgcagggagacaagaaggcccgcagcgtgcgggtcggccagctgatcgccgagcgggccaaggccgccggtatcgacagcgtggtcttcgaccgcggcggatacacctacggcggacggatcgcggcgctggccgacgccgcccgcgagaacggattgcaattctgatgatcgagaacttgaacacgactggaaggaccgcatgatggcggagcagccggccggcggacagggcgccggcgacagccgcgactcgcgcggtgaccgcgacagccgcggtcggcgcggcgacggcggtcgtgggggccgcgaccgcgacggcgacaagagcaactacctggagcgcgtcgtcgccatcaaccgggtctccaaggtggtcaagggcggtcggcgattcagcttcaccgcactggtgatcgtcggcgacggcaacggcatggtcggtgtcggctacggcaaggccaaggaagttcccgccgccatcgccaagggcgtggaggaggcccgcaagggcttcttccgggtgccgctgatccgcgggaccatcacccacccggtgcagggcgaggcggccgccggcgtggtgctgctgcgcccggccagcccgggtaccggtgtgatcgccggcggcgccgcccgcgcggtgctggaatgcgccggggtgcacgacatcctggccaaatcgctgggcagcgacaacgccatcaacgtggtgcacgcgaccgtggccgcgctcaagctgctgcagcggcccgaggaggtggccgcgcggcgcggcctgcccatcgaggacgtggcgccggccggaatgctcaaggcgcgccgggaaagtgacgcgctggccagtgcggcggcggcgagagaggcggcggcgcaatgagtcaactgaagatcacccaggtgcgcagcaccatcggagcccgctggaagcagcgcgagtccctgcgcaccctgggcctgcggcggatccgccactcggtgatccgcgaggacaacccgcagacccgcggtctgatcgcggtggtcagccacctcgtcgaggtggcgccggccgacgcgagctccgcgggcaccggaggtagcaagaaatgacgatcaagctgcacgacctcaagccggcgcgcggatcgaagaccccccgcacccgggtcggccgcggtgagggctccaagggcaagaccgccggccgcggcaccaagggcaccaaggcccgcaagaacgtgccggtgacgttcgagggtgggcagatgccgattcacatgcggctgcccaagctcaagggattccgcaaccggttccgcaccgagtacgagatcgtcaacgtcggtgacatcaatcgccttttcccgcaaggcggttcggtcggggtggacgagctggtggccaagggcgcggtccggcgcaactcgctggtcaaggttctcggcgacggcaagctgaccgtcaaggtcgaggtgtccgcgcacaagttcagcggcagcgcacgcgagaagatcaccgccgcgggcggctcggtcaccgagctgtagtcggcccgcgcggctaattcagctgcggaatcacttccgcggcaaggcgttccatctgctcgtggttctccgcgacatcggcgccgacggggttcagtagcagcgtctgcgccccggcgtcgatgacctcgcgcagcccccggaccacgtccccgggcgtgccggacaccggcacgtcggccacgccgggcatccgcccgtagatgcggcccagcccggccagcacccgctcgcgggcccgcgccgcgtcgtcgtcgaccgtcaggtaaacccttttgccgatcgtgaattcggccgggtccctttgctgttcgtcgagttcgcggcgcagcacggccactgccccggcgaacgcctcggtggtcgacgagcccgcgcccatgaacgcgtcgccgtgccggaccgcgcgggccagcgccttcggcgccagcccgccgaaccagatcggcgggtgcgggcgctgcaagggcttgggcgcgatcggcaggtcgtcgacgtcgcggaaccgcccgtgaaacgtcacccgcgggtcgtcggaccaggccgccttcatcagcttcaggccctcggtgaaatacgcgacgaaggtgtccttgtcgactccgaaggcggcgaacttgcgggtgccgccgccgggtgcgacgccaatgtccaaccggccgtggctgagtcggtccacggcggtgaccgccgaggccagctgcagcggatcgtgcagcgacgtcaccaacaccgcgacccccagccgcagccgctcggtgcaggccgcgcagtaggcgagcagctccagcggcgccagcagcggcgccggaccgatgatctgctcgagcgcccagccgccctcgaacccgagctgctcggcgcgcgtcaaaaaggaacgcagccccgccccgtcgaagccgtcgtagtcgaactgggggatggcgatggaaaacctcacccgaccaccgtacggccgttcgtcggtagtctgcagacatgttcgctgtgctgtcctcgatacccggcctgtccaaaggcgccgacgagatccgtgccctggccgggcgcgtcgacaccgcccgccatcacggcgtgcccaacggctgtgtgctcgagctggatctgcggtcgatgccgccggagacgtccggcttcgacccgctggcgctcgtcaccggcggcagccggccggcatcgctgcgcgacacggtggacgccatccaccgggcggccgaggacccgcgggtggccgggctgatcgcccgggtgcagctggcgccgtcgccgtcggccgcggtgcaggagctgcgcgaggcgatcgtcgccttcaccgccgccaagccgtccctggcctgggccgagacctatccgggcacgctgtcgtactacctggcgtcggcgttcggcgagatctggatgcagcccggcggcagcgtcgggctgatcggcttcgccagcaacgccaccttcctgcgcgacgcgctcgacaaggcgggcatcgaggcccaattcgtcgcccgcggcgaatacaagtccgcggtaaaccgtttcaccgaacacggcttcaccgaggcgcaccgcgaggccgtcacccggatgctggacagcgtccaggaacaggtgtggcaggcggtagccgaatcacgcaagctcgacaccgacgcgctggacgcgctggccgaccgcgcgccgctgctgcgccaggacgcgctggactccggcctggtcgaccggatcggcttccgcgaccaggcgtacgaccggatcgcggaactcgttggcgtacaagatgtttcaccggacaccgagccgccccggctgtatgtgtcgcgctacgccggcgcggcccggtcccggctgtccccgccggtgccctcgctaccggggcgccgccgcccaccgacggtggcggtcatcaacgtcgacggcaccctcgtcgacgggcgcggcgggccccatttcctgccgttcggcgccgccaccgtgggcagcgacaccatcgcgccggcgctgcgggaggccgccgccgacgatgcggtgtcggcgatcgtgctgcgggtcaacagccccggcggctcggtcaccgcgtcggaaaccctttggcgcgaagtgaaaagggcccgtgaacgcggcaagccggtggtggcgtcgatgggtgcggtggccgcctccggcggctactacgtgtcggtggccgccgacgcgatcgtcgccaacccggcaacgatcaccggttcgatcggcgtcatcaccggcaagctggtgatccgcgacctgctggggcggctgggcgtcgggtcggacaccgtgcgcaccaacgccaatgccgacgcgtggtcgatcgacgcgccgttcaccccggagcagcgcgcccaccgcgaggccgaggccgacctggtgtacaccgacttcgtgtcccgggtggccgagggccgcaacctgaccaccgacgccgtcgaacgggtggcccggggccgggtctggacgggcgccgacgcccacgagcgggggctggtcgacgaactgggcggctttcgaatcgcggtgcggcgggccaagattctcgccgggctggacgaggacgccgacgtgcgcatcgtcacctatccgagcggctcgctgctggacgtactgcggccgcgggcctcgtcgcaaccggcggcggtgtcgctgcccgacgcgctgggcgccctgacggtcaagaccctgggcgcgatcctggacaacgtcgagcgatcctgcagcggtgccagcgcgctgtggctggggccgtcgcggctctagcgggtccgtgtggcgctgatgaagatgatctcgccgagcgggtcgtcgttctcgggggcgggcacctcgatgccgtgccggtggaacagttcggtgcgggtcacaccctcggcccgccacccgaggccgttcaggtaatcgatgacgtggttgcgttcgccggcgtagaccagcgacgccatgtcgatgtcgacgccgtgctgccggaacgagccggacatctcccgcacccgttcggcgtcgaaatccacgatgccgggcacgaattcggtggcgatggtgctgcccggcgcggacagcgcggtgatgttgtcgaacagccggtcctgggcctccggcggcagatagatcagcaggccctcggccagccaggccgtcggcgcggccggatcgaatccggcggcgctcagcgcggcgggccagtcgccgcgcagatcgatggggatggtgcgccgggtcgcggtgggctcggcgccgacctcggccagcgtgttgctcttgaattcgatcacccgcggctggtcgatctcgtagaccaccgtgccggccggccacggcaaccggtaggcgcgcgaatccaggccggaggccaggatcaccacccgacgcaccccggcgtcggtggcgtcgacgaagtagtcgtcaaagtacttggtgcgcacggccattccgtcgaccatcgactgaatccgcaccggggtggcgttctcgatcgcatccaggtcgagctcgccgtccatcatcttggtgaagaagtccaccccgaccgcgcgcaccagcggctcggcgaacggatcgtcgatcagaccgcggggatccttggtcgccatggcgcggccggccgcgaccatcgtcgcggtggcgccgacgctggacgccaggtcccactcgtcgtcatgcgtgcgtgtcatcgcgagcaaccttagccgcggccaccggtgagggtggcgtcgacgtagctcatctcaccgaaggtggccctcatctcgtcctcggggaactcgaaaccgttgcgggcgtacaactgtcgggccggatgcggcgtcacccgccagcccttgccggtgaggtagtcggcgacgacgttgcgctcgccccggtagaacaggtcggcggcgttgaggttgagaccgagacgctgccagcgctccgagatgcgggccaaccgctcgtcggagaacgcgttggggtccggcacgtgctcggtggccagccggctgcccggcgcggacagggcggtgatgttgtcgaacaaccggtcctgggcctccggcggcagatagggcaacagcccctcggcgctccaggccgtcggccgggtgacgtcgaaaccgccctcgcgcagggccgcgggccagtcgtcgcgcaggtcgatgctgatggtgcggcgctcggcggtgggggccgcgccgaggttggccagcgtgtcggtcttgaacgcgatgacctgcggctggtcgatctcgtagaccaccgtgccggccggccaggtcagccggtaggcccgggtgtccaggccggaggccaggatcaccgcctggcgcagcccggcctcggtggcgtcgatgaagaagtcgtcgaagaacctggtgcgcaccgtgatctgctcggcccgcgcccggcggttgaacagcgggtcgtcggggaagtcgagcttgccctcgacgatgcggatgaacggatccagtcccaccgcccgcaccagcggttcggccagcggatcgtcgagcagcgcgtcgggtccctgcgacgccaccgcgcgggcggcggcgaccatggtcgccgtcgctcccacgctctgcgccggaccccaggtgtcgccgtcggtgcgtccctcactcatagatcccccaggtgtagagcatctcacccatccgggtgtcgtcgtcatcgagcgggtcaagtccgttggccgcgaacagatcccggatggtgacgctgttcagccgccaaccgtggccggccagatacggggcggcctcgttgcgctcgccgaagtagaccagtccggccatgtcgaggtcgaacccgtgcgcgcgccagcgctgcgagatcgcctgcatgcgttccttgagcttctcctcctcgccgggcgcggggttgggcgcgctctcggtggccagccggctaccgggcgcggacagctcggtgatggtgtccagcagccggtcctgcgcctccggcggcaggtagccgagcagcccctcggcgctccacgcggtcggccgggccgggtcgaacccggcggcgcgcagcgcggcgggccagtcgtcgcgcaggtcgacggccaccacccggcgctcggccgtgggcgcggcgcccagctgcgccagcgccgtggttttgaagtcgatgacctgcggctggtccacctcgtagaccaccgtgccggccggccaggccagccggtaggcgcgcgcgtccagcccggaggccaggatcaccacctgcgcgatgccggccttggtcgcgttcaggaagaactcgtcgaagaacttggtgcgcacggccatgttgtcggccatccgcgacatcgccccggcggacccggcggcgccgtcgtgcacgtcgttcagctcagccgggtccagctcgccgcccgccagccgggacagcaggtccacgccgaccgccttgaccagcggttcggcgaacaggtcgttgatcagcgggttgtccgcccgggtggccatcgcgcgggccgccgcgaccatggtcgcggtcacccccacgctggaggccaggtcccaggtgtcgccctcgtacctggtggaagtcatgtgcgcacccctatcggagatcgtcgaggtagtagccaagctaatatttagccgatataacaagctgcccccactgtacgcttcccgcgattcgcggcaacctttactgatgacgtacgcgggcaagagggtgttgatcgccggggcggcggcgccatgaaggcactggtctatggcgtcgcgccggagcccgtcgcggtgcccgacgacgccaacccgctggtccagaacctggcccgcaccccgaccgggctgcgcgacatgccggaacccgtgctgccgcacgaggattgggtgctcacccggccgcggctgaccggcatctgcgggtcggacgccaagcagatcctgatggacttcggcgagggcgacgccgacaacgccatgtccgccttctgctcgttcccgcaagtcatgggccacgaggtggtggccgacgtggtggcgctgggacccggggcgcgggggttggcggtggggcagcgggtggtgctcaacccgtggctgtcctgcgggccgcgcggcatccaaccgccctgccccgcatgcgaagccggcgactacagcctgtgctggagcttcgccgacggcgacctcaaacccggcatccacaccggcgtctcggccgacgtgaccggcggctacgccgagctgatgccggcccacgacagcatgctgttcgcggtgccggagcgggtccccgacgagatggccgtgttcgccgacccgttctcggtgtcgctgcacgcgatcacgcgccacccgccgccccgctcggggcgggcgctggtgtacggcgccggctcgctcgggctgtgcgcggtggcgatcctgcgggcgctctacccggaggtcgccgtggccgtggtggcccgcttcgacgcccaggcggagctggcccggcgcttcggtgccgccaaagtcgttgcgcacgaaccgcgtacggccgtcatcgaagaactggtcggctggggcggtggccggctgcgccggccgctgctgggtctgccgatggcccaccccggcgcggtcgacgtcgtctacgacaccgtcggcaaacccgagacgttagaggtcgccgtccgcctgctgcggtcgcggggcaccctggtgaaggccggtgtgcacgcgcccgggcgctgggaggacagccccttgtatttcaaggagatcgcgctggtcggctccaacgccttcggggtcgaggaggtcgacgggcagcgccggcacgccatcgcgcactacctcgacctggccgcggcggggcgggtggacctgcgcccgatgctcacccacacgttcacgctggaccgctggcgcgacgcgttccacgccctggccgaccagggccggaccggcgcggtgaaggtggcgttcgaccagcgttagcccagcgcgccccgggatccgaggcgtcaggggttggcgcgcagatagccgtacacggcggcgaagttgcggttgacgtccgcgggaattggcaccggaccgccgagagctcttgcgccccagacgatttgggcggtccgctccaccagcgcggtgatgtgcaggaccttgtcgggccgcgggcccaccgccaccaggccgtggttggcgatcagggcggcgccgcggccctgcagcgccttgaccgcgttggcgccgacgtcaggggtgccggaggcggcgtagtcggcgcagcgcacgtcgccgccgcaatacaccgcgaactcgtcgatgcacgccggaatcgattggtgcgcaatggcgaacatggtcgcccacaccggatggctgtggatgacgcagccgatgtcgtcgaacgcggcgaagcaggccaggtgcagctgcatctccgtggacggcgagcggccctgcgcggcctgcagcaccgaaccggcggggtcgatcagcaccaggtcgtcgagctgcatgtcgcggtagtccaccgacgacggcgtgatgacgatgttgccgtcggagcggcgcgccgagatgttgccggcggtgccctccaccaggccgcggcgcagcatgtccttggcggcgtccagcaccgcctgttccgggtcgtcgacgaacttcatcgggccaacacctccgggttgacgatgtgggcgggcgtcgcgccggccagcagcgcttccaggtcgtcggccaccagctgcgcctgccgggcctcagtgttccacgtggccccgccgatgtgcggcgtcagcaccacgttcggcatgccgaccagcgggtgatcggtcggcagccactcaccgacgaagtggtccagcccggcggcggccaccttgccggcgcgcagcgcctcgaccagcgcgtcggtgtcgtgcagctgggcgcgggcggtgttgaggaagaccacgccgtcgcgcatggccgcgaactgctcggcgccgatcatgccggtggtctcgtcggtgaccggggcgtgcagcgacaccacgtcggactcggccaacagctcgtccagaccgtgccgggcctcggggtggtaggggtcgtgcgcgatgacgcgcagacccagcccgctcagccgccaccgggtggcgcggccgaccgcgcccaggcccaccagccccgcggtcaggcccgcgatctcgccgccgcggaaccgctgatacgggatgctgccgtcgcgaaagatgttgccgccgcgcacatccgcgtcggcgggaagcaggtgacgggtggcggccagcagcagcgccacggtcatctcggcgacggcgtcggcgttgcggcccggggtgttcagcaccgggatgcccgccgcggtggcgccgtcgatgtcgacgttgttggggtcgccgcgcgtcgcggcgatcgcgcgcacaccgagctcgaacaccgggccgcgcaccgaatcgctttccaccaccaccacgatttcggcttcctcggccgcgatccgctcggccagctgctcggcgctgtagatgcgcaacggccgctgctcgatccaggggtcgtagaccacctcggccagcacccgcagtttgtccaggcccggcccgcgcagcggggcggtcaccaaggcgcgcggtttggacgtcacgcctgccaatgctggcgtacggtgacgcccgtgtcacgcaaggacgtcacaatcggcatcgacgtcggcagcaccgcggtcaaggcgttagccgccgacgccgacggccgggtcatggcccgcgtgcgcatcccgcacgaactgcggataccggcacccgaccggctcgagcacgacgccgaggcggcgtggcggcgcggcccgtcggccgccctggacgaactgctgcatcagcccggcgtcgcggcggtggcggtcgcggccatggtgccgtcgatgacggcggtcgacggctccggcacgccgatcaccccgggactgctctacggcgacggccggggccgcaccccgggcggcccgcaaaatcagccgctgcccgcgctgggcgaggccgccgagttcctgcgctggacggcggcccgcgctcccggtgccgccggctactggccggcgcccgcggtggccaaccacgcgctggccggccaggccgtgatcgacgtcgccaccgccgccaccgccttcccgttgttcgacgggaccggctgggacgccgccgcgtgcgccgagcgcggcgcgcgcgtcgagcagatgccgcgggtgcacagcatgggcgccgttgtcgggcagctgccgggcggcgcggcgctggccaccggcgccatcgacgcgctgtgcgaacagctcgtggccggcgccgaccgcgacggcgacgtgctggtgatgtgcggcaccacgctgatcgtgtgggccaccatttcccaggcccggcagatgcccgggctgtggaccatcccgcacaccacgccgggcaagagccagatcggcggcgccagcaacgccggcgggctgttcctcggctgggtggatcgcgttgtggcacaagcggatccggcatctgcccagcccgggcgggtgccggtgttcgcgccctacctgcgcggcgagcgcagcccgttccacgacccggaccgccgcggcgtgctcgaggcgctggacctgacccacgacgccgccgcgctgcgccgggccgcctacgaggcgtccgggttcgtggtgcgccagctcatcgagctgtccggcgcgccggtgtcgcgcatcgtggccaccggcggcggcacccgggtggggccgtggctgcaggccatcgccgatgccaccgggcacccggtcgaggtgtccgcggtggccgagggcgccgcgctgggcgccgcgttcctggccaggatggccgccggcctggagaccaccctcaccgacgccgcgcgctgggtgcgcaccgagcgcgtcgtcgagcccgacccggcctgggccgccccggtgcaggaccgctaccaacggttcctggagttgggaaaccgcccgtgtcccgcggttgtggcgcggtagccgcaccggcgttctaggctggtgcaatgaccgaccaggaccgcaaagccgcccgccgggaaatcgccgatgccctgttgaaagcgctggaacgacggcatgaaatcgccgacgtggtggtggaatcggagaacaaggcggccgcggtggaggcgatcgtgcggctgctggacacctcgcacctggccgccgaggcggtgatgggcatgtcgttcgatcagctcaccatcgactcgcggcgcaagatcctggccgaactcgaggacctgaacaagcagctgagcttcaccgtgggcgagcgcccggccagctcgggcgagaccctggagctgcgcccgttctcggccaccgaggaccgcgacatcttcgccgcccgcacccaggacatgggctcggccggcgacggatccggcgggcccgccggcgacctcgacgacgagatccgcgcggcgacggcccgcctcgacgacgaggaggccgcctggttcgtcgccgtcgattccggtcagaaggtcggcatggtgttcggcgagctgctcaatggcgaggtcaacgtgcggatctggatccaccccgatttccgcaagcggggttacggcaccgccgcgctgcgcaagtcgcgcaccgagatggcgtggtgtttccccgccgtcccgctggtcgtccgggcgcccgccgccaaacccgcctgacggtcagcccaactcggcgctcacggcgacgatgttggggaactgcgccgtctcgtcgtcctcggggtaggccaggccgtagtcgtcgaacaggtcccggcgtggccgggcgctgacccgccatccgcgcccggtcaggtactcgacgacgttgctgcgctcgccgtcgaagaacagcccggacaggtcgatgtcgcagcccaccctggcccaccggtcgttgaactcctgcgcgcgctgcgccatcgtcgtgccggtggcgtccgggtgatattcggtggccagccggctgccgggcgcgctcagggcggtgatgttgtcgaacagccggtcctgtgcctccggcggcaggtacatcagcaggccctccgcgctccacgacgtcggctgtgtcacgtcaaaaccgttggcgcgcaatgcttccggccagtcctcgcgcaggtcgatgctgaccgtgcgcagctgcgcggccgggcgggcgtccagcgccgccatggtgttggtcttgaactccaccaccttgggctggtcgacctcgtacaccacggcgccggccggccagtccagccggtaggcgcgggcgtccagcccggcggccaggatcaccgactggcggattccgtcccgggcggcgccggtgaagaagtcgtcgaaaaatcgggtgcgcaccgcgatcgaatccgtctccagctgcaggtcgcgttccccgcgttgcggatccgcgggcgccacctcgccgtcgaccaggcggcggaagaaatccaggccgaccgcccgcaccaacggcgcggcgaacgggtcgttgatgatcgggcgctcgcccgtgctggccagcgcgcgggccgcggccaccatcgtcgccgtcgcgcccacgctcgaggccaggtcccaactgtcttggtcggtgcgtgtcatgctgctcccaagttacttagcaaatgcaacgattcatccgcactgtacgccccgcggcttacggcttcctggaaaggccctgaccggacccggccggaccagctgttagtctcgtacacggtttgacgcgctgtaattgagtcgggccgtacgtcctggcctgcgggtgttgggcgcgtgatgcaggaaatcccggctgcgcaggaggaagagttgctttcggctttcatctcatcgctgcggacagtcgacctgagacggaagatcctcttcacgctgggcatcgtcgtcctgtaccgggtcggggccgcgttgccgtccccgggcgtcaactaccccaacgtccagcagtgcatcaaggaagccagcggcggcgcggccgggcagatctactcgctgatcaacctgttctccggcggcgcgttgctcaaactcaccgtgttcgccgtcggggtgatgccctacatcaccgccagcatcatcgtgcagctgctcaccgtcgtcatcccgcgcttcgaggaactgcgcaaggaaggtcagtccggtcaggccaagatgacgcagtacacccgctacctggccatcgcgctggccatcctgcaggccaccagcatcgtggcgctggccgccaacggcgggctgctgcagggctgctcactggacatcatcgccgaccaatccatcttcaccctcgtcgtcatcgtgctggtgatgacggccggcgcggcgctggtgatgtggatgggcgagctgatcaccgagcgcggcatcggcaacggcatgtccctgctgatcttcgtcggtatcgcggcgcgcatccccgccgagggcaagaccatcctggacagccgcggcggcatgatcttcgccgccgtgctggtggccgcgctgatcatcatcgtcggcgtggtgttcgtcgaacaggggcagcgccgcatcccggtgcagtacgccaagcggatggtgggccggcgcatgtacggcggcacctcgacgtacctgccgctcaaggtcaaccaggccggcgtcatcccggtgatcttcgcgtcctcgctgatctacatcccgcacctgatcacccagctgatccgcagcggcagcggcggcgtcggcaacagctggtgggacaagttcgtcggcagctacctgtccgaccccagcgacccggtctacatcggcatctacttcgggctgatcatcttcttcacgtacttctacgtgtccatcacgttcaaccccgacgagcgcgccgacgagatgaagaagttcggcggcttcatccccggcatccggccgggcaagcccaccgcggattacctgcgttacgtgctgagccggatcaccttgcccggctccatctacctgggtgcgatctcggtgctgcccaacctgttcctgcagatcggcaacggcggggcggtgcagaacctgccgttcggcggtaccgcggttttgatcatgatcggcgtgggcttggatacggtcaagcagatcgagagtcagctcatgcagcgcaactatgaagggttcctcaagtgagagtcgttttgctggggccgccgggagcgggcaaggggacgcaggcccagaagctctccgagaagctcgggatcccgcagatctccaccggtgagctgttccgcagcaacatcgagaacgggaccaagctggggctggaggccaagcgctacctggacgccggcgacctggtgcccgcggagctgaccaaccagctcgtcgacgaccggctcagcgagccggacgccgccaacggtttcatcctggacgggtttccccgatcgttgcagcaggccaaggcgctgcacgagatgctggaacgccgcggcaccgacatcgacgcggtgctggagttccgggtgtcccaggacgagctgctggcgcggctcaaggcgcgcggccgggccgacgacaccgacgaggtgatcctgaaccggatgaaggtgtaccgcgacgagacggcgccgctgctggactactaccgcgaccagctcaagacggtcgacgccgtcggcaccctggacgaggtgttcgcccgggcgctgtgcgcgctgggcaagtaggaatgaacgcgctggcgcggctgcggggccgcaaggtggtgccgcagcgcagcgacggcgaactcgacgcgatggccgccgcgggcgcggtggtggccgccgcgctgcaggcggtccgcgcggccgcggtcgccggggtgtcgacgctgagcctggaccagatcgccgagtcggtgatccgcgatgccggcgcggtgccgtcgttcctgggctaccacggttacccggcctccatctgcgcctccgtcaacgaccgggtggtgcacggaatcccctcggccgcagaggttttggcgcccggcgacctggtgtcgatcgactgcggcgcggtgctggacggctggcacggggacgcggcgatcaccttcggggtgggcgccctggacccggccgacgaggcgctgtgccagggcacccgggagtcgctggaagccgggatcgcggcgatggtgcccgggaaccggttgaccgacgtctcgcacgccatcgagctgggcacccgcgccgccgagacccggcacgggcgggcgttcggcatcgtcgagggctacggcgggcacggcatcggccggcagatgcacatggacccgttcctgcccaacgagggctcgccgggccgcggtccgctgctggcccccggctcggtgctggccatcgagccgatgctgaccctgggcaccggcaagaccgtggtgctcgacgaccagtggacggtcatcaccaccgacggctcgcgtgcggcacactgggagcacaccgttgccgtcaccgacgccgggccgcgcatcctgacgatcgggtaggggcgcaccgggtcggggccgttgaaccgaaccttcgccgggctcgtttccccggcaggaggtgatcgagtggctcgtgtggtcggcatttccagggcgtccgggactgccgaggccgctctgatgaaggcgctctacgacgaacacgccgcggtgctgtggcgctacgcgctgcggctgaccggcgacgcgagccaatccgaggatgtggtgcaggagacgttgctgcgggcctggcagcatcccgaggtcatcggcgacaccgagcgctcggcccgggcgtggttgttcacggtggcccgcaacatgatcatcgacgaccggcgcagcgcgcggttccgcaacgtggtcggctcgaccgacaccgcgggggcgcccgaacagtccacgcccgacgaggtcaacgcggcgctggaccggttgctgatcgccgacgcgatggcccagctgtcggccgagcaccgcgccgtgatcgaacggtcctactaccgcggttggaccaccgcgcagatagctacagacctcggcatcgccgagggaacggtgaagtcgcgactacactatgcggtgcgggcgttgcgactcactctgcaggaactcggggtcacccgatgagggactttccgaatgtttgaggggtgagcagacatggatgaaatgaggacgccggtgcacgacgtcggccctcccgaagaccgctacgcgatgtgggatgccgcatacgtgctgggttcgttgtccgccgcgcagcgccgcgaattcgagcaacacatggcgcactgccgcggctgccgcgaggcggtcgccgacatcagcggggtgcccgcgctgctgtcccggctcgaccacgacgaagtggccgccatcgacgaggccggccccgccccgcagctgtccgccgacctgttgccgtccctgctgaccgcggtgcgccggcggcgccggcgcggccgggtggcgacctgggtggcatcggctgccgcggcggcggtgctggccatcggcgtgttcgtcggcctcgaggggtggtcgtcgactccggcgcggcaggtgaccgcgtcggccgagccgatggcccaggtcggcaccaccctgctgacctcgaccgtgcaggtcagcggccagcactggggcacctcgatcaacctgaggtgcgtgtgcctggccccgctcaacgcccaccacgacaccctggcgatggtggtggtgggccgcgacggcagccgcacccggctggcgacctgggtggccgtgcccggccacaccgcgtcaccggcggggtcgatctcgacgccggtggaccagatcgccgccgtgcaagtggtggccgccgacagcggccaggtgctgctgcagcgttccctgtaaacgatcggagccagcgtggtcggcgacgcgcgtccgctgcgggtgctggtggtgggcgccggcgtggccggcatctcggtggcccgcggactgctgcgcgacggccacgacgtcaccgtcttcgagagccgcccccggctggcggcggccggcggcgcggtgacggtgtggtccaacggcgagacggtgctgcgccagctgggcgtcgagatggacggcgccggccggcagctgtccagcgtgcgggcggtgacgtcgacgggccggccgctggccacgctggacgtgaccgcgatggcgcggcggctgggcgcgcccgtgcggatggtgccgcgccgggtgctgctggagcggctgctggacggattcccgcccgggcgcatccactgtgaccgtcgcgcggtcgcactggccacctcccgcgacggggtcagcgtcgaattcaccgacggcaccgtggccgagggcgacgtgctgatcggcgccgacggcctgcactcgatggtgcgcgagtgggtcggcgcccggcacgccaaggcgaccggctggtgcagctggcagggcctggtcagcctcccggagatcgccgagtccgacgccgccctgatgatgatcggcggcggcggaaacctcggcctctggccggccggcggcgccgaggtgcaatggtggttcgacctgccgtggtcggcggggttcgtccggccgcaacacccgatcgagacgatccgctcgcacttcgccggatggtccgagccggtcgatcgggtgctggcgatcctgaccgacgaggatctggccgcgtcgccgttcccgcattttcggcatccgatcccgcgccccgggcagggccgggtcaccctgctcggcgacgccgcgcacaccatgccgcccaccctggcgcaggggaccaaccaggcgctgctcgacacgatggtgctgtgccaggcgctggccgatttcgggcgggggacacccggcggccaggccgacgtcgcgaacgcgctgcgctggtacgagaagacccggcgccgccgggtccgggcggtgtcctgggtggcctcgctgccggtgtcgcacggcgaggccgtgctgcgcccggccgcgctggtctccgaccggctgcaggccgccgcgctgacgatgttcctgcgctggaccagccaccgccgcatgtccgaccacatcaaccgcagcttgggggaagcgatcaaccgcagcttgggggaagcgccgaagattccgtcacgccggtgaacggcccgggcgaatccgtaagggtgcgaggcgatttcgacgccccgtcgcgctggctgtggctggtgaagtggtgcgtgctggcggtgccgcactacccgatcctgatcgggctctacctggtgtacccgctgtgcatcgtcgtcgccgggatcgcgatcgtctgcaccggtcggtatccgcggcggctcttcgacttcaacgtcggcgtgctgcgctggtcctggcggcttatgaactaccgattcccgatgaacagcacggaccgatacccgccgttcacgctcgcggcctcgcccgactatcccggcgacctcgccgtcgactatccgcgacggctgaaaaggcttgcggtgccgatcaagtggctgttggcgatcccgcacgtgctggtctgctggtcgatggagccgctgctgcaggtgctgtgcctgaccgccgcgctgacgttgctgtgcaccggcaccgtcccgcccggcatgttcgatctgctgatgggcatcgtgcggtggcggtaccgggtggccgtctacgtgtcgttgatgcgtgacgaatatccgccgttccgaatggatctgggctcccgatgagattccgcaacgtgctgttcccctacgtgtaccggttcgggcagccggtgttcgaccggctcttctaccaccggtatcggcggcaggcgatgagtcacgccaccgggcggctgctgatggtcggcctggggccgggcaccgacctgatgttcctgcccgccgcggtgacgtcggtggcggccgtggagcccgaggcgtcgtttcgccggatggccgcccggctggctgcgcgccacggggtcgcggtcgacgtggtcgcggggtccggcgagtcgattcccttcccggacaacagtttcgactcggtgcacatcgggctggtgctgtgctcggtgcgcgacgtggcggccaccctggccgagatccgccgggtgctggtgcccgggggcaggctggtggtgctcgagcatgtgcgcggggacgggctgacgggccggctgcaggatctgatcgcccggccgtggtcctggttggccggcggctgcgagcccaaccggcggaccggggcggccatcgccgccgccgggttcgacacctcgatgctgcgcagcgtgccccgcaccccggtgcccttcccgtgcaaaccccacctgcagggattcgccgtgctcagtccacgctgaccgcctcgatgatgttcagccgcgccgcccgccgcgcgggcggcaccgaaccgagcagggtgatccccagcgccccggcggtgcaggcaagcgccagcgggctgagccggaaggccactgggaagttcatcatgtccccgctgatgcggctgaacaaccactggtccgccagcccgagcagcaaccccaaaccaccgccgacacaaccgattccggccgcctcggcaagcaccatacgcagggtgagccggcggccggtgcccatcgcccgcagcacaccgatctcgcggcgccgctcggtcaccgacagcgtcaacgtgttgagcagggcgaccgcggccaccgccaccacgatgatccacaccgcgttggcgatgaacatgctctggtgcagcggggcctgcagcccggccagcgcggcgcggccgtcgtagacgtggttgggcgccggcaccgccgcgcggacgtcagccagcagccgccgcggatccacccccggggccgccgtgacttgcagcgtcgtcgccgccgggcgatcgaaccatgcccgcagctgggccagatccatcccgacggtgccgatgaccgtcgagaagaacggcaccaccgccagcaccgccgcctcccgcgggccgtgcggggtctgcaaccgcagccggtcgccggcccgcacgttgagcgccctgcccagattctgggtgagcaccacaccccgcccggccagcacctcggcgcgcacccggtcgtcgagcgcgcggaacaacgcgtcccggctgcccgcggcgaacccgtccagcagcacccgggttcccgcgacgacggcgaacccgcacgccccctcggtcacccgcgccgcaccgggcagcgcggcgagtctttccgaaagcccttgcggcagaacatccgtggggaaactgtcgggcggatccgcgctcacccacacgtcagcctcggcgacgggcgcgaagatggcgcgcgccgacccgatcatgtccgcgttggtgccggtgatcaccaccgtggtgagcaccccgatcaacaccgtcatcacggtggcccacacccgccgcggtgcgcgccggatggtcgcggcggcgagcgcaccgcacgacccgaacacgcgggacagcgcggacgtggcggtgacgatgggcacggtgagcgcgaagcccgccgccagctcggcgaccagcacggcgcccagcagcacgcccgtcggggcgccggccgggaccgccagggccgccaccgcgaacagcgccagcgcgccgaccccgctggcggcccgcagccacggcggcaccgcgtcggccgccgacgccccgaccggcgccagcgcctcgaccggggaaaccttgtacacctgccgcgcggccatcgccgcggccgccacggcggtgagcgccgtcgccgccagcgccagcgggacggcgtagccgggcagccagtactcgacgcgggcttccagtccctgcgtgacggccgggggcagccggccaattgccatgcgcccggccaggattccggcgccgcaccccaacgccccgccgatcagcccgagaacggcggcctcggcgagcaggtcgccgatgacggcgcggcgccgcccgcccagcgcgcgcagcatcgagatgaccgggcggcgctgggtgatcgccatcgtcatcgtggtgtagatcaggaacgcgccgaccaccagcgccaccgccgcgccgagcagcgccatgtaattcatcagccggacgccgtcgccggcgcgggccgcccgcgagctgggcgccgccacgatcgcccgcccgcccacggcggcgccgaccgcggcgcggacggcggccgggtcggcgcccggcgtgaaggtgatcaggatcgagtccagctgcccggcgcgcccggtgacgcgctgcgccaacgccagcggcgccagcacatagtgtccgccgttgagttcggcgaactgcctgccggccagcacctcggtgacggtgaccggggccgaacccagttggaacgcttgacctttcgcatacccggcccgcggccccacctgcacgccgtccggcgtcgcggaaagctcccgcaccggtcgcgacaccgcgtcggtgagggcgccgcccagcgcggcggtgcgggcgtcggcgcccagcagcagaaccggcccggacggcgtggccgccgtcgtccggatcatcggcgcggcggtggcgacaccgggcaccgcggcgacatcggccagcaccgagtcggcgaatccggcgtcggtgatgccggagacctcgagcgcggccaccccggcgatcccgtcggccagccggctcaccgatccggtgatcgagccgaagatgccgaagaccgccaccaaatacgttgcggagacggtcatcacggcgatcgacgcggtggtgcggcgtcgatgcacggcgatctcgcgcaggctgaacacgcgcagccggctcgccgcggccgtgaccgcacgccccgacctcacccggcgaccgccagcacgtccgaaccgacccggccgtcctgcagcgtgatcacccgatcggtggccgccgcggcgtcgctgttgtgggtcaccatcaccaccagccggtgaccgccgccctcgtgcgccacctcggccagcagctccaggatggccgcgccggtggaggaatccaggttgccggtcggctcgtcggccaggatcagcggcgggtccatcatcagcgcccgcgccaccgcgacccgctgcatctggccgccggacagctccgcgggccggtgttcggtgcggttgcccaggcccacccggtccagcagccggagcgcgtccggcctggcccgacccagccggaccccgtcgagcaaccgcgggatcgccacgttctcccaggccgacagggtgggcaacaggttgaaggactgaaacacgaagcccacccggcgatggcggaaccgcgactgcgcctcgtcgccgagccggccgatctcctcgccgtcgaagcggatggaacccgagtcgggggagtccagcgcgcccagcagatgcagcaacgtgctcttgcccgcgccggagggcccgacgaccgccacgaactgcccaccggccagctgcaggctgatccggtccagggcccgcaccggttgaccgcccacccggtactcgcgcaccacgccggccatttctatggtcatctaggcaccacggtgacggccgacgaacggttcaccggccccgccgcgcgacgatcgtgaacccatcggcggcccgcctcgtgtcttcccacatgctcggaaggcaccgggtggtcgaccacatcgtcggccacctcgcggcgatcggaaccgaccacctcttcgcggtggacggcgccaacatcgaggacctctacgacgcggcgcatttccggccggagctcaccgcggtgctggccaagcacgagttctccgccgccgcgatggccgacggatacagccgaagcggagcgggactcggggtggtggccgcgacctcgggcggcggatcgctgaatctcgtggccggactcggcgagtcgctcgccagccgggtgccggtgctggcgctggtcggccagcccgccgccgcgctggacggccggggcagcttccaggacaccagcggcgccaacggatcgctggacgccggcgcgctgttctcggcggtctcggtgttctgccggcgagtgcaaacccccgacgacattgtttcgcttctgccgcaggccatttcggcggcgcgggccggaggcccagcggtgctgttgttgcctaaggacattcagcaggcccgggtcggcgtcggcgagcgcaacggccacggcgcacccggcgggcgagtcgcgattgcggcgcaatggcggcccccggccggcgacccgcacccgatcgcggcgcaattgcgccgcgtgaccggcgagatcgccatcatcgccggcgaacaggtggcccgcgacgacgcccgggccgagctcgaggagctgcgcgcgctgctgggggcgcgggtggccaccgtgccggacgccaaggacgtcgccggcgcacccgggccggacggccggacgctgggagtgaccggtgtgatgggccaccgcaacgtggccgaggcggtggcccgcagcgcggtgtgcctcatcgtcgggacccggctggcggtcaccgcgcgcagcggcctggacgacgcgctggccgcggtgcgcaccgtctcgatcgggtcggcgccgccctatctcgcctgcacccacgtgcacaccggcgacctgcgcggctcgctgcggctgctgatccgcgcgctgcgcggccaccggcgaccggtcgcgccggccgggcaaggcgggggccggccgaccgagctgacgccgccgccgtgcagggggccgggggtgcgctaccgcgacgcgatggcggtgctggacggcgtgctgccgcgcggcgccgacatcgtggtcgacgctggcaacaccggcgcggtcgcgatccactgtctgccggtgcgccgcgacggccggttcgtcgtcgcgctcggcatgggtggcatgggctacagcttcggggcggggatcggaatagcgttggggcgcaacaacagtggacgccctggcgggcgcaccgtcgtcatcgccggggacggcgcgttcttcatgcacggcatggaggtgcacaccgccgtgcaataccggctaccgatgacgttcgtgctgttcaacaacaacgcgcacgccatgtgcgtgacccgcgagcagctgttctacggcgaccgctacagctacaaccgttttcggcccagccggctgggcgccgggctggccgccatgttccccggcctgacctcggtggaggtcggcgacgtcgacgggttcgccgccgcgatggccgcggcgctcgatgtcgacggcccggcggtggtcagcgtcgagtgcgccgccgacgagatcccgccattcgccccgtttctcaccacgtcggcggtcaaagatgctgccgtcaaacagaattcagttacaaaggagatccgcaccaatgtcgctgccagcgcttgaggacatcggcgacctcatcgacggggtcacccgcatcgagaccagcccccgggagaaggccacgccgatcatcatggacatgatgcggtcggtgtacccgcacgaccaggtcttcgggcagtactgcaccgtcaacgactacatcgactgtccacccgacgacttgttcgagtatatggccgacacccgcagcctggaggagtggacctacagcctgcgcgggttcacccccaccgacgagcccgggctgtggctggcccacgaccggctcggttcggaaaccaagatctacacccgcaccgtcgccaacgcgcaggcgcggaccgtggactaccactgcgcctgggaccagggcgaccacctgtggatgatctacctgatgcgcgtcgtcgacgcccagactgtgctcgacaagccgggatcggttgtgctgtggaccaattgccatcacccgttctacgaccacaacccgtacccgcagaccgcgccgccgcagcgcccggtgtgggtgggcgacttctgggacatgttcggcgccggccatctgctggagctgcgcaacctcaaggcgatcgccgaataccgccatcggcacggcctgccggtcaccccggtgtggatgaggtgacgcgatgaacgcgtcaaccgtcagcctgatcgacgtcgccagctatctgccgggcgagccgatccccgccgactactacgcgcaattcgccgaatccgacgacctgcgcgacaacgtgatgttctgcgccccgaagtaccgccaccacgtcggccccgacgagagctccatcgacatgatcgaacgcgcggcacagggtttgatcgagcggcacggccacgacgtcatcgagggcgccgacgtgctgatcacccacacccaggtgcccgacatggcgttctacggccagggcggcggcatcgcgcaccggctgggcatgcgcccgtcctgggtgctcgacctcaacaacggcgggtgcgcggcattcgtgttggcgctcaacgtggctcgcacactgctgtcgtcgggccagggacgcaccgcgctgatcgcgatcgcccagaacgcggccggccagttcttcgaccagccgacgatccggcgcaaggcgcaggcggcggtgcccggcgacggcgccgcggtggggctggtcaccgtcggcgactcctcgcccgtcctcgacgtcgagtgccgcagctacggcgaatacgcgggcgagatgacgctgtcctacgacccgccccgcaagtggtggcaggccgggccaggcgagggcagcatcggcttcaccgacagcaagatcaccaaggtgctggcccgcggtaaccggcaggtacccgaggtggcgctggcggtatgcgatcgaatcgggttgcccgccaaagacatcgacctgctggtcaccaaccagccgaaccgggcgttcctgcgcaactggcgcgacgcgctggagctgccgccggcgcggcacctcgacaccttcgacgagtgcggcaacctgttcggtgccgggatcccggtcaacctcgaccgcgcgatatccgagcagcggatcaaggccggagacgtggtcatgatggcggcgttcgcgcacgccggcgatttcgccggcgccgccgcggtgcgctggggcgggcggggcggatgctgaccgtcccgcgcccggccgccggcggcatcggcgaggcgctgcccgacgcggtcgacccgtttgccttgtcgctcaacgagaatcccttcccgccgctgccggcggtgcgcgcggcgctgatccgttcggtgtgcaccgccaaccggtatccggagttcctgcccgagcggctgcgcggggtgatcgccgagcacatcggtgtgccggccgagctcgtggtgctgggcgccggagccaccggcgtgatgctgcaggtgctgcaggcgttgaccgcgccgggggacgccatcgcgatggccacccccaccttcgacgggtatccgatcgtggcgcggatggcccggctgaacaccatcgccgtcgcgctggacgagcacgggcagcacgacctggacgggctcgccgacgcggccgcgcgcgcccgcgtggtggtgctgtgccggccgcacaacccgaccggaaccgtggagcccgcggccgcagtcttccggttcctgcgccgggtgccgcgcgacaccgtcgtgctgctcgacgaggcctatgtcgaattcaccgcgcccgagcaccggatcgacgtcgcggcgctggtggcgtgcttccccaatgtggtggtggtgcgcaccttctccaaggcgtacggcctggccgggctgcggatcggctacggggtggcgtcgccgcggctggcgcggccgctgtgggaccagcagctgccgttcggcatcgcgatcaccagcctgctcgccgtcacggcgtcgtatcgggccgaagacgaactgtcccggcgcatccggtcgatcaccgccgaacgccgccggctgcggatgcggctgagcgcgctgggcgtctacaccaccaacgcgcacgcgaacttcgtttacctgccgcccgatccgcaggggcgcgcgtggcagcgggtcttcgcccgcggcggcgtccgggcgcgctactacccggacggcgcggcccggctgacggtgggcagtcgcgcctccacggtggcggtgctgtcggcggtgggaaaggccacgctggagcggcaagtgcggtaagaaagggcgtggccgactcacgtcctcacgaacgcgatccgatcgccgccgcccgggccaactgggagcgcgccgggtggggcgacgtggcgccgggcatggtcgcggtgacctcggtgatgcgcgcgcaccagatcctgctggcccgggtcgagacggcgctgcgcccgtacgacatgagcttctcccgctacgaactgctgcggctgctggcgttcagccggaccggggcgctgcccatcaccaaggcctccgaccggctgcaggtgcacgtcaccagcgtgacgcacgcgatccgccggctggaggccgacgggctggtgcagcgggtgcctcaccccaccgacgggcgcaccacgctggtgcagatcaccgagctgggccgctccaccgtcgaggacgccaccgtcaccctcaacaagcaggtgttcgccgacatcgggatgagcgacaccgagtcgcggcagctggcgtcgtcgatcgagacgctgcgccgcaacgcgggcgacttctgaactcgccccgcggcgccgagcgtcacgccagcgtgaccgtcgcgcccgggtgccacgccagcgtgacgctcggtgctagcaagcgccgcgcagcatctcgatgaccgcactgaagtccttgtcgccgtgggaggcggcgaattttgcgtaaatctccgcggcatgccggcccagcggggcggccgcgccggtcgaggtcaccgcgtccatcgcaagacccaggtccttgttcatcagcgaggcggcgaagcccggcttgaagtcgttgttggccggcgacgtcggaaccgggcccggcaccgggcaattggtgtgcacggcccagcagttgccggtcgccccggtgatcacgtcgaacagcgactgcgccgacaacccgagcttttcggccaggatgaatgcctcgccgatggcgatctgctgcaccgccagcaccatgttgttgcacaccttggcggcctgcccggccccggccgcaccgcagtgaatgatcttgcccgccatgggttccagcaccggccgggcccgctccagggcctcgggttcgccgcccaccatgaacgccagcgtgccggcgaccgcacccttcaccccgcccgagacgggcgcgtcgagctgcgccacgccgtgcgactgcgcttgcgcgtgcacctcgcgggcgtcggcgaccgagatcgtggagctgtcgatgaacagcgcgcccgggcgcgcggcgggcaggatctcggcgtagcagcgtttgaccacctcgccgttgggcagcatggtgatcaccacgtcggcccccgtcaccgcgtcggtggcggtgtcgaaaccggtgacaccggacgcggtggcggccgacagcgccgcgggcaccggatcgaatccgcgcaccgcatgttgggccgcaacgagattcgccgccatcggcgcgcccatgttgcccaggcccaggaaagccaccaccacgcgctcggtcatccgacggcctttctatgcggtggcccggaaccgcgccgcttcggcccggccgatgaccacccgcatgatctcgttggtcccctccaggatgcgatgcacccgcaggtcgcgcacgatcttctccagaccatactcgcgcagatagccgtagccgccgtgcagctgcagcgccttgtcggcgacctcgaagcaggtgtcggtgacgtagcgtttggccatcgcgcacaactcgaccttgtcgggatcgtcggcgtccagcgcaccggcggcccgccacaacatcattcgcgacgtttccaggccggtggccatgtcggccagggcgaaccggatggtcggctcgtcgagcagcggcgacccgaacgcctgccgatcgcgcacgtaggccccggccttgtcgaaggccgcctgcgcgccgcccagcgagcacgcggcgatgttgagccggccgccgttgaggccgttcatcgcgatgccgaatccggcgccctcaccctcggcgccgcccagcatcgcgtcggcgggcacccgcaccccctccaggatcacctgcgcggtgggttgggcgtgccagcccatcttctcctcgggcgaaccgaaactcagcccagcagaacccttttcgacgacgaacgcggagatgccgcgcggcccttcaccgcccgtgcgggccatcaccaggtagacgtcggaggccccggcgcccgagatgaactgcttgacgccgtccagcacgtaatcgccgccctgtctgaccgcgcgggtgctcagcgcggcggcgtcggaccccgcgcccggctcggtcaggcagtagctggcgatgacgtccatcgccgccagccgcggcacccaggccttgcgctgttcgggcgtgccgtagctgtcgatcatccacgcgcacatgttgtggatggacaggaacgcggccgtggtggggtcggcgatggccagctgctcgaagatgcggaccccgtccagccggcgcagcccgctgccgccgacgtcctcgcggcagtagatcgccgccatcccgagctcggccgactcgcgcagcacgtcaaccggaaagtgttcggccgcatcccattccagcgcgtgcggggccaggcgcttggcggcgaacgcggcggccgtctcggcgatcacccgctcgtcgtcgtccagggtaaacatagtggggccggaattccttctcggttctaatccattgtgggaatcacgaattcggcgccgtccttgatgccggacggccaccgcgacgtgacggtcttgaccttggtgtagaactggatcgacgccggcccgtgctggttgaggtcgccgaagccggagcgcttccagccgccgaaggtgtggtaggccaccggcaccgggatcggcacgttgaccccgaccatgccgacctgcacccgggacacgaaatcgcgggcggcgtcgccgtcgcgggtgaacaccgccaccccgttgccgtactcgtgctcggagggcagccgcagcgcctcctcgtagttctgcgcccttacgatgcacagcaccggcccgaagatctcgtcggtgtagatggacatatcgggcgtgacgtggtcgaacagggtaggcccgatgaagaagccgccctcgaggttggcgtccccgaaagtcaggtcgtcgctgcggcgttcgcggccgtccaccacgatctcggcgccggcggccacgccctggtcgatgtagtcgcgcacccgcgccaccgcggccccggtcactagcgggccgtagtcggccttggggtccaggctgtgccccacccgcaggttgttgatccgctcgacgagccgggcccgcagccggtcggcggtcttgtcgccgaccgggaccgcgaccgaaatcgccatgcagcgctcgccggcgctgccgtacccggcgccgatcagcgcgtcgacggcctggtccaggtcggcgtcgggcatcacaatcatgtggttcttggcgccgccgaagcactgcgagcgcttgccggtggcggcggccccggcgtagatgtactgggcgatgtccgagctgccgacgaacccgaccgcctggatgtcggggtggttcaggatggcgtcgacggcctccttgtcgccgtgcaccacctggaacacgcccggcggcaggcccgcctcgacgaagagctcggccagccgcaccggcaccgacgggtcgcgctcgctgggcttgagcacgaacgcgttgccgcaggccagcgcgggcccggccttccacagcgggatcatcgccgggaagttgaacggggtgatgccggcgaccacgcccagcggctggcgcagcgaatagacgtcgatgccgggcccggcgccctcgctgtactcacccttgagcaggtgcgggatgccgacgcagaactcgatcacctcgatgccgcgctggatgtcgcccttggcgtcggccagggtcttgccgtgctcgcgcgacagcagctcggccagctcgtcgttgtgttggttgaccagctcgatgaaacgcatcagcacccgggcgcggcgttgcggattcgttgcggcccaacccttttgcgcctcgatggccgaagccaccgcggcgtcgatgtcggcccggcccgccatcggcacctgcgcctggacggccccggtgctggggtcgaagacgtcggcggtgcgagtggattgcccggcggtgcgctgcccgtcgatgaagtgcggaatctgtgtggtcatggggccctcgaaggtggtggacggcacgggacgtgacgcggatacttgcatatcctagtaacccggttccggccttggcaagcggcgcccggggctagcctgaggcctgtatgcacaccatcgaggccgactacctggtggtcggcgccggcgccatgggcatggcgttcatcgacacgctggtcaccgagacggccgcgtcgcaggcccgtgtcgtggtggtggaccgccatcacgcgccgggcgggcactggaccatggcgtatccgttcgtgcggctgcatcaaccctcggcgttctacggcgtcaactcgctgcgcctgggcggcgacagcatcgaccaaatcggttggaaccgcggcctttacgaattggcgacggccgacgagatctgcgcctactacgaccgcgtcatgcgcacccggctgctgccgaccgggcgcgtgcgctacttcccggacagcgagtaccgcggcgacgggcggtttcgcacctcggccggcgccgaccacaccgtcgaggtgacccgccgcatcgtcgacgccacctacatgcacgtcagcgtgccggcgatgcgcccaccgccctacaccgtcggcgacggcgtcgactgtgtgccgcccaacgagctgccgcgccggcccggatatcagcgctacgtcgtcgtcggggccggcaagaccggcatcgacacgtgcctgtggctgctgggccggggcgtcgagccggacc

(The sequence listing continues in the following parts.)

What is claimed is:

1. A method for detecting the presence or absence of *M. paratuberculosis* in a biological sample, comprising the steps of:
contacting said biological sample with an isolated nucleic acid under standard amplification conditions, wherein said nucleic acid comprises a nucleic acid molecule, wherein said nucleic acid molecule is at least 10 nucleotides in length, wherein said nucleic acid molecule has at least 75% sequence identify to an aligned portion of SEQ ID NO:1355 or the complement of SEQ ID NO:1355, wherein an amplification product is produced if *M. paratuberculosis* nucleic acid is present in said biological sample; and
detecting the presence or absence of said amplification product,
wherein the presence of said amplification product indicates the presence of *M. paratuberculosis* in the biological sample, and wherein the absence of said amplification product indicates the absence of *M. paratuberculosis* in the biological sample.

2. The method of claim 1, wherein said biological sample is obtained from a cow, a sheep, a goat, a rabbit, a deer, an antelope, a bison, or a human.

3. The method of claim 1, wherein said biological sample is a fecal sample, a blood sample, or a milk sample.

4. The method of claim 1, wherein said nucleic acid molecule comprises a nucleic acid sequence selected from the group consisting of SEQ ID NOs: 46-101, 1343-1353, and 1354.

5. The method of claim 1, wherein said detecting comprises electrophoretically separating said amplification product.

6. The method of claim 1, wherein said nucleic acid is labeled.

7. The method of claim 1, wherein said nucleic acid molecule has 75% sequence identity to SEQ ID NO:1355.

8. The method of claim 1, wherein said nucleic acid molecule has 80% sequence identity to SEQ ID NO:1355.

9. The method of claim 1, wherein said nucleic acid molecule has 85% sequence identity to SEQ ID NO:1355.

10. The method of claim 1, wherein said nucleic acid molecule has 90% sequence identity to SEQ ID NO:1355.

11. The method of claim 1, wherein said nucleic acid molecule has 95% sequence identity to SEQ ID NO:1355.

12. The method of claim 1, wherein said nucleic acid molecule has 99% sequence identity to SEQ ID NO:1355.

13. The method of claim 1, wherein said nucleic acid molecule comprises SEQ ID NO:110.

14. The method of claim 1, wherein said nucleic acid molecule comprises SEQ ID NO:313.

15. The method of claim 1, wherein said nucleic acid molecule comprises SEQ ID NO:551.

16. The method of claim 1, wherein said nucleic acid molecule comprises SEQ ID NO:748.

17. The method of claim 1, wherein said nucleic acid molecule comprises SEQ ID NO:929.

18. The method of claim 1, wherein said nucleic acid molecule comprises SEQ ID NO:1175.

19. The method of claim 1, wherein said nucleic acid molecule comprises SEQ ID NO:1342.

20. The method of claim 1, wherein any of said molecules that are 10 to 30 nucleotides in length, in combination with an appropriate second nucleic acid molecule, under standard amplification conditions, generates an amplification product from *M. paratuberculosis* nucleic acid but does not generate an amplification product from nucleic acid of any of the organisms selected from the group consisting of *M. phlei*, *M. smegmatis*, *M. intracellulare*, *M. fortuitum*, *M. bovis*, and *M. tuberculosis*.

21. A method for detecting the presence or absence of *M. paratuberculosis* in a biological sample, comprising the steps of:
contacting said biological sample with an isolated nucleic acid under hybridization conditions, wherein said nucleic acid comprises a nucleic acid molecule, wherein said nucleic acid molecule is at least 10 nucleotides in length, wherein said nucleic acid molecule has at least 75% sequence identify to an aligned portion of SEQ ID NO:1355 or the complement of SEQ ID NO:1355, wherein a hybridization complex is produced if *M. Paratuberculosis* nucleic acid is present in said biological sample; and
detecting the presence or absence of said hybridization complex,
wherein the presence of said hybridization complex indicates the presence of *M. paratuberculosis* in said biological sample, and wherein the absence of said hybridization complex indicates the absence of *M. paratuberculosis* in said biological sample.

22. The method of claim 21, wherein nucleic acids present in said biological sample are electrophoretically separated.

23. The method of claim 22, wherein said electrophoretically separated nucleic acids are attached to a solid support.

24. The method of claim 23, wherein said solid support is a nylon membrane or a nitrocellulose membrane.

25. The method of claim 21, wherein said nucleic acid molecule is labeled.

26. The method of claim 21, wherein said biological sample is selected from the group consisting of a fecal sample, a milk sample, and a blood sample.

27. The method of claim 21, wherein said biological sample is obtained from a cow, a sheep, a goat, a rabbit, a deer, an antelope, or a bison.

28. The method of claim 21, wherein said nucleic acid molecule has 75% sequence identity to SEQ TTS NO:1355.

29. The method of claim 21, wherein said nucleic acid molecule has 80% sequence identity to SEQ ID NO:1355.

30. The method of claim 21, wherein said nucleic acid molecule has 85% sequence identity to SEQ ID NO:1355.

31. The method of claim 21, wherein said nucleic acid molecule has 90% sequence identity to SEQ ID NO:1355.

32. The method of claim 21, wherein said nucleic acid molecule has 95% sequence identity to SEQ ID NO:1355.

33. The method of claim 21, wherein said nucleic acid molecule has 99% sequence identity to SEQ ID NO:1355.

34. The method of claim 21, wherein said nucleic acid molecule comprises SEQ ID NO:110.

35. The method of claim 21, wherein said nucleic acid molecule comprises SEQ ID NO:313.

36. The method of claim 21, wherein said nucleic acid molecule comprises SEQ ID NO:551.

37. The method of claim 21, wherein said nucleic acid molecule comprises SEQ ID NO:748.

38. The method of claim 21, wherein said nucleic acid molecule comprises SEQ ID NO:929.

39. The method of claim 21, wherein said nucleic acid molecule comprises SEQ ID NO:1175.

40. The method of claim 21, wherein said nucleic acid molecule comprises SEQ ID NO:1342.

41. The method of claim 21, wherein any of said molecules that are 10 to 30 nucleotides in length, in combination with an appropriate second nucleic acid molecule, under standard amplification conditions, generates an amplification product from *M. Paratuberculosis* nucleic acid but does not generate an amplification product from nucleic acid of any of the organisms selected from the group consisting of *M. phlei, M. smegmatis, M. intracellulare, M. fortuitum, M. bovis*, and *M. tuberculosis*.

* * * * *

UNITED STATES PATENT AND TRADEMARK OFFICE
CERTIFICATE OF CORRECTION

PATENT NO.         : 7,867,704 B2
APPLICATION NO.    : 10/934893
DATED              : January 11, 2011
INVENTOR(S)        : Vivek Kapur et al.

It is certified that error appears in the above-identified patent and that said Letters Patent is hereby corrected as shown below:

Title Page;
Column 1, Item (73), (Assignee), line 3, please delete "America" and insert --America,-- therefor.

Column 93, line 23 (Claim 1), please delete "identify" and insert --identity-- therefor.

Column 94, line 40 (Claim 21), please delete "identify" and insert --identity-- therefor.

Column 94, line 43 (Claim 21), please delete "Paratuberculosis" and insert --paratuberculosis-- therefor.

Column 94, line 67 (Claim 28), please delete "TTS" and insert --ID-- therefor.

Column 96, line 12 (Claim 41), please delete "Paratuberculosis" and insert --paratuberculosis-- therefor.

Signed and Sealed this
Twenty-second Day of March, 2011

David J. Kappos
*Director of the United States Patent and Trademark Office*

UNITED STATES PATENT AND TRADEMARK OFFICE
CERTIFICATE OF CORRECTION

| | | |
|---|---|---|
| PATENT NO. | : 7,867,704 B2 | Page 1 of 1 |
| APPLICATION NO. | : 10/934893 | |
| DATED | : January 11, 2011 | |
| INVENTOR(S) | : Kapur et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1251 days.

Signed and Sealed this
Thirty-first Day of May, 2011

David J. Kappos
*Director of the United States Patent and Trademark Office*